United States Patent 8,344,211 (PLANT NUCLEOTIDE SEQUENCES AND CORRESPONDING POLYPEPTIDES) - sequence listing, part 12

SEQ ID NO: 44981 - DNA, 762 bp, Zea mays
  misc_feature: Ceres CLONE 1448038-F
  misc_feature: Encodes the peptide sequence at SEQ ID NO. 44982
  misc_feature (562)..(562): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (573)..(573): n is a, c, t, g, unknown, or other
  misc_feature (621)..(621): n is a, c, t, g, unknown, or other
  misc_feature (638)..(638): n is a, c, t, g, unknown, or other
  misc_feature (729)..(729): n is a, c, t, g, unknown, or other
aagctggagctccccgcggtggcggccgctctagaactagtggatcccccgggctgcaggaattcgcacgagaccattacctagaacatcctaatcgaaaaagatctcttccttgttctcgcctcgtcgtccccaatcgtcgccgggagtctcccgatccttcttccaccacctcaccggtggtgtcagggccggctcgcggacggtgcttggactgcccccgtcccgtcatggatcgcgccgagctcaccaccgaacaggttctgaagcgagatattccatgggagcattacatgtcaactaagcttatctccggaacgtgccttcagcttttacggcgatatgaccacaaaccggagagccagcgagctcctttgcttgaggaggatgggccagcatatatccgagttttcctgaatatcctgcggagcatctccaaggaagagactgtggaatacgtgcttgcactcattgatgaaaatgcttgcacaaatcctaagcgtgcagcactgttttatgatcaatctttgtcgggtgaagatatttatgaaccgttcttaangtnnngtatgnaaggcaactggtttgtacaagaaaaaagtgtaagatattgactgttantattagtgcacgacaangcttcagaatggcacactcaaaatggagatgcttcgaattcgagaagcagcttacttcaacacacgatgtattgagagtttggtttgattngctctgttcaagctgaagaatctacccacccga

SEQ ID NO: 44982 - protein, 127 aa, Zea mays
  misc_feature: Ceres CLONE 1448038-F
  misc_feature: SWISSPROT Homolog: EC 3.6.3.14 H(+)-transporting two-sector ATPase
  misc_feature (111)..(111): Xaa is any aa, unknown, or other
  misc_feature (112)..(112): Xaa is any aa, unknown, or other
  misc_feature (113)..(113): Xaa is any aa, unknown, or other
  misc_feature (115)..(115): Xaa is any aa, unknown, or other
MDRAELTTEQVLKRDIPWEHYMSTKLISGTCLQLLRRYDHKPESQRAPLLEEDGPAYIRVFLNILRSISKEETVEYVLALIDENACTNPKRAALFYDQSLSGEDIYEPFLXXXMXGNWFVQEKSVRY

SEQ ID NO: 44983 - DNA, 790 bp, Zea mays
  misc_feature: Ceres CLONE 1448051-F
  misc_feature: Encodes the peptide sequence at SEQ ID NO. 44984
  misc_feature (324)..(324): n is a, c, t, g, unknown, or other
  misc_feature (331)..(331): n is a, c, t, g, unknown, or other
  misc_feature (332)..(332): n is a, c, t, g, unknown, or other
  misc_feature (348)..(348): n is a, c, t, g, unknown, or other
  misc_feature (396)..(396): n is a, c, t, g, unknown, or other
  misc_feature (402)..(402): n is a, c, t, g, unknown, or other
  misc_feature (418)..(418): n is a, c, t, g, unknown, or other
aaagctggagctccccgcggtggcggccgctctagaactagtggatcccccgggctgcaggaattcgcacgagaccattacctagaacatcctaatcgaaaagtgcttcctcctaggtcattccacttccaccaatctgtctcccaatctttcttctgctccaatccgctctctttactcggccagcggaaggggagaggagggcgagatgacggtggagaaggtggacgcggggctttccgacttcgaagcccacttcgatcgcctcttcgcttccccggacgccgcctccgacggcaaggtgaagctgctgctcttcctggncgaccgnncagctgactcctcccntctctggtgccccgactgcaacgtggcggagccggtgatctacgagcngctggnaggactggaggccaangacgcggtgctcctgcccgcctacgtcggggacaagcccacttggggcgaccccgcgcacccggggaaggtgagacccaggttccgggttcagggcgtggccaaccttaaccccttggaggaagggccccccccccccccccctggggaaaacaaggccccctagggaaagggtaaccccccccctggggtggggggattgggtttgggctcggaaaaacccgggtcccctgcgggtcccccggggaagaggggccaaaaaaaaagaggggcgtggttttctttcctctttgccaaacaaaaaggggaggaaggggggaaatataaatttcttttttcaaaaaaaaaaaaaaatattttttctccccccccc

SEQ ID NO: 44984 - protein, 124 aa, Zea mays
  misc_feature: Ceres CLONE 1448051-F
  misc_feature (9)..(111): Pfam Name: DUF953 Pfam Description: Eukaryotic protein of unknown function (DUF953)
  misc_feature (39)..(39): Xaa is any aa, unknown, or other
  misc_feature (42)..(42): Xaa is any aa, unknown, or other
  misc_feature (47)..(47): Xaa is any aa, unknown, or other
  misc_feature (63)..(63): Xaa is any aa, unknown, or other
  misc_feature (65)..(65): Xaa is any aa, unknown, or other
  misc_feature (70)..(70): Xaa is any aa, unknown, or other
MTVEKVDAGLSDFEAHFDRLFASPDAASDGKVKLLLFLXDRXADSSXLWCPDCNVAEPVIYEXLXGLEAXDAVLLPAYVGDKPTWGDPAHPGKVRPRFRVQGVANLNPLEEGPPPPPPGENKAP

SEQ ID NO: 44985 - DNA, 767 bp, Zea mays
  misc_feature: Ceres CLONE 1448052-F
  misc_feature: Encodes the peptide sequence at SEQ ID NO. 44986
  misc_feature (349)..(349): n is a, c, t, g, unknown, or other
aagctggagctccccgcggtggcggccgctctataactagtggatcccccgggctgcaggaattcgcacgagaccattacctagaacatcctaatcgaaaactttcaacttcgttcgcaagaagctcagaagtcagatcagaagccgccgaggggaggcgccgacgccgagtttttgctccatcccgcatccaccgccagaatgtttctcacgaggacggagtacgaccgcggggttaacaccttctcgccggaggggcggctgttccaggtcgagtacgccatcgaggccatcaagttgggatccactgcgatcgggttgaaaacaaaggatggtgttgtccttgctngtgagaaacgtgtgacctcgccactgctggaaccaagcagtgtggaaaaatcatggaaatgacgacacataggctgtgccatgagtgggcttattgctgatgctagacactagtcgagcatgctcgtggtgaaactcgaaatcataggtctcataccgggaggccatggacgtaaaatcttcaaccaagccattttgagactacccctgccctttggcaaagggaaaaaaattcaatgtcccgggcctttggagtcccctctctattgcggggcatggagaaaatgggccttccctggttacccccgcccccctcgtggctttttgggaaaggcccccccaggcctttttggttcggcctaaaaaggattaaaaccccctttggggaaaaacaaaaaaggattggccccttgagagat

SEQ ID NO: 44986 - protein, 69 aa, Zea mays
  misc_feature: Ceres CLONE 1448052-F
  misc_feature: SWISSPROT Homolog: EC 3.4.25.1 Proteasome endopeptidase complex
  misc_feature (50)..(50): Xaa is any aa, unknown, or other
MFLTRTEYDRGVNTFSPEGRLFQVEYAIEAIKLGSTAIGLKTKDGVVLAXEKRVTSPLLEPSSVEKSWK

SEQ ID NO: 44987 - DNA, 776 bp, Zea mays
  misc_feature: Ceres CLONE 1448054-F
  misc_feature: Encodes the peptide sequence at SEQ ID NO. 44988
  misc_feature (278)..(278): n is a, c, t, g, unknown, or other
  misc_feature (364)..(364): n is a, c, t, g, unknown, or other
  misc_feature (398)..(398): n is a, c, t, g, unknown, or other
  misc_feature (776)..(776): n is a, c, t, g, unknown, or other
aacagctggagctccccgcggtggcggccgctctagaactagtggatcccccgggctgcaggaattcgcacgagaccattacctagaacatcctaatcgaaaactctctctcctgcgctgggtttaacgcagcggtaggcgatttcccccgatgcccccgtcgtgggtttgtccccgtggaaagaagcaccgctcccgtggaaacaagaagtcgttctagggatccaagatggcggcgcggatgctcatcgccgatccgcccagaatactacgccgtncagcccccaagccccatgcacccacctctccagccactcctcccgctgccaaaaagccagatctggttgagcgcactggagatttnggggtaatggccccaccggggggggggtctccanccccccgttgaaaccccaccccgtgtggtgcgacaacataaaactcctccccgagacccccacagttgggggcagcttggataaggcaatagggttttcccctcccccacctaggggttcctgcaaatccccaactctcctcaaggccgaatatttttgaaaaaggcattttcacaaacagtttttgggagcgctcagggccatcccacactcctaaggcgtcggagtgcagggcccaccaagcctctaggggacacctctctggggctaagcttgggttcctcaccgcgtttctgtctcgcttcccaacactggggacgtggctcggacaacgcttggtcttccggtgtgtcccccgctaattttggtccccctccn

SEQ ID NO: 44988 - protein, 59 aa, Zea mays
  misc_feature: Ceres CLONE 1448054-F
  misc_feature (17)..(17): Xaa is any aa, unknown, or other
  misc_feature (45)..(45): Xaa is any aa, unknown, or other
  misc_feature (57)..(57): Xaa is any aa, unknown, or other
MAARMLIADPPRILRRXAPKPHAPTSPATPPAAKKPDLVERTGDXGVMAPPGGGSPXPR

SEQ ID NO: 44989 - DNA, 760 bp, Zea mays
  misc_feature: Ceres CLONE 1448056-F
  misc_feature: Encodes the peptide sequence at SEQ ID NO. 44990
  misc_feature (423)..(423): n is a, c, t, g, unknown, or other
  misc_feature (426)..(426): n is a, c, t, g, unknown, or other
  misc_feature (557)..(557): n is a, c, t, g, unknown, or other
atagctggagctccccgcggtggcggccgctctagaactagtggatcccccgggctgcaggaattcgcacgagaccattacctagaacatcctaatcgaaaactactctgcttgccatccgccgccgtctcctacccactctccctatccggcggtgcagcatcacccagcggcgcgcgcagggcaccgggcagccatcggactcgccaagccgcgcggcgggcggccttgccgagccaggcgtcgggcggcctcgccgagccaagtcggggctggagttccgcgtgggtgggccgcgcgagtggcgcgtcccggacgccacaccagctacggatgggtgggcatgaaacaccgcttccacgtcggcgaccgcctctattttcagtacgcgaacgactcggtgctggtggtgaaccgcctggnctncgacggctgcaacgccagcgcgccgctcgccgcgttcgccggcgggcccacgaagtctgcctccacgccgggcttcttctgcttcattagggggaagcagggactggaaagaaaaaggccaaagccccccncaccctggtgggcggggtttaagcccccggaagggttggccccacttggcttttgggggggaaatgggggggaaaaccccaccaaaccccttttgttaaaaaaagcgccaggcccaaatttccgctccaaaaattgggggcccccgaagaccctttttttttaaaatttccccaaaaaaagttttccccaaaacatttttttc

SEQ ID NO: 44990 - protein, 125 aa, Zea mays
  misc_feature: Ceres CLONE 1448056-F
  misc_feature (1)..(63): Pfam Name: Cu_bind_like Pfam Description: Plastocyanin-like domain
  misc_feature (27)..(27): Xaa is any aa, unknown, or other
  misc_feature (28)..(28): Xaa is any aa, unknown, or other
  misc_feature (72)..(72): Xaa is any aa, unknown, or other
MKHRFHVGDRLYFQYANDSVLVVNRLXXDGCNASAPLAAFAGGPTKSASTPGFFCFIRGKQGLERKRPKPPXPWWAGFKPPEGLAPLGFWGGNGGENPTKPLLLKKAPGPNFRSKNWGPPKTLFF

SEQ ID NO: 44991 - DNA, 835 bp, Zea mays
  misc_feature: Ceres CLONE 1448057-F
  misc_feature: Encodes the peptide sequence at SEQ ID NO. 44992
  misc_feature (404)..(404): n is a, c, t, g, unknown, or other
  misc_feature (457)..(457): n is a, c, t, g, unknown, or other
  misc_feature (493)..(493): n is a, c, t, g, unknown, or other
  misc_feature (498)..(498): n is a, c, t, g, unknown, or other
  misc_feature (835)..(835): n is a, c, t, g, unknown, or other
aagctggagctccccgcggtggcggccgctctagattagtggatcccccgggctgcaggaattcgcacgagaccattacctagaacatcctaatcgaaaacccactcgagccagccagccagccagcgagccgcttgggcgccatctctctagagcttcgtaccctcgaagagagatccggcgcggtccaataaacacccggcttactacagactcccagatggacggcctcaggatgaagtacgacgccgtcgccgccatggacgccgcgctcgtggcgtccgacgtaatcgccgaggccgccgcccaggatcccgcggcctccttctctgaccccgtacccctcgctgcgggcgtctttcttttttgttttttttttaaaccggcggggggggggataaacnattaaataaatttttcccccccccccaagttgttttttttgtggttagagganatattaataatccgcctcccaccccccccccaccanccccngtaagctgctgtgagtttagtttgtcttcctaattttgagcttattctcatcctagagtttcttatctctagtttctgactcttcttgtgtggtggagtcctccattttcctcttgcggcaaaatctttctcactccgcctctccaccgctcaaccgcgcacgggagagctctccactactctcagctgagagacttcctgatgtgttgtttagtagatactatgttcttgctttagctctcgtctcaggatcgagctcgcctgcgagacccccattctcgctctgctctggctctcttctagacttgctcattattgctacggctcatctcccgcn

SEQ ID NO: 44992 - protein, 61 aa, Zea mays
  misc_feature: Ceres CLONE 1448057-F
MDGLRMKYDAVAAMDAALVASDVIAEAAAQDPAASFSDPVPLAAGVFLFCFFFKPAGGGIN

SEQ ID NO: 44993 - DNA, 765 bp, Zea mays
  misc_feature: Ceres CLONE 1448059-F
  misc_feature: Encodes the peptide sequence at SEQ ID NO. 44994
  misc_feature (359)..(359): n is a, c, t, g, unknown, or other
  misc_feature (417)..(417): n is a, c, t, g, unknown, or other
  misc_feature (459)..(459): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccatacctagaacatcctaatcgaaaacccattctccactccgctctctcaaactccccggctccccgctctcccccgcccgtccagctcgtgctccgcctccgctgctctgccctcttcctcctctgcgtttctcctcagagctgtttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccngatcatgaagaaggcgctcccggccaacgccaagatctccaaggacgcccaagagacngtgcaggagtgcgtgtcggagttcatctccttcatcaccggncgagccctcgaacagtgccagcgcgagaagcgcaagaccatcaacggcgacgacctactctgggccatgaccacgctcggcttcgaagactacgtcgagccgctcaagctctacctccacaagttccgcgagctcgaggccgagaaggcggccacaacgagcgcctcttccggcccgcagccgccgctgcacagggagaagaacnccgtcgtcgtcaacgcacaatggcgcgggcgggcccccgtcggggatacgccatgtaccggcgccccggccggggaaaccgtattatcatgatgatgggac

SEQ ID NO: 44994 - protein, 164 aa, Zea mays
  misc_feature: Ceres CLONE 1448059-F
  misc_feature (24)..(89): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 62 in the 10/675,852 US patent application
  misc_feature (33)..(33): Xaa is any aa, unknown, or other
  misc_feature (135)..(135): Xaa is any aa, unknown, or other
MPDSDNESGGPSNAEFSSPREQDRFLPIANVSXIMKKALPANAKISKDAQETVQECVSEFISFITGRALEQCQREKRKTINGDDLLWAMTTLGFEDYVEPLKLYLHKFRELEAEKAATTSASSGPQPPLHREKNXVVVNAQWRGRAPVGDTPCTGAPAGETVLS

SEQ ID NO: 44995 - DNA, 764 bp, Zea mays
  misc_feature: Ceres CLONE 1448063-F
  misc_feature: Encodes the peptide sequence at SEQ ID NO. 44996
  misc_feature (495)..(495): n is a, c, t, g, unknown, or other
  misc_feature (647)..(647): n is a, c, t, g, unknown, or other
aagctggagctccccgcggtggcggccgctctagaactagtggatcccccgggctgcaggaattcgcacgagaccattacctagaacatcctaatcgaaaagatcactcagctcgcagctagcttttcacgtacacagttgcagttcagagagaagagaaagagaccgagatctcgccgatagctagcatcatggcgtccaaggcgctcctcgtggtagcgctcctgctcgccgccaccttcctcgccgcctccgctaacgagcaagccaaggcggccaaagaggagaataaggcggaggtccaagactggcacggcggcggcggcggctacccgggcggcggcggcggctggcacggcgggggcggcggctacccgcactgccggtggggctgctgcaaccgcgggtaccatggcggctgccggtgctgctcgcaccctgatcagataccagagcccatgtaccgtcctgagctcgtcgaggtccacactaaancactaaataacgagctgcgctgctacgtatatatacgtacgtatgcccgaggggaaagaacgagaaagcagagcacacgtagtacgctcgtcgtagtagtagtcaataaaagtttggttcccatcacgtcatgaaataaaaagtagggaggntgcacgcttttgtgtgcgtgcttggaaacgtcgactgtatctcatgtatcgaataaatgattttgtccaaaaaaaaaaaaaaagcttatcgataccgtcgactcgaggggggcccgc

SEQ ID NO: 44996 - protein, 145 aa, Zea mays
  misc_feature: Ceres CLONE 1448063-F
  misc_feature (1)..(77): Pfam Name: GRP Pfam Description: Glycine rich protein family
  misc_feature (102)..(102): Xaa is any aa, unknown, or other
MASKALLVVALLLAATFLAASANEQAKAAKEENKAEVQDWHGGGGGYPGGGGGWHGGGGGYPHCRWGCCNRGYHGGCRCCSHPDQIPEPMYRPELVEVHTKXLNNELRCYVYIRTYARGERTRKQSTRSTLVVVVVNKSLVPITS

SEQ ID NO: 44997 - DNA, 764 bp, Zea mays
  misc_feature: Ceres CLONE 1448066-F
  misc_feature: Encodes the peptide sequence at SEQ ID NO. 44998
aaagctggagctccccgcggtggcggccgctctataactagtggatcccccgggctgcaggaattcgcacgagaccattacctagaacatcctaatcgaaaaatatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccaacgcggcgggaagacgtcgcagatctacgccattcgccaggccgtcgccaaggggctcgtcgcctactaccagaagtacgtcgacgaggccgccaagaaggatgtcaaggacatcttcacccggtacgaccgcacccttctcgtcgccgaccccaggcgctgcgagccgaagaagttcggttgtcgcgtcgcccgcgccaggttccagaagtcctaccgttgagcgctcggctgcccgcgcttgccgtaccgatgcctgtgttgtcccaacttgcccgttccaatgctgtacccgtggcttaaattttcatcatcggagctaacttagggggttctataacaagaagctg

SEQ ID NO: 44998 - protein, 149 aa, Zea mays
  misc_feature: Ceres CLONE 1448066-F
  misc_feature (17)..(149): Pfam Name: Ribosomal_S9 Pfam Description: Ribosomal protein S9/S16
MSTVLQRPTPGTVQCFGRKKTAVAVAYTKPGRGLIKVNGVPIELIRPEMLRLKAFEPILLAGRSRFKDIDMRIRVQRGGKTSQIYAIRQAVAKGLVAYYQKYVDEAAKKDVKDIFTRYDRTLLVADPRRCEPKKFGCRVARARFQKSYR

SEQ ID NO: 44999 - DNA, 765 bp, Zea mays
  misc_feature: Ceres CLONE 1448067-F
  misc_feature: Encodes the peptide sequence at SEQ ID NO. 45000
  misc_feature (322)..(322): n is a, c, t, g, unknown, or other
  misc_feature (419)..(419): n is a, c, t, g, unknown, or other
tggagctccccgcggtggcggccgctctagaactagtggatcccccgggctgcaggaattcgcactagaccattacctagaacatcctaatcgaaaagttgcacataaaaattcccacgccccgcacccaacgacctccgcgtccgcccccaaaacccccgcaaaccctagccgccgccagctaggcaaggaatggccgccctcctgcggctcgccgcagcccgatccgccctccccaggcgcgccctcgccccacaccggaggctcgcggcggcggcggcggccgcgatggaggagtggtggtccgactggaagcaggacngcgaagaagaggcgcgcgcctcggcgccgggcgccggccttgaccccgccggcgggggccccgggggcgtgcaatgggtcgtcatgggcccccctgncccgcagaaacacgcccacgccgcgcgcttcgccgaggtgctcgccgtgccctacatctccatgggcgcgctcctcaggcaggagctcaccccctcctcgcaactctacaggaagatggcaaactctgtgaatgaaggagggcttgtgccggaggcatcatatttgggttgctgacaaagcggcttgaggacgaatacacaagggggaaaagggtttcattcttgatgggattcccccacccgtatgcaagcttaaaatcctgaccaaattggggaaggtaattttgggtcctaaattcaaaggggccggaaggctgttccctgaaaaaccaatcgagagggacct

SEQ ID NO: 45000 - protein, 133 aa, Zea mays
  misc_feature: Ceres CLONE 1448067-F
  misc_feature: SWISSPROT Homolog: EC 2.7.4.3 Adenylate kinase
  misc_feature (44)..(44): Xaa is any aa, unknown, or other
  misc_feature (76)..(76): Xaa is any aa, unknown, or other
MAALLRLAAARSALPRRALAPHRRLAAAAAAAMEEWWSDWKQDXEEEARASAPGAGLDPAGGGPGGVQWVVMGPPXPQKHAHAARFAEVLAVPYISMGALLRQELTPSSQLYRKMANSVNEGGLVPEASYLGC

SEQ ID NO: 45001 - DNA, 854 bp, Zea mays
  misc_feature: Ceres CLONE 1448068-F
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (411)..(411): n is a, c, t, g, unknown, or other
  misc_feature (854)..(854): n is a, c, t, g, unknown, or other
gctcttaactagtggatcccccgggctgcaggaattcgcacgagaccattacctagaacatcctaatcgaaaacttctgaagtttccgcggcggcgtaggtagcggcggtgtgcttgtgatctcaatctcaaccccaggcgagctcggctccggtcacccgtcgatccaccctaccatgtcaaggaggaagaccagggagcccaaggaggaaaacgttccccttggacccactgtcccctaaaggaaagtttgcctttgggggtgctcaaatttttgcacccttcaggggccccttcatccaggcccgtgaattgcccgggaagggaaatttttggttttggattaaggcacggcttaaagttttaaggcttaatggtgttaaagtnnnaccgggacttgcccccaaaaantgggtggaaaaaaaatgtagcactttggttggaaaaggagccccgcaaaaacaacaaccctaaaaaattaaaacttttgcgccctccttggagggaaattaaaaccataaaaccccctggaaaccgggggtctttattctggcgtccacaggtgtctttgggcgcagttcggggggaaaaaaacttttaccctatttcttgttttttttacccccgtgtttcccttggggcactcttctcccaataaatggttctttaataagagaaaagacagcggaaagggaggttaccctcctagaatttactggataatgttttgttcgggagctcaagaagtcactctctctctttttttttctccacacgaaagcgcacctgctttctcactcatcactcgctccctgcttggaaagtatcttttatttattcacactttcctcccn

SEQ ID NO: 45002 - DNA, 742 bp, Zea mays
  misc_feature: Ceres CLONE 1448070-F
  misc_feature: Encodes the peptide sequence at SEQ ID NO. 45003
  misc_feature (683)..(683): n is a, c, t, g, unknown, or other
  misc_feature (686)..(686): n is a, c, t, g, unknown, or other
aagctggagctccccgcggtggcggccgctctagaactagtggatcccccgggctgcaggaattcgcacgagaccattacctagaacatcctaatcgaaaaagctcgaaacgtcacgggtcacggagagaccgcgcagcagcagagctagttcgttcaggcagctttatttgagcagacatatataggagaagatccgaggagaaagatttagcttgctaagagatctcgccatggcgtccatgatgggaggagacttggtggaggcgtacgtgctcaagaacgcgtgcaaggagaagctccggcgcatggaggcggcggcggcggcggcccacgataagacgagcaagcagggccgcctcgcggagaagaaggtctcaggcagaggacgacgcctgccttggctccctgaagaagaaggtgcacccaaaagcggccgcgtcgtcctcgccacccgaaagcggcgctgaagaagcagcctcctcttcttggattcagcttccgtccaacaatttcgctgccccaccattgcgcggacaataaatcagcccgtgtgggagacgaaaacgaagcacgaggcacgggcggtggcctggttcaaaaccatttcaaacagagaccggaggggggtgcttttccaaccaaggattggggtggttgtgaacaacttggggtcgcccttcngtngggtgcctccctttcggttccccggtcccctcgctttggaaaccaactcttgtttt

SEQ ID NO: 45003 - protein, 78 aa, Zea mays
  misc_feature: Ceres CLONE 1448070-F
MASMMGGDLVEAYVLKNACKEKLRRMEAAAAAAHDKTSKQGRLAEKKVSGRGRRLPWLPEEEGAPKSGRVVLATRKRR

SEQ ID NO: 45004 - DNA, 786 bp, Zea mays
  misc_feature: Ceres CLONE 1448071-F
  misc_feature: Translation starting site: 694
  misc_feature: Pfam Name: RNA_POL_M_15KD Pfam Description: RNA polymerases M/15 Kd subunit
  misc_feature (240)..(240): n is a, c, t, g, unknown, or other
  misc_feature (299)..(299): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (593)..(593): n is a, c, t, g, unknown, or other
  misc_feature (594)..(594): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (702)..(702): n is a, c, t, g, unknown, or other
  misc_feature (709)..(709): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (719)..(719): n is a, c, t, g, unknown, or other
  misc_feature (722)..(722): n is a, c, t, g, unknown, or other
  misc_feature (724)..(724): n is a, c, t, g, unknown, or other
  misc_feature (727)..(727): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (738)..(738): n is a, c, t, g, unknown, or other
  misc_feature (745)..(745): n is a, c, t, g, unknown, or other
  misc_feature (746)..(746): n is a, c, t, g, unknown, or other
  misc_feature (748)..(748): n is a, c, t, g, unknown, or other
  misc_feature (762)..(762): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
ctggagctccccgcggtggcggccgctctagaactagtggatcccccgggctgcaggaattcgcacgagaccattacctagaacatcctaatcgaaaaaaggaaaatccccgtcgttctcgcgtctggagctcggcggcggagcagggcggcagggggagggcgatggaattctgcccggtgtgtgggattctgctgcagatcgatcccgggcacgggaagccaccgcctgcgcctcttnctgccccccggtctgcccccctaccgttctgccccccttccctgaaaaccaaagattcntttgaaaaaaggcaaggttggtcaaaaaggaggtggagcccatcttcagcaccgcggatgaaatgaaatcggccccctaagaaccgccggtcccctgcccaaagaatgcccccccttggaaaaacctcttctttcccagcgccaaatgggccaaaatttccccttccccccttttttgtagaccccctataacacctatttttttggttttttttaaaaaaaaaaaaaccccccnnnnnnnnaagaagatagagcaagcgaggnnnnncnnnnccnnnnnnnnnnnnggagggnncnnnnnnnnnnnnnnnnnnnnnnnnnngnnnnnnnnnnnnnagggnnnnnnnnnnnnnnnnnnccgggcgccccccnnnncacnnnnnnnnnnccccccatggggcgncaccccncnnnnncaanacnanacncctnnnnnncnaccacanncntgcgcgagggcgtntcctatactcnnnnnnccctcatc

SEQ ID NO: 45005 - DNA, 762 bp, Zea mays
  misc_feature: Ceres CLONE 1448075-F
  misc_feature: Translation starting site: 439
  misc_feature (396)..(396): n is a, c, t, g, unknown, or other
  misc_feature (490)..(490): n is a, c, t, g, unknown, or other
  misc_feature (510)..(510): n is a, c, t, g, unknown, or other
ctggagctccccgcggtggcggccgctctagaactagttgatcccccgggctgcaggaattcgcacgagaccattacctagaacatcctaatcgaaaaatcttccaagtcaccaacgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctccccgtggccggagctgaagaagagatgctgcccggagctggcngacatccccgcgtactgccgttgcacggcgctgagcatcctcatggacggcgcgatcccgccgggcccggacgcgcagctgggagggccgcctnagagacctgccgggctgccngcgggaggtgcagaggggattcgccgccaccctcgtcacggaggccgagtgcaccctgggcaccatcagcggcttccccgaatgcccctggatcccggcgggggaaccattgccctccaataactgccaaaaacatagtgcatgaagaatgaacttgtacctagctcatatgtctaaataatagccccgcaaggaaatgaatgcttttcccgggatcttcctccggacaattattaaagggggatcgggatt

SEQ ID NO: 45006 - DNA, 750 bp, Zea mays
  misc_feature: Ceres CLONE 1448076-F
  misc_feature: Translation starting site: 165
  misc_feature: Pfam Name: ICln_channel Pfam Description: Nucleotide-sensitive chloride conductance regulator (ICln)
  misc_feature (352)..(352): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
aaagctggagctccccgcggtggcggccgctctagaactagtggatcccccgggctgcaggaattcgcacgagaccattacctagaacatcctaatcgaaaaaaaacctaaacctagcttttcgtcagtacaacgcctccgccgctccttccattagctcagacatggttctcggcctctacaccttcgccgacatcgacgccgacggagcaccccgcctcgaggttgccgatggcgaggagttcgtccgtgtcgatcgcgttgtcgagcttgccctcggtccccgggtgctgaaggcccctggaaccctttatctcaccacccaggagggtgatttgggtcagcgatggcngcgagggctacgctgtggacttcnnnngcaactcgctccacgccgtgtcgcgtgatcccgaggcgtatccatacccctgcatctacacacagatcgagacggaagctattcctgacgaggagtctgatgtgtcagattcctgaacaaatggagaactcgagctctcaaaagttatggaaatgcccatcaaaccttcagatcctggtcaattggatgaactctttgaagcattctggcattgccctgagcttaaccctgatcctagtgctgaaagtgattaagaactgggttggggtcctggggatgagggttatgaaaatcccgtagatgggaaccaccttgaattttcaaatgcccccccattgggcaaactgggggacaggaaattaaacctgcgt

SEQ ID NO: 45007 - DNA, 753 bp, Zea mays
  misc_feature: Ceres CLONE 1448077-F
  misc_feature: Translation starting site: 197
  misc_feature (607)..(607): n is a, c, t, g, unknown, or other
  misc_feature (608)..(608): n is a, c, t, g, unknown, or other
aaagctggagctccccgcggtggcggccgctctagaactagtggatcccccgggctgcaggaattcgcacgagaccattacctagaacatcctaatcggaaaatcctattccttccaccctgctctcctcgtccactgtctcggtgtctcctctgctcgcccaccaaagcaagattcactcgcccggccggccgccatggccagatcagcgccggggctgccgccgcagccctacgccgccgcggtcgccggccgccgctcctcctcctcacccgcggcgtcttgcatcttggcggtcctcttcctcctcctagccgcctgcgtcgcggcggtgctgctgttcgtgctcttccgcccgcgcgcgccggctatcgccgtgacggccgtgcagctccccgcctttcgcgtggccaacggcaccgtcgccttcaccttccagcagctggcttccgtgcgcaccccaaacgtttcccgctcgcgcactacgacagctcccctcacgtcgcctacgccggcggcgaggtcggctccatgtacatcccggcaggccagatcgacggcggccgcacgcagtacatggccaccagcttcaccgtccccgccttcnncgtctcggccacggggcgccgccgcgcaaccgaccaccatctccggtcccggggtccggcccgtccccgcaagtactgcggttcttatggaccccccgttgatgaagtggactccctctgccggtcaaggcaaagtcacctttcc

SEQ ID NO: 45008 - DNA, 713 bp, Zea mays
  misc_feature: Ceres CLONE 1448079-F
  misc_feature: Encodes the peptide sequence at SEQ ID NO. 45009
ggagctccccgcggtggcggccgctctagaactagtggatcccccgggctgcaggaattcgcacgagaccattacctagaacatcctaatcgaaaaaaaaaaataaccagacaatgagcttaacgcttctccagggctactcctccgctgaggacgacgacgatcccgccgccggcgccggcgctggcaccgagctgagcgagtctggtgattcgtcagccgaggaagccggatcggacgaagacgaggagtccgctcctccaaagcgcccccccaagctccgccgccgaccaaaccctaaggggggagatgccggcggcagcgacgggggctccttgctgccctccgcgctggaggccttcgctgatgtctcgggaccaccagattttttgaggcacagggttgccgagccagaggaagggacggaggccctcggtgtactcgatcgccgtgggaaagaggggagcaaacagccgcctccaggtgctgtgtggtgcaaaacccagatagttgctatcgcgagcgagttacacaactggagcaacccccaggtcagtgcagctggtctttgatggaaaagatataggtgctgaatcctggccagagacgcactgatctctaagatgtgctacatgggtgtacaaaacctatccatggaagggatggggcctcgtggggggaaaccatgccacaaaagcaaaaaagaatgtccc

SEQ ID NO: 45009 - protein, 152 aa, Zea mays
  misc_feature: Ceres CLONE 1448079-F
MSLTLLQGYSSAEDDDDPAAGAGAGTELSESGDSSAEEAGSDEDEESAPPKRPPKLRRRPNPKGGDAGGSDGGSLLPSALEAFADVSGPPDFLRHRVAEPEEGTEALGVLDRRGKEGSKQPPPGAVWCKTQIVAIASELHNWSNPQVSAAGL

SEQ ID NO: 45010 - DNA, 756 bp, Zea mays
  misc_feature: Ceres CLONE 1448086-F
  misc_feature: Encodes the peptide sequence at SEQ ID NO. 45011
  misc_feature (550)..(550): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaactctcgccgtcgtcgccacctccacttggccccgctcatcgcctcctccgacgaccaccgtccaccggcgacaaggacagcgacgatgcagtcggcggcgtggaggcgtcacctcctcgaccaccacctctccccttcaacctcggctgccatcgccgccttcagatccgcctcccagcccgggctcgctccccaagggttgtttggagcggatggcgcaagatgcatgtctgcgagggcgccggcggtcaaggggtccgggcatctcgcccgcaagggcgccggagggaggtcttctgtgagtggaattgtagccacggtgtttggagctactgggtttcttgggcgctatcttgtgcaacaacttgccaagatggggtctccagtgcttgccccatccaaagttgtgaggattctcctcgcccctgaagatatgggtggactgggnccaaattggcccatgaaaaacctccgaagaatggtgattcattaagggctgtaatggccaagcaaagggggtattacccccctggagccaggggttggaacanggacaccccccctcacaaaattaaccccccctctcgcccgaccgcttgcaccaattggctaggagcatggggggtaccaaaaaattatcacggttcctggcaa

SEQ ID NO: 45011 - protein, 135 aa, Zea mays
  misc_feature: Ceres CLONE 1448086-F
MQSAAWRRHLLDHHLSPSTSAAIAAFRSASQPGLAPQGLFGADGARCMSARAPAVKGSGHLARKGAGGRSSVSGIVATVFGATGFLGRYLVQQLAKMGSPVLAPSKVVRILLAPEDMGGLGPNWPMKNLRRMVIH

SEQ ID NO: 45012 - DNA, 717 bp, Zea mays
  misc_feature: Ceres CLONE 1448087-F
  misc_feature (427)..(427): n is a, c, t, g, unknown, or other
  misc_feature (440)..(440): n is a, c, t, g, unknown, or other
  misc_feature (449)..(449): n is a, c, t, g, unknown, or other
  misc_feature (450)..(450): n is a, c, t, g, unknown, or other
  misc_feature (523)..(523): n is a, c, t, g, unknown, or other
  misc_feature (524)..(524): n is a, c, t, g, unknown, or other
tggagctccccgcggtggcggccgctctagaactagtggatcccccgggctgcaggaattcgcacgagaccattacctagaacatcctaatcaaaaaagaagacttcacaagaatctactcgtcgagtcaccaaagataaggctctatcggactcggagtctcggacagcacagcaaagcaagagccgctactcaagtatagtctgacaccggccgaccctgccccaacccaagcatggcggacacaacaaccggcggaacacgggcagaccttgctcgccggcgcgggcctgggcctgctcgcccgtgactcgggccctcgcatctacggcgcgaggggcgacacggccgccgtcctcttcgtcgcggggcctgcggcaccctgctcctcctctcggctgcctccgcgctacgagcggcggcgccngggtcgcggcccnggaccggcnncgcgcgcttgtggcccctcccacgctgctacgctctcttcgcctggaggtgcggcggcatgcttcccgcgccnngccgccctcgatgggggctggccgtggcaccacccgggggttcgtggccttgacgtgcaaaagcatgacccttgggcccggacggactaggaaacacctgaaacttgcgcttcgtcaggaatcaaaacccgcgcccccccccctgtgtaaaaaggaacggggatttggctaacctttcaaattggggcaaagg

SEQ ID NO: 45013 - DNA, 759 bp, Zea mays
  misc_feature: Ceres CLONE 1448088-F
  misc_feature: Encodes the peptide sequence at SEQ ID NO. 45014
  misc_feature (609)..(609): n is a, c, t, g, unknown, or other
  misc_feature (610)..(610): n is a, c, t, g, unknown, or other
  misc_feature (625)..(625): n is a, c, t, g, unknown, or other
  misc_feature (632)..(632): n is a, c, t, g, unknown, or other
  misc_feature (691)..(691): n is a, c, t, g, unknown, or other
  misc_feature (696)..(696): n is a, c, t, g, unknown, or other
  misc_feature (703)..(703): n is a, c, t, g, unknown, or other
  misc_feature (709)..(709): n is a, c, t, g, unknown, or other
  misc_feature (726)..(726): n is a, c, t, g, unknown, or other
  misc_feature (740)..(740): n is a, c, t, g, unknown, or other
ggagctccccgcggtggcggccgctctagaactagtggatcccccgggctgcaggaattcgcacgagaccattacctagaacatcctaatcgaaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgccaacacggcgcggcaggcgtttcagcgcaccccgaactacgtgnnagacgcgcaccgcangatggcngaagccgcggcgcacgcggcccacagaaccgcgcaggcagccaggccatccaggcaggncgcangaagccngcgccnggggaagtgcagtgccngcgctggccgcgcngcaaggcttcttcgtaagt

SEQ ID NO: 45014 - protein, 186 aa, Zea mays
  misc_feature: Ceres CLONE 1448088-F
  misc_feature (44)..(161): Pfam Name: Oleosin Pfam Description: Oleosin
  misc_feature (137)..(137): Xaa is any aa, unknown, or other
  misc_feature (142)..(142): Xaa is any aa, unknown, or other
  misc_feature (164)..(164): Xaa is any aa, unknown, or other
  misc_feature (166)..(166): Xaa is any aa, unknown, or other
  misc_feature (168)..(168): Xaa is any aa, unknown, or other
  misc_feature (170)..(170): Xaa is any aa, unknown, or other
  misc_feature (176)..(176): Xaa is any aa, unknown, or other
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCLANTARQAFQRTPNYVXDAHRXMAEAAAHAAHRTAQAARPSRQXAXSXRXGKCSAXAGRAARLLRK

SEQ ID NO: 45015 - DNA, 741 bp, Zea mays
  misc_feature: Ceres CLONE 1448090-F
  misc_feature: Encodes the peptide sequence at SEQ ID NO. 45016
  misc_feature (635)..(635): n is a, c, t, g, unknown, or other
tggagctccccgcggtggcggccgctctagactagtggatcccccgggctgcaggaattcgcacgagaccattacctagaacatcctaatcgaaaaatctctgaatcgctgacgcccagcctcctctgtcatctccctcctcggacctcgccacctcacgcggaaggaggggaaaaggaagcgcggagactggaaatcgggccccaaatccgcttcggtctctcgatcggcgaggcatgattcatacaaccggctaggatggcctcaaaagctataaaaagaaggcctatcagcgctgagactgatacaacaggggaaaaacaaatggatacagcactgtcagatcctgtaacagaacctcttctaggaaacactcctcaggaagagaaatccaagacatatgagcctattacacggtcaggtttctgggatgggacggcacaggagtgtcttcgttggacacatcttttagcagcttttggttgctcatctgcaagaaacatagtaaatgttctttctgaatttggatatttgctagcaagactctttggttgctcttctgcttccaaaggtcacaaaatggacagacccttccagttaaccctcgtccattacaggaagaaaggtaagattgntgagacaaagatagatgtgccatatgactgcctctctgtcaagcatcaggatgccctgaaagaactttggaagtggcttacccatacagacaactccctcctctgg

SEQ ID NO: 45016 - protein, 161 aa, Zea mays
  misc_feature: Ceres CLONE 1448090-F
  misc_feature (126)..(126): Xaa is any aa, unknown, or other
MASKAIKRRPISAETDTTGEKQMDTALSDPVTEPLLGNTPQEEKSKTYEPITRSGFWDGTAQECLRWTHLLAAFGCSSARNIVNVLSEFGYLLARLFGCSSASKGHKMDRPFQLTLVHYRKKGKIXETKIDVPYDCLSVKHQDALKELWKWLTHTDNSLLW

SEQ ID NO: 45017 - DNA, 759 bp, Zea mays
  misc_feature: Ceres CLONE 1448091-F
  misc_feature: Encodes the peptide sequence at SEQ ID NO. 45018
aagctggagctccccgcggtggcggccgctctagaactagtggatcccccgggctgcaggaattcgcacgagaccattacctagaacatcctaatcgaaaactcctttgcgcctccccgaatcgcatcagcctttctcctcgtgtcgcgactcgcgagcgaaaccctcgccatggcggaggcgaccgacaccgccgcagccacgccgccgccagcgccagcgatggcgactttgtccccgcctcctaagtcggggatcccgccgcggtacaacctggacgccaagtgggacgcgtgcctcgacctctccatccgtcgagttgcctactcctccctcgccggcgccttagcgggcctcctcctcttccgtagccctactactcgctgggcatcagttacccttggggctggtgtgcccacaggggctgcatacactgaatgctcatacttgttcagtggtggtcctccaaattggtcacccaaagtatcaacaattccttctgcacactctgaaggagaaagacagtaaacccttgcccgttggatggtggagttgtggtgtgtgtgaagtactggctgtttgtgctggatattgcactgcctgtgccctgtggccataccatagcatgcattgagttttctgggcaaccccatgaattccccatttgtgtctagcgaggaagtgcctttgcttgggtacttgttcgcggcatacttctggggctgtatcatcgccaaccatgcgacgcttacttattca

SEQ ID NO: 45018 - protein, 118 aa, Zea mays
  misc_feature: Ceres CLONE 1448091-F
  misc_feature (18)..(95): Pfam Name: DUF543 Pfam Description: Domain of unknown function (DUF543)
MAEATDTAAATPPPAPAMATLSPPPKSGIPPRYNLDAKWDACLDLSIRRVAYSSLAGALAGLLLFRSPTTRWASVTLGAGVPTGAAYTECSYLFSGGPPNWSPKVSTIPSAHSEGERQ

SEQ ID NO: 45019 - DNA, 749 bp, Zea mays
  misc_feature: Ceres CLONE 1448093-F
  misc_feature: Encodes the peptide sequence at SEQ ID NO. 45020
  misc_feature (398)..(398): n is a, c, t, g, unknown, or other
  misc_feature (408)..(408): n is a, c, t, g, unknown, or other
  misc_feature (465)..(465): n is a, c, t, g, unknown, or other
  misc_feature (596)..(596): n is a, c, t, g, unknown, or other
  misc_feature (708)..(708): n is a, c, t, g, unknown, or other
ggagctccccgcggtggcggccgctctagaactagtggatcccccgggctgcaggaattcgcacgagaccattacctagaacatcctaatcgaaaagaacgaaacgggagacgataacgagacagcaagagccaagaggtggtgagagagaggaccgaggagggaaacagagaagatgacgacgaagcgcgacaccgagtcggacggcgaaggctccaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaaggggttttagggctcattcagcaatgcagggtcctctgccnagacttttgncattctctctggcgttcagagtttggttttgtgcttgttgcgaaggctacgtggcanggatgacatttgtcatgctggtatagctggttgttgtactggcctcgctttgggcttttcagggggcgcacaggcatttgctccaagctgtgccactttcgcagcattctcatgcatcatggaggggctcnataagcgcaggctgcaatggctcgcacctttggaggactgccccgatggccgtgcataagaaaatgtgtgttctgcccccgttcacccttccacctatcttgatgctctgangcttaagcttcatgctgcttagcggtagtaaaggctaagcc

SEQ ID NO: 45020 - protein, 63 aa, Zea mays
  misc_feature: Ceres CLONE 1448093-F
MTTKRDTESDGEGSNPVGGGATPPPLAAAPVVCLLRSAGDFGGGAFVGSIFGYGQGLITKKGF

SEQ ID NO: 45021 - DNA, 737 bp, Zea mays
  misc_feature: Ceres CLONE 1448094-F
  misc_feature: Encodes the peptide sequence at SEQ ID NO. 45022
aagctggagctccccgcggtggcggccgctctagaactagtggatcccccgggctgcaggaattcgcacgagaccattacctagaacatcctaatcgaaaagactagcactcgtcaccgttccgagaccagcgccagacgcagacggccccgaacgccggcggcggagcatcaggtcgtcgacctccgagcatcgacccgccgcgatggagaagggaaagggcctcgctcgccgctgggcggtggagctccccgacgcctcctcctcctcccccgccgtccccgacccgcccggcttcaccagatccgcgcccgacgcggacgacgccgctggagcgcgccagcgcaaggactccgaggctgcatggaaggcgcaaaaagcttgggaagttgcgcaggctccgtttcagaacctgatgatgatgggatttatgatgtggatggcagggagcactgtccacctcttcagcatcggaattaccttctctgctctgtggcaaccccctcacgctctccgatctggtgggaaaagttttttgaaccatttaaggacccagggtggatactattgctcctaagtgctctttatgcccctcatttgctgcatgggattggtatatgaagcctatacattgggcttcttccacaatcatcagatgggtgtctctctggctctgctcggaggttgatatgcggaggaggctccccttaattatgccatcccattgacctatttcc

SEQ ID NO: 45022 - protein, 123 aa, Zea mays
  misc_feature: Ceres CLONE 1448094-F
  misc_feature (16)..(124): Pfam Name: DUF1077 Pfam Description: Protein of unknown function (DUF1077)
MEKGKGLARRWAVELPDASSSSPAVPDPPGFTRSAPDADDAAGARQRKDSEAAWKAQKAWEVAQAPFQNLMMMGFMMWMAGSTVHLFSIGITFSALWQPPHALRSGGKSFLNHLRTQGGYYCS

SEQ ID NO: 45023 - DNA, 756 bp, Zea mays
  misc_feature: Ceres CLONE 1448095-F
  misc_feature: Encodes the peptide sequence at SEQ ID NO. 45024
  misc_feature (500)..(500): n is a, c, t, g, unknown, or other
ggagctccccgcggtggcggccgctctagaactagtggatcccccgggctgcaggaattcgcacgagaccattacctagaacatcctaatcgaaaaagctcgaaacgtcacgggtcacggagagaccgcgcagcagcagagctagttcgttcaggcagctttatttgagcagacatatataggagaagatccgaggagaaagatattagcttgctaagagatctcgccatggcgtccatgatgggaggagacttggtggaggcgtacgtgctcaagaacgcgtgcaaggagaagctccggcgcatggaggcggcggcggcggcggccgacgataagacgagcaagcagggccgcctcgcggagaagaaggtctcaggcagaggacgacgcctgcttgggctcctgaagaagaagtgcacccaaaagcggccgcgtcgtcgtcgccacccgaaagcggcgctgaagaagcagcctcgtcttcttgattcagctccgtcaancaaattcgctgcccaccatttgcggacgatagatcagccgtggtggagacgaagacgaagcacgagcccgtgcgtggcctgctccaaaccactcaaacggagacagagtgcggtgttttctaccaaggatggtgttgtggtgaactacttggggagcccttcgtcggtccggtcttcgttccctgttccccccctggaaaacgatcggggttgtttcctggggaggggggaactccggggcagtacctgaaatggc

SEQ ID NO: 45024 - protein, 173 aa, Zea mays
  misc_feature: Ceres CLONE 1448095-F
  misc_feature (91)..(91): Xaa is any aa, unknown, or other
MASMMGGDLVEAYVLKNACKEKLRRMEAAAAAADDKTSKQGRLAEKKVSGRGRRLLGLLKKKCTQKRPRRRRHPKAALKKQPRLLDSAPSXKFAAHHLRTIDQPWWRRRRSTSPCVACSKPLKRRQSAVFSTKDGVVVNYLGSPSSVRSSFPVPPLENDRGCFLGRGELRGST

SEQ ID NO: 45025 - DNA, 742 bp, Zea mays
  misc_feature: Ceres CLONE 1448099-F
  misc_feature: Encodes the peptide sequence at SEQ ID NO. 45026
  misc_feature (442)..(442): n is a, c, t, g, unknown, or other
  misc_feature (643)..(643): n is a, c, t, g, unknown, or other
  misc_feature (662)..(662): n is a, c, t, g, unknown, or other
  misc_feature (668)..(668): n is a, c, t, g, unknown, or other
aaagctggagctccccgcggtggcggccgctctagaactagtggatcccccgggctgcaggaattcgcacgagaccattacctagaacatcctaatcgaaaaaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcangatgccttacttgagatagttggcaggcgtactgtccctcaagtttttgtccatggaaagcacctgggtggttctgacgatactgttgactcctacgaaagtggaaaactggctagacttctaaacatcggagtcaaggacgacctttgagtgacatgctacatcggtcagccctgtcgtttggtttcatccgtaccggcntctactacttctatatggntttggnccctatggattacagctacaacagtctaaatagctgattttatcccgagcgaacagtccaaacagtctcttgtt

SEQ ID NO: 45026 - protein, 135 aa, Zea mays
  misc_feature: Ceres CLONE 1448099-F
  misc_feature (44)..(108): Pfam Name: Glutaredoxin Pfam Description: Glutaredoxin
  misc_feature: SWISSPROT Homolog: EC 1.11.1.15 Peroxiredoxin
  misc_feature (86)..(86): Xaa is any aa, unknown, or other
MVALLGRRIGVAAAAAAFIALVAFGSASSSPKSFVKSTVSAHDVVIFSKSYCPYCKRAKAVFKELELKKEPYVVELDQREDGSEIXDALLEIVGRRTVPQVFVHGKHLGGSDDTVDSYESGKLARLLNIGVKDDL

SEQ ID NO: 45027 - DNA, 754 bp, Zea mays
  misc_feature: Ceres CLONE 1448102-F
  misc_feature: Encodes the peptide sequence at SEQ ID NO. 45028
  misc_feature (377)..(377): n is a, c, t, g, unknown, or other
  misc_feature (552)..(552): n is a, c, t, g, unknown, or other
  misc_feature (587)..(587): n is a, c, t, g, unknown, or other
tggagctccccgcggtggcggccgctctagaactagtggatcccccgggctgcaggaattcgcacgagaccattacctagaacatcctaatcgaaaaagtagcatccatttgattgttctatcctcttctctgttctcacccccttgcaagcaacaatcgttcaccgatcgatccagtgcgtcctgcatggaaactgccgccgtcgccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcanggtacatgatgacctcggacgtgctggcgagcgttgaaagcacgccaaacgcgtctcggcggcggcggtcgacaaggcaagcgcgtctgcgccgaccacccgcacgtcaaggtggagacgacggtggagagcggggacccgcgggacgtcatctgcgacgcagccaacagatggnccgcgacctgctcgtcatgggcagccatggttacngcttcatccagagggcgttcttgggcagcgtcagcaaccactgcgcgcaaaactgcaaatgcccgggccctcattgtcaagaagcccaaggagtagaaagttcctcgcatgtaacgctgccacttaaccaataatgtttcatgccgaccatatagcatatttgtccc

SEQ ID NO: 45028 - protein, 177 aa, Zea mays
  misc_feature: Ceres CLONE 1448102-F
  misc_feature (12)..(155): Pfam Name: Usp Pfam Description: Universal stress protein family
  misc_feature (64)..(64): Xaa is any aa, unknown, or other
  misc_feature (122)..(122): Xaa is any aa, unknown, or other
  misc_feature (134)..(134): Xaa is any aa, unknown, or other
METAAVAASSAGRRIMVAVDEGEESLHALNWCLANVVSPAGGDTLVLVHARRPRPVYAAMDSAXYMMTSDVLASVESTPNASRRRRSTRQARLRRPPARQGGDDGGERGPAGRHLRRSQQMXRDLLVMGSHGYXFIQRAFLGSVSNHCAQNCKCPGPHCQEAQGVESSSHVTLPLNQ

SEQ ID NO: 45029 - DNA, 755 bp, Zea mays
  misc_feature: Ceres CLONE 1448106-F
  misc_feature: Encodes the peptide sequence at SEQ ID NO. 45030
  misc_feature (425)..(425): n is a, c, t, g, unknown, or other
aaagctggagctccccgcggtggcggccgctctataactagtggatcccccgggctgcaggaattcgcacgagaccattacctagaacatcctaatcgataaccccactcaagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgtcgccgccgacttcagctacctcttctgctagatccgcgctggatacccccccccccgcnccaaaatatgattcgtctggtctggcgcgcgtgagtccagctcgtgtgtcgagcgtgtctctgtgtgaggtgtccgcgggcgtgtgtgtatgtatggagtcagcctcggcggcggcagaagaagaggtgtgcccttggtgggtgatacgtgcttcaacgccccactgttggtcgcggcgataatggactacccctgctgcgttgtctgggttatcaaggagatgatttatttgattccaaaaaaaaaaaaaaaaaagctttttccattcccgtcaaccctccagggggggggcccggtaccccaatttcgccccttataagggagtcata

SEQ ID NO: 45030 - protein, 57 aa, Zea mays
  misc_feature: Ceres CLONE 1448106-F
MAGLRMKFVAVAAMAAALVASAAAAEAPAPAPASDAAAAVPLAAASLVAADFSYLFC

SEQ ID NO: 45031 - DNA, 766 bp, Zea mays
  misc_feature: Ceres CLONE 1448111-F
  misc_feature: Translation starting site: 243
  misc_feature (524)..(524): n is a, c, t, g, unknown, or other
  misc_feature (613)..(613): n is a, c, t, g, unknown, or other
  misc_feature (616)..(616): n is a, c, t, g, unknown, or other
  misc_feature (632)..(632): n is a, c, t, g, unknown, or other
ccaaactggagctccccgcggtggcggccgctctagaactagtggatcccccgggctgcaggaattcgcacgagaccattacctagaacatcctaatcaaaaaatctgttaattaaacaccaccgacaaaactccaaggtgccatataatctcaagtcaaatccagtctcgattccagttttgtttccactgcagtcccagctcaaatctcgaatctttgtaagaagcccagatctactcgtatggcgaagcacacggcggcgttgaaagccggactgactttgctggcgctgagcatgatcggttacatactcggtcctcctctctactagcacctcaccgaggcactggtcgcttccgcctcttcttgctctccttgcgtctgcgactgctcttccctgcctctccctcacatccccaaaggactcagcaatggatcttttggagattgtgcaaagcatgacccagaggtgaacgaagacacagagaagaactatgctgagctcttaacagaggaactgaangcacgcgaagcagcatcgatggagaaaacacaacgagtagacactggtctgctcgagccaagaagatcacatcctcttaccaaaaggangcngataagtgcaactccnggtatgagacttgtgagaagccagagagaagtcggaaaaaggcacttgtgagcagaagaagctgacttctatgtgggaactcagagctcgtcaaaaaggatggaaagagggagccaccaagtcttctgttaatc

SEQ ID NO: 45032 - DNA, 752 bp, Zea mays
  misc_feature: Ceres CLONE 1448113-F
  misc_feature: Encodes the peptide sequence at SEQ ID NO. 45033
  misc_feature (433)..(433): n is a, c, t, g, unknown, or other
  misc_feature (486)..(486): n is a, c, t, g, unknown, or other
  misc_feature (494)..(494): n is a, c, t, g, unknown, or other
  misc_feature (495)..(495): n is a, c, t, g, unknown, or other
  misc_feature (515)..(515): n is a, c, t, g, unknown, or other
  misc_feature (517)..(517): n is a, c, t, g, unknown, or other
  misc_feature (542)..(542): n is a, c, t, g, unknown, or other
  misc_feature (548)..(548): n is a, c, t, g, unknown, or other
  misc_feature (696)..(696): n is a, c, t, g, unknown, or other
ctggagctccccgcggtggcggccgctctagaactagtggatcccccgggctgcaggaattcgcacgagaccattacctagaacatcctaatcgaaaaaaaatctacccacctcctcagacctcactccactcaccgttgccaaaagctcccacccacctctcatgggcagggttcatgtcacggcagccggccgcccgcccgcccgcgttcggcggcgcgcatgcagcatacaccgccccaggcccgatcgatggaggggaggggagcgcccgcgagaaccctaaaaagcctccgctcaacctctatgctggatgggatcagctggacggaggcctggagcgtccagcactccagcctgccacacgcctgggctggggcccacctccccgctataaagcggagccgccgcggcatcgtcaggaatctacccngatggatgcggatccgtagtcccgcccctccatggtgtttttgaccagatctnattaccannatcgcttctccctctctcgntngttttcccttcttccctttcagggntaccgntgaagtctgaggagacctgatcccacagcaccgccgccgtgtgccagagatgagatgccatggaggagcaagaagacgccatgaattgtgacgccaaggagagcgaggcaaggaacacgttgaacacgtccgccggcaaatctgcagntgctgccgccgtctccgcacgatatctcaatcggatactgttaaataactagccgc

SEQ ID NO: 45033 - protein, 84 aa, Zea mays
  misc_feature: Ceres CLONE 1448113-F
  misc_feature (71)..(71): Xaa is any aa, unknown, or other
MQHTPPQARSMEGRGAPARTLKSLRSTSMLDGISWTEAWSVQHSSLPHAWAGAHLPAIKRSRRGIVRNLPXWMRIRSPAPPWCF

SEQ ID NO: 45034 - DNA, 765 bp, Zea mays
  misc_feature: Ceres CLONE 1448114-F
  misc_feature: Encodes the peptide sequence at SEQ ID NO. 45035
  misc_feature (273)..(273): n is a, c, t, g, unknown, or other
  misc_feature (355)..(355): n is a, c, t, g, unknown, or other
  misc_feature (380)..(380): n is a, c, t, g, unknown, or other
  misc_feature (389)..(389): n is a, c, t, g, unknown, or other
ctggagctccccgcggtggcggccgctctagaactagtggatcccccgggctgcaggaattcgcacgagaccattacctagaacatcctaatcggaaaaaaaagtgctagggttcttctcgcccatcgcagccgccgccgcggctctcgcctcttgactcgctctcgcctctcggagcaaaagctgtgtccgctcctcctggtgatcccggagccagtcctcgccgcaccgcgctgtgtctgctcctcctggtgatcccgcaccgtgctgtgntcgctccatcttcctccgccgcacactcagcgccggtgcgagggcatgtctacctacccgaggacctacgatctcatccatnggcgactcggtgtcaccctgtacangaacagggnagagatcctcctggttgtccagacgtattggactaccatgaggccatgaccaagatcagtagcaggactgtcaaatctattaatgatttgaagaacactgcttctggtccaaatttgggaagaaaggtcccaacatcaaaaccctgaatggggcaggaaagaattgcccattttacggaacccaaaggtttccccaggggctttgccacagggggggctcctgcggaactcttttttttcccgggaagaaaatggggggcatactttcgaatgaaacccccaggggggttttaaaaaacgggggggcggggccccctgggggggagggccggagggttttcaagggatttctccccccccgggggggctttatgaa

SEQ ID NO: 45035 - protein, 39 aa, Zea mays
  misc_feature: Ceres CLONE 1448114-F
  misc_feature (13)..(13): Xaa is any aa, unknown, or other
  misc_feature (21)..(21): Xaa is any aa, unknown, or other
  misc_feature (24)..(24): Xaa is any aa, unknown, or other
MSTYPRTYDLIHXRLGVTLYXNRXEILLVVQTYWTTMRP

SEQ ID NO: 45036 - DNA, 743 bp, Zea mays
  misc_feature: Ceres CLONE 1448116-F
  misc_feature: Encodes the peptide sequence at SEQ ID NO. 45037
cagctggagctccccgcggtggcggccgctctagaactagtggatcccccgggctgcaggaattcgcacgagaccattacctagaacatcctaatcgaaaagactagccgaagcggccgcggcggaacacctcggcgatcggcgtgcgtaccttccacgcgggagtgcgggaccgttgctgcgacgctgcgtcagatcgacgcgcggcgcgtccgccccccaccctctcgccgcctatataactcgcgcccgaatcggcggctccctcctttgccctctccgcgcaccttccaccacgctctggaagctgtttcccctttctcgagagtttagaaagctggtgcagagatggccggggagagctgcgtcccccagcccctgttcggcggcgccatcttcaccaccttctcccaccccttccaggacgtgagcaacatccgggaggtccccggacatcaggagggtctcgttgatcccatccgcgacgagagcctcattttcgagctacttgacctcaagggcgaggtggacgacgccggcagcgcgctctggttcctggcagacctccgcaacgagcaagaccccggggacaactttgggggtaaagcattcttgggacacttgaacctggctgctttgcatctccgaaaaagcttctggcaatggttgccactgcagtttggcccgcctggccctctccaaagggaggcgggccaaaaaaccccaaaccttggttcgaattt

SEQ ID NO: 45037 - protein, 131 aa, Zea mays
  misc_feature: Ceres CLONE 1448116-F
MAGESCVPQPLFGGAIFTTFSHPFQDVSNIREVPGHQEGLVDPIRDESLIFELLDLKGEVDDAGSALWFLADLRNEQDPGDNFGGKAFLGHLNLAALHLRKSFWQWLPLQFGPPGPLQREAGQKTPNLGSN

SEQ ID NO: 45038 - DNA, 705 bp, Zea mays
  misc_feature: Ceres CLONE 1448121-F
  misc_feature: Encodes the peptide sequence at SEQ ID NO. 45039
  misc_feature (413)..(413): n is a, c, t, g, unknown, or other
aaagctggagctccccgcggtggcggccgctctagaactagtggatcccccgggctgcaggaattcgcacgagaccattacctagaacatcctaatcgaaaaaactaaaaataattcagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcgctgccctttcctttttcggtcggcagcaatcaccggggcaagcgaaccctcgatttgcgtccccgctctctgctagcgcccctaaaagaggagcgaagcgatgtctatgtcgaagacgggtcaggccncggagaaggatgagcagcagcagtcccgagggatagcactgatgcagggcatctgcgccgtggtgtaccgccaacccgataacacgccctgccccatcaagcagggtctctacttgggaatctgttgagcagcattccataggaccttctcaaagtttgaactcccccctatctggtcgttcaaagccctggaccaggatttccagctgattttattccagaaaaatcaagttttgtttcccaaaccggtttgtaaaaattccgaaaaagttttggtttcaaaaaaaactaa

SEQ ID NO: 45039 - protein, 51 aa, Zea mays
  misc_feature: Ceres CLONE 1448121-F
  misc_feature (10)..(10): Xaa is any aa, unknown, or other
MSMSKTGQAXEKDEQQQSRGIALMQGICAVVYRQPDNTPCPIKQGLYLGIC

SEQ ID NO: 45040 - DNA, 747 bp, Zea mays
  misc_feature: Ceres CLONE 1448128-F
  misc_feature (290)..(290): n is a, c, t, g, unknown, or other
  misc_feature (338)..(338): n is a, c, t, g, unknown, or other
aagctggagctccccgcggtggcggccgctctagaactagtggatcccccgggctgcaggaattcgcacgagaccattacctagaacatcctaatcgaaaatacctttctcggccttttggctaagatcaagtgtaatatctgtttttatcagtttaatatctgatatgtgggctatgtgcctacttcgatattaaatttattttttgtgggagagggtccattgccggtggcttgcccttgggggctctcatgcgtcgtccagctattgcactctgctggcgggactgncgcaccccaccaaaacaaactgcgagtcttcggaaaaacccggcctgnaaccgttgaagacgacacacaacaacgatccggttttctatcgttccgtttccgtccgtttccatcacaaccaacagaggagacagcccagaaaagttgcagttccatcacaaacccaacagaggacatacttaatcacagcagtgtctatcacaaatttcttgctgccccacagtccgtgtagttgcatcaggactagatcatgttaatgaccctttatgaatgttccctgcacatgtagatttaccgttaatctagtgtaattcaagcttcgggaacgaaacagaccgtgagatcaactccaacaccctgcctgcaaagcccgcacggctgaaccaaattcattgcatgtcgcagccctcctaccagtgcagggtccagaaaaggaataccgaaaccgttggacacc

SEQ ID NO: 45041 - DNA, 715 bp, Zea mays
  misc_feature: Ceres CLONE 1448135-F
  misc_feature: SWISSPROT Homolog: EC 3.1.13.4 Poly(A)-specific ribonuclease
  misc_feature (381)..(381): n is a, c, t, g, unknown, or other
tcttaactagtggatcccccgggctgcaggaattcgcacgagaccattacctagaacatcctaatcaaaaaatcagacaaccggcggcacccgcttactatatcagattctaacaacctgttccaggaatcccctacccggcggcggaacaagccgggaacctgccgcaaagggcgccaccgatgctaaagacacagacgtcgaggacagcttccctccctctccttctcatccgccgctgctcgagaaccgcggccagtccatctcctgccggtgaccggccgctctcctttgtcccggtctgcaagcggcggatgagcacgctggcggatcttatgtttgcccctctccctacggagcaaactgaatcgcagtgcgcancccccccccacacggtaccagttccggctggtctctcacaacatcttgttccaggtttatgttaagagtacgcttgttcctcattccccatctgcgtgcctcgggtggaaatgtcgatcgggagctattcttactgaactaaagagctttgatgctgacttgatgtctatacaggagtccgatgaatatgacaccttccataacaaacccacggaaaagtcctggaattcaggtattgtcatttcgccgatctgaacacaaaccagatggcgttgggtatattctattaaccataaagtggcccaactgggtgcagatacaagttatcctgttc

SEQ ID NO: 45042 - DNA, 779 bp, Zea mays
  misc_feature: Ceres CLONE 1448138-F
  misc_feature: Encodes the peptide sequence at SEQ ID NO. 45043
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
cggtgtacatgttcccctcctacaacccccttnnnnnnnntcccccnncnccaaagctggagctccccgcggtggcggccgctctagaactagtggatcccccgggctgcaggaattcgcacgagaccattacctagaacatcctaatcgaaaaagatcgggccatcggggaggcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaacgagatggaggaggaagccgccgccctccgcgatatgcaggccaaggtcgccaaggagatgcaaggaggtgaccctagtgcatctacagctgaggcaaaggagcaggtggatacccgttctgtgtaccccccacatgtggattatgcttgcaccccagaagaagtgcaacagcatttccaagcttgtggaactgtcaacagggtgacaatcttgactgacaagtttggacagccaaaaggtcttgcttatgctgaatttctggaacaagaacgcgttccggaagctcttaacttgaatgaatctgaattgcatggtccccaggattagcgtcgccccaaagaggactaatgtttcctggagatgaagcagccgtcacccacggggggtataattccataaggatgggctaccctttataaatccatacggggggcccccgtatt

SEQ ID NO: 45043 - protein, 155 aa, Zea mays
  misc_feature: Ceres CLONE 1448138-F
MDEEEHEVYGQEIPEDGDMDGADVDMAASGDDAAKLQELDEMKRRLNEMEEEAAALRDMQAKVAKEMQGGDPSASTAEAKEQVDTRSVYPPHVDYACTPEEVQQHFQACGTVNRVTILTDKFGQPKGLAYAEFLEQERVPEALNLNESELHGPQD

SEQ ID NO: 45044 - DNA, 767 bp, Zea mays
  misc_feature: Ceres CLONE 1448150-F
tccccgcggtggcggccgctctataactagtggatcccccgggctgcaggaattcgcacgagaccattacctacaacatcctaatcgaaaaacattaaaatcgctccataccagctacgactggcgacagccgatgaggaggatactccaagtccagcagctctaccctggtaacttcggcaccgagagtacaaacacatggctagtccggggcggctcgatgctgctgtcaatggtcttcgttgcattgcctctgtcactgctggatatgtacaggggcaaatgcccctcatccgagagtaatgacaaaaggcgagggacccgccgactacctcctattcggtacaactgctcacctttattggaaaccaccaaaaagctaggtggagacacaactgggtggtgaccaaccccccgtacaacaacttgtacatcataatgcaatcggcaccgtacccggtgtccggagaacgacacgcttcttgtattcaggtggactcttttctccgcttaaccagctctgtgggaggccccttcccagaagtgagtctgaggtgaggggtgactcctgtccaagacgcccaagagcgatgataacctcgacattttaatggaagatgacgtatgtcgtatcgccaagatgagagaacatgtgccctcgacctccccgacattttctacagcccttccggggtcctcagattctcgaataccgtgcccattttgtaccgggggttaacactaggaagttttccctgaacctcttg

SEQ ID NO: 45045 - DNA, 779 bp, Zea mays
  misc_feature: Ceres CLONE 1448154-F
  misc_feature: Encodes the peptide sequence at SEQ ID NO. 45046
  misc_feature (274)..(274): n is a, c, t, g, unknown, or other
  misc_feature (594)..(594): n is a, c, t, g, unknown, or other
  misc_feature (757)..(757): n is a, c, t, g, unknown, or other
ggagctccccgcggtggcggccgctctagaactagtggatcccccgggctgcaggaattcgcacgagaccattacctagaacatcctaatcgaaaaaggctttatttatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgangatgagaaggtactggctttcagggacataaaccctcaagctccaaccacattctcatcatcccccaagtcagggatggactacttgccctggcaagggttgaaaaaaggcccataaaaaaactttggctacccccccgtggttgccaggggttgttggcaaaaccggaaggccttggaaagggggtttccgcggctcctctatatgggcgcccagggggggggatattttttttttacaaaccccctttttcttcccccggggggggggaaaaaaaagggcccccccccccaaaaaaattttggggtataaaagagggnaacgggggagggggggcccttctcttctctaaaaaaaacctggggtgtttttaaaaaaaaaaaaggcgggggggggcaccgggttgtaatatttttgaggaaaacgccccggccccggcttgttgttttataaaaaaacaaaaagtttttctgtgtggcttcncaaaaataagaaaaaagctttc

SEQ ID NO: 45046 - protein, 73 aa, Zea mays
  misc_feature: Ceres CLONE 1448154-F
  misc_feature (35)..(35): Xaa is any aa, unknown, or other
MSSEKEAALAAVLDDSPTIFDKIIKKEIPSTVVYXDEKVLAFRDINPQAPTTFSSSPKSGMDYLPWQGLKKGP

SEQ ID NO: 45047 - DNA, 644 bp, Zea mays
  misc_feature: Ceres CLONE 1448159-F
  misc_feature: Translation starting site: 173
  misc_feature (364)..(364): n is a, c, t, g, unknown, or other
  misc_feature (430)..(430): n is a, c, t, g, unknown, or other
  misc_feature (455)..(455): n is a, c, t, g, unknown, or other
  misc_feature (492)..(492): n is a, c, t, g, unknown, or other
tggcggccgctctagaactagtggatcccccgggctgcaggaattcgcacgagaccattacctagaacatcctaatcgaaaaagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcaggntacatgatgacctcggacgtgctggcgagcgtcgagaagcacgccaacgctgtctcggcggcggcngtcgacaagggctagcgcgtctgcncggaaccacccgcacgtcaaggtggaaaacaatgtgnaaagcggggaacccgcgggacgtcatctgcgaaccccggcaaacaaatggcccccgaacctgctcgtcatgggcagccatgggtacggctttcttcaaaaggcgtttttgggaaaggttaggaaccactggggccaaaaaatggaaatggcc

SEQ ID NO: 45048 - DNA, 787 bp, Zea mays
  misc_feature: Ceres CLONE 1448173-F
  misc_feature: Encodes the peptide sequence at SEQ ID NO. 45049
  misc_feature (210)..(210): n is a, c, t, g, unknown, or other
  misc_feature (211)..(211): n is a, c, t, g, unknown, or other
  misc_feature (215)..(215): n is a, c, t, g, unknown, or other
  misc_feature (229)..(229): n is a, c, t, g, unknown, or other
  misc_feature (239)..(239): n is a, c, t, g, unknown, or other
  misc_feature (244)..(244): n is a, c, t, g, unknown, or other
  misc_feature (247)..(247): n is a, c, t, g, unknown, or other
  misc_feature (485)..(485): n is a, c, t, g, unknown, or other
aagctggagctccccgcggtggcggccgctctagaactagtggatcccccgggctgcaggaattcgcacgagaccattacctagaacatcctaatcgaaaaaaaacctcatcccaaatctcaacccaagaacaaaaatggccaccgccaccactgaagccgaagtccgtgagtccctcggcacgaagttcggtcgcctcaaggaacaggnncggnaaaaaagggaaacnaattgggggnccccnttnccccccaaggggccaccccgtcgctggagccgcggccgtcatcgctgtcagcgccgtgagcgcctacttcttgtggcccgtggcagccccggccgtggccatgatgaaggcgcctggatcccggcgtgtgctcgtctccccgcgcgcgtttctcgcgaagaaagagctgtactttcagctcttgcgcaccgggggcgtttgcggcggggtcgcccctttggcgtacctgcccatgcantaatggaacttgcttgttcgtaaccaacggcgggcccgaacttttcagttgaatgtgaacaaaggggtaataaaactttcccttccctggggggggagccccaacccccgagttggaattatcggcccaaaaccctttgatggggggcgggaaccttttgagaaaaaaagggaacccttttttaaaaaaaaaacaggtggtcgggcccaaaaaaaaaaaaaaaaagtttttttttccccccccccccccgggggggggggcggggcccatttcccccaaagagggggagaaaaaagcccccc

SEQ ID NO: 45049 - protein, 160 aa, Zea mays
  misc_feature: Ceres CLONE 1448173-F
  misc_feature (70)..(70): Xaa is any aa, unknown, or other
  misc_feature (76)..(76): Xaa is any aa, unknown, or other
  misc_feature (81)..(81): Xaa is any aa, unknown, or other
  misc_feature (82)..(82): Xaa is any aa, unknown, or other
AGAPRGGGRSRTSGSPGLQEFARDHYLEHPNRKKTSSQISTQEQKWPPPPLKPKSVSPSARSSVASRNRXGKKGKXIGGPXXPPRGHPVAGAAAVIAVSAVSAYFLWPVAAPAVAMMKAPGSRRVLVSPRAFLAKKELYFQLLRTGGVCGGVAPLAYLPM

SEQ ID NO: 45050 - DNA, 690 bp, Zea mays
  misc_feature: Ceres CLONE 1448175-F
  misc_feature: Encodes the peptide sequence at SEQ ID NO. 45051
ggagctccccgcggtggcggccgctctataactagtggatcccccgggctgcaggaattcgcacgagaccattacctagaacatcctaatcgaaaaattgccatgccgcctccgctctcgctccgcgtcgccgtcatcggcgcgggagccgcggggctggccgccgcgcgcgagctgcggcgcgaggggccacgtgcccgtcgtgttcgagcgcgcccacgcagtcggtggcacctggctgtacgaccacgacgaccgccaccgctccagcagcctgtacgcgtccctgcgcaccaacctgccacgcgaggtaatgggcttcctcgacttccccttcgccgctgtcccggactccgccgacgcgcgcaggtttcctcggcaccaggaggtgctgcgctacatccaggccttcgcgcgccgattccaccttgacggcctcatccgcctccgcacggaggtgctcgccgtcagcaaggacaacgacgaggggagcagcggcggctggagggtgaggtggcgccggaacgcagccggagacgagtccgagcaggagcaggaggaggtgtttgatgccgtcgtggtctgcaacggacactacacggagccgagaaccgccgccgccgacatccccggcctagacgcctggcctgcgggcaagcagatgcacagccacagctaccgcgtgccggc

SEQ ID NO: 45051 - protein, 125 aa, Zea mays
  misc_feature: Ceres CLONE 1448175-F
  misc_feature: SWISSPROT Homolog: EC 1.14.13.8 Flavin-containing monooxygenase
MGFLDFPFAAVPDSADARRFPRHQEVLRYIQAFARRFHLDGLIRLRTEVLAVSKDNDEGSSGGWRVRWRRNAAGDESEQEQEEVFDAVVVCNGHYTEPRTAAADIPGLDAWPAGKQMHSHSYRVP

SEQ ID NO: 45052 - DNA, 794 bp, Zea mays
  misc_feature: Ceres CLONE 1448176-F
  misc_feature: Translation starting site: 257
  misc_feature (373)..(373): n is a, c, t, g, unknown, or other
  misc_feature (374)..(374): n is a, c, t, g, unknown, or other
  misc_feature (377)..(377): n is a, c, t, g, unknown, or other
aagctggagctccccgcggtggcggccgctctataactagtggatcccccgggctgcaggaattctcccgaaaccattacgctgaacatcttaatcgaaaattccgctgggcaccatttcttgcactgcatgacatctgacacattccttaccatgttgctgcttctagccaagtacagaatgatgagccttccagttgtacgaagtgggaggagataagattgagaacattatcacacaagcctctgtcgtagacatgcttgcagaaagagatgggctctcctggattgagaactggggaactaacaaactctccgaactggagcttactgtcatgagaacatccacacttgagaaggtaagcaaagattannaanatcagagagatttcaaaccgataatgtaaaagccgacccgcgcgcattgtcagacactgaacacaagcgaaccaaatgccattggcaacaaaagcaacaaagatgttcacaatcttttaaatagtcccaacatttacaaagagcacaggtcaatcccctaaaaaggatttcctttaatgttgttagaccccccctcctggaactacgtggggccctcgccgttgctgcatgatgctttcacgtgccaacaaggatgattccattcaccaaaccatactgcatcctgggactcctacgaagatgcacagcgatttaagtttgtggggcggacaaagggaaccccggagggagccattcccctccaaggcgaaataaccctccttgctgcgggtaagaagcatcgccctttatgttttc

SEQ ID NO: 45053 - DNA, 692 bp, Zea mays
  misc_feature: Ceres CLONE 1448195-F
  misc_feature: Encodes the peptide sequence at SEQ ID NO. 45054
tggcggccgctctataactagtggatcccccgggctgcaggaattcgcacgagaccattacctagaacatcctaatcgaaaaactctactacgctccacgaacacgcacgtccgaacaattccatcctagctagctagcagttctcatcacgccaagcacctacgacgagcatggccgccagagcaagaacccacggccctctcttctccctcctccccctcctcctcgcggtactcaccgtcggtaatagcagcagcagccggtgccccggcgtgccgtccatgacggcgcagcaggcgtgcggcgcggtggccgggacgcggcgcatgctggagctctgcctccgcaccctccgcggcggcgcgccgctgccggtgacccggcacgcggcggtggccgtgcgcggcgcgctcgacgcgtacgcggccacggtggccgctgcgacgtcgctgctggacggcggcgcggtgccggccgacggcgagagggccgcgttcggcagctgcatggtgggctacggcagcgcccgcgtcgccatggcgcgcgtcgccgccgacctcgccgccgccggctgcgacggcggcggcgcccgggccgcggagctcgaggcggggtacacggccgggctccgtggcatggatgcgtgcaccgggggcatgctcagctacccggcgtcgcccttgtacgccag

SEQ ID NO: 45054 - protein, 136 aa, Zea mays
  misc_feature: Ceres CLONE 1448195-F
MTAQQACGAVAGTRRMLELCLRTLRGGAPLPVTRHAAVAVRGALDAYAATVAAATSLLDGGAVPADGERAAFGSCMVGYGSARVAMARVAADLAAAGCDGGGARAAELEAGYTAGLRGMDACTGGMLSYPASPLYA

SEQ ID NO: 45055 - DNA, 661 bp, Zea mays
  misc_feature: Ceres CLONE 1448209-F
ctccccgcggtggcggccgctctagaactagtggatcccccgggctgcaggaattcgcacgagaccattacctagaacatcctaatcgaaaaattttagcaaactcgacgatttgacatagctttttgagcacccgccgcctacagtaaacatcaatggattctcagatcaggcatgctgtgcttgtcaaagtgatggggaggactggctcgcgtggccccgcgactcaagtgatagtgaagtccacagactcagaccgtgttctcactgatgaatgtaaaaggaccagccatggaaagatacatcctcactcttctcaattccgagagagaacccaaaggactccgctaattctcttatgccaactctctctcatgatttacattttgatgctcatttagcttttctgctttcctcgtgagattcaagcccttgctgttaagacaatgtttgaacctggaaatgaatcttttctgaccagagtttcctcgatgatgaccagattgatcttatctataccctcaacctcgagggggggcccagtacccaattcaccctatagagagtcgtattacacgcgctcactgacagacattctacatcgacatgactggtaaaaccctggcattacccaacttaatcgccttgcatcacatccccc

SEQ ID NO: 45056 - DNA, 766 bp, Zea mays
  misc_feature: Ceres CLONE 1448217-F
  misc_feature: Encodes the peptide sequence at SEQ ID NO. 45057
aagctggagctccccgcggtggcggccgctctattctagtggatcccccgggctgcaggaattcgcacgagaccattacctagaacatcctaatcgaaaaagttgagttcttgtatttgcttgaatctggaaaaaaaaactagagacaaaaggaggacgggaaacggagagaaggatcatggactacagcatgcagggatccaaggactcctcctcgccgcaagttcacaaccacttgtacccggacgctcagcctgggctgtatcctcctcctccgccggcgccgccgccggcgatggcgaacccgccgcaggggggctacggctacggctaccaataccagggctacctcggcgaagcggcgaaccctcctcctccttattactacactggcagctggcccgagcagcccccacctccgtccgacggcgccccctttcgctaccgctacctgcaggaccaggacgatgccaactgcatcaccttcctcagaggatgtcttgctggtctgtgctgctgctgcttactggagcgatgctgcatctatggaggatggcgtgcagtgctgctgcctggagcacgcatgtatgcagcagtgtggtggtgacataataataataataataataagctgctgcggcagcagagatgacggttcctgcgttgacggcgccatccatgtaaaaccaaggagcagcttggcatcatcatgtctctcgtcgtccttggtcttgcaaaaaaaaaaaaaaaagcttatcgataccgt

SEQ ID NO: 45057 - protein, 142 aa, Zea mays
  misc_feature: Ceres CLONE 1448217-F
MDYSMQGSKDSSSPQVHNHLYPDAQPGLYPPPPPAPPPAMANPPQGGYGYGYQYQGYLGEAANPPPPYYYTGSWPEQPPPPSDGAPFRYRYLQDQDDANCITFLRGCLAGLCCCCLLERCCIYGGWRAVLLPGARMYAAVWW

SEQ ID NO: 45058 - DNA, 724 bp, Zea mays
  misc_feature: Ceres CLONE 1448222-F
  misc_feature: Translation starting site: 151
  misc_feature (383)..(383): n is a, c, t, g, unknown, or other
  misc_feature (395)..(395): n is a, c, t, g, unknown, or other
  misc_feature (724)..(724): n is a, c, t, g, unknown, or other
gcggtggcggccgctctagaatagtggatcccccgggctgcaggaattcgcacgagaccattacctagaacgtcctaatcgaaaaagaccacccaaacccacacaacccactcggaggcggcgacggcggcggcggcggagcacgcgaagatggagaaattcctgaagccgggcaaggcggtgatccttctccagggtcggttcgccggccggaaggcggtcattgtgcgcgttttcgaggagggcacgcgcgaccgaccctacggccactgcctcatcaccggcctagcctagtaccccgagaaggtgatccgtacggactcggcctagaagacggcgaagaagtctcgcgtgaagtgcttcctgaaggtggtgaacttcanagagattaccanacccttgtgtcaacatgaatgtcgacttcaaagacgtggcctccggcgggcccgacgccctcgccacccgcgactagaaggtcgcctcctgcaaggacgccaaggcacgtctcgaggataggttcaagaccggcaagaacaggtggttcttctccaagctccgcttctaggagcagagcgtctttacaatactagtattccttgttcttgctatcaatagcacgcggagttatctctatgcctggttttgtattgcccttgaagattttgttggtactcatggatcttccaaataagcctaattaagggcctgatgatgatgacctaan

SEQ ID NO: 45059 - DNA, 548 bp, Zea mays
  misc_feature: Ceres CLONE 1448227-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (142)..(142): n is a, c, t, g, unknown, or other
  misc_feature (151)..(151): n is a, c, t, g, unknown, or other
  misc_feature (152)..(152): n is a, c, t, g, unknown, or other
  misc_feature (291)..(291): n is a, c, t, g, unknown, or other
  misc_feature (292)..(292): n is a, c, t, g, unknown, or other
nnnnnnnnnnnnnnnnnnnnnnnnnnnnnnnnnnggggcccccggggnnnnnnnnnnnnnnnnnnnnggtcaaagctggactccccgcggtggcggccgctctagaactagtggatcccccgggctggcaggaattcgcacngagaccatnntacctagaacatccttaatcgaaaaatcatgtattatcctcagcctaccgtctccttggcggcggcggttgccctcctccgcccctcactccgccgccactctcaaagggcgtcatcccttctccgctccctcacgcgnnctcatgggttagtgcgaggaagaagacggcccgtctcaacgactttctccacgtcgagttggacgctactggatggaaccgggaaccggatccctctgaaaagggttcccttccccgggaggggatgtgggttttaccggggaactttgctctcaaaacctttgagaccccacccccggggggccccccccctaggggagaattctccccccaaaaaccgggggggggtataaaatagggggtggtggaggggacc

SEQ ID NO: 45060 - DNA, 693 bp, Zea mays
  misc_feature: Ceres CLONE 1448228-F
  misc_feature: Translation starting site: 430
  misc_feature: SWISSPROT Homolog: EC 6.3.2.19 Ubiquitin--protein ligase
aagctggagctccccgcggtggcggccgctctagaactagtggatcccccgggctgcaggaattcacaggagacctttacctagaactcctagtcgaaagaacaaagaccgtggctcccccccgaatctagctttctgtctgtgtctctctctctctctctctctcgatggagaagaatcaggcaggccttcttctccagcaacagctcacacgtctgtgccagaacccggttgatggtgttctcctgctggtctcgtccacgagagtatacgtctgttcagaggagcgtgtcgatcatgggtcctcccgatactttggatgagaggggattcgttagtgcgatttatgacatttccggaggaatatcctaacctcccaccaactgagagggtcacctcggagatgtcggcatcctagtgcttactctgatgggaaagtttgcatatcggttcttcatcctcctggcgatgatcctaatggatacgagcttgcctctgaacgtgtggaaccctgtccatacgggagagaccattatgttgagtatcatatccatgctctcgagtccaaacgatgagtcaccagcgaacgtcgaagctgctaaagagtggagagagaacagagcatggcttaggaagaaagtgagtcgctgagttcagaaatcgcaagagatgctatgagccgtctcttcttgg

SEQ ID NO: 45061 - DNA, 695 bp, Zea mays
  misc_feature: Ceres CLONE 1448232-F
  misc_feature: Translation starting site: 234
ccccgcggtggcggccgctctatactagtggatcccccgggctgcaggaattcgcacgagaccattacctagaacatcctaatcgaaaaacacacatacttgttgtataccgcctttgttcggagagaatcatcgagtcggatagagtccagggctccaggcgctgcgtactgatcgaagaggcgtgtctcttcgatcgacctccaggcttccagctagctagctagcgagcgatggcattgagggagatcgagtcgacgctgccaccggggttcaggttctacccgagcgacgaggagctggtgtgccactacctccacaagaaggtggccaacgagcgcatcgcgcaggggacgctcgtcgaggtggacctgcacgcccgcgagccgtgggagctcccaggtcagttcaggtggcgaagctgacggccaccgagtggtacttcttcagcttccgggaccgcaagtacgccacggggtcgcgcaccaaccgcgccaccaggacgggctactggaaggccacgggcaaggaccgcgaggtgcgcagcagcagcagcgccaccgccgtcgtcgtcggcatgcgcaagacgctcgtcttctaccggggcagggcccccaacggcgtcaagtccggctgggtcatgcacgagttccgcctcgacaccccgcattcgccgccaagggaggacttggtgc

SEQ ID NO: 45062 - DNA, 698 bp, Zea mays
  misc_feature: Ceres CLONE 1448236-F
  misc_feature: Encodes the peptide sequence at SEQ ID NO. 45063
ggagctccccgcggtggcggccgctctagaactagtggatcccccgggctgcaggaattcgcacgagaccattacctagaacatcctaatcgaaaaaaccagccccgtccggagggacagacagcgagcgagcgagcgagcacgcccgcggcccgcactgccaagtgccactgcccccagcaacccccgccaccttagcgcccgacggtatgtctctcgcctcctcccaccacctgcggccgtcgccggcgggcccggcgcggcgcccgggctgccccgcgccgcgcgtggcgctctgccggctagccggtgcctcgcccccgtaccgcggccgctgctgcaccatcgtggcggcggcggcgcctgccgcgggcgccggcggcgaggcagcctcggcccccgcccccgccgccgctgtgccggcggtcgcccccggtgccgccgccagggacaaggtgcggcgccacacgatttcggtgttcgtcggggacgagagcggcatgatcaaccggatcgccggggtgttcgccaggagaggctacaacatcgagtcgctcgccgtggggctcaacaaggacaaggccctcttcaccattgtcgtctccgggaccgacatggtgctcaaccaagtcattgagcagctcaataagctcgtcaacgttcatagtgttgaagatctatctaaagaacctcaggtt

SEQ ID NO: 45063 - protein, 163 aa, Zea mays
  misc_feature: Ceres CLONE 1448236-F
  misc_feature (86)..(150): Pfam Name: ACT Pfam Description: ACT domain
  misc_feature: SWISSPROT Homolog: EC 2.2.1.6 Acetolactate synthase
MSLASSHHLRPSPAGPARRPGCPAPRVALCRLAGASPPYRGRCCTIVAAAAPAAGAGGEAASAPAPAAAVPAVAPGAAARDKVRRHTISVFVGDESGMINRIAGVFARRGYNIESLAVGLNKDKALFTIVVSGTDMVLNQVIEQLNKLVNVHSVEDLSKEPQV

SEQ ID NO: 45064 - DNA, 708 bp, Zea mays
  misc_feature: Ceres CLONE 1448242-F
  misc_feature: Encodes the peptide sequence at SEQ ID NO. 45065
tggagctccccgcggtggcggccgctctagaactagtggatcccccgggctgcaggaattcgcacgagaccattacctagaacatcctaatcgaaaaccattcttgaaatgggtggcgggacatgggatagagacactgtactacgtgctctgcgggctgcgtacaacaatccagagcgtgctgttgagtacttatattctgggattcctgaacaaatggaggttcctgcaccgcctccgagttcccaaccagtcgaccctgttcaggcggtacaaccagctcaagctggaccaaatgctaaccctctcgacctctttccccaatctcttccgaatgattccgctaatgccaacacaggaaatcttgatgttttgcgtaataactcacagttccaaaacctacttggtttggttcaggctaaccctcaaattttgcagccattgcttcaagaattgaggaaacaaaatccccgggttatgcagctaatccaggaaaaccaagcagagtttatgcggttgattagtgagccactagagggagacgaagagaatgaaatgatgctggatcagatggcagatgcaactgagaccattgcagtcactccagaggagaatgaagctatacttcgtcttgaagggatgggctttgaccgggcactcgtcctggaagtgttcttcgcctgcaacaagaacgagcagctggccgcc

SEQ ID NO: 45065 - protein, 200 aa, Zea mays
  misc_feature: Ceres CLONE 1448242-F
  misc_feature (86)..(144): Pfam Name: XPC-binding Pfam Description: XPC-binding domain
MGGGTWDRDTVLRALRAAYNNPERAVEYLYSGIPEQMEVPAPPPSSQPVDPVQAVQPAQAGPNANPLDLFPQSLPNDSANANTGNLDVLRNNSQFQNLLGLVQANPQILQPLLQELRKQNPRVMQLIQENQAEFMRLISEPLEGDEENEMMLDQMADATETIAVTPEENEAILRLEGMGFDRALVLEVFFACNKNEQLAA

SEQ ID NO: 45066 - DNA, 690 bp, Zea mays
  misc_feature: Ceres CLONE 1448247-F
  misc_feature: Encodes the peptide sequence at SEQ ID NO. 45067
  misc_feature (492)..(492): n is a, c, t, g, unknown, or other
  misc_feature (529)..(529): n is a, c, t, g, unknown, or other
  misc_feature (608)..(608): n is a, c, t, g, unknown, or other
  misc_feature (609)..(609): n is a, c, t, g, unknown, or other
  misc_feature (617)..(617): n is a, c, t, g, unknown, or other
  misc_feature (619)..(619): n is a, c, t, g, unknown, or other
acccgcggtggcggccgctctagaactagtggatcccccgggctgcaggaattcgcacgagaccattacctagaacatcctaatcgaaaaaccgattgttctggctcctgcgcgccgccagccccgcttgttctggctcctgcgcgccgccagccgtcagcccgtcaccgattggagatccttggacacctgcgcgccgccagcccgtcaccgcttggagacccgcgcagccgcgcttccctgcgcgccgccagccgtcgccgatccgtggccgcgtccgccgccgccagccctaaggtcgcgccgtcagccagcccgtctgccgtcgtgaggaatttttctcgtaatcagcatggcactgtcatcaatgtttaagagaataaatgtgaaagatttgacctccaaggtttcagtctataccagtgctacagagttatctggtggactaaacatgatatttaggcgctgggccacgaaaaggactgctggatncacaaaaaatggtcgcgattccaatccaaagtatttnggggtaaagaagtttggtggagagaaagtactacccaggaacatcattgtccgccaaaagggacccgcttcccatctgnnaactatgntngcatgggcaagatcatacacttttctgcctgaaagaaggcatgtacgctttgagcgcaacaactctcaggc

SEQ ID NO: 45067 - protein, 112 aa, Zea mays
  misc_feature: Ceres CLONE 1448247-F
  misc_feature (40)..(107): Pfam Name: Ribosomal_L27 Pfam Description: Ribosomal L27 protein
  misc_feature (47)..(47): Xaa is any aa, unknown, or other
  misc_feature (59)..(59): Xaa is any aa, unknown, or other
  misc_feature (86)..(86): Xaa is any aa, unknown, or other
  misc_feature (89)..(89): Xaa is any aa, unknown, or other
MALSSMFKRINVKDLTSKVSVYTSATELSGGLNMIFRRWATKRTAGXTKNGRDSNPKYXGVKKFGGEKVLPRNIIVRQKGPASHLXTMXAWARSYTFLPERRHVRFERNNSQ

SEQ ID NO: 45068 - DNA, 773 bp, Zea mays
  misc_feature: Ceres CLONE 1448248-F
taaagctggagctccccgcggtggcggccgctctagaactagtggatcccccgggctgcaggaattcgcacgagaccattacctagaacatcctaatccgaaaatggattcagtgaagggaagccggttgctgcaataaccatatacaaatgccttcttcattggagaatttttgagacggacaaaacaaatgtttttgatcgattgattcagatttttggttctgcaatgcagaaacaagataacaatgctgatcttgcatactggttatcaaattcatcatctctactgattatactacaaaagagccctcaacctcctggttcatctgtaacaactccaatgaaaagaccccagactcttattcattccttggaagggggggaggtggggcttcaggattactggtgcaaaggattcttgtccgccaaaaataagccaaattcccgggccccctttttaaagcacaacttaaaccttttggggaaggctttaatggagagtccccaacaatgttgaaaaaaaaaatactccccgatttcccccaggctcccggccccaaaaaggaaaattggtgtttataaacaaaacaaggggttttggccaacaaagcccccatctttagaggcccctcaaaaatttcgaaaaaacgtttgtcccgccttttttttccacaaaacttcccccaatttttcgattactaccgcccccccccaaaaagaccccccgcccccccagtattcctcctacagggagaaaattaaacaaaccgg

SEQ ID NO: 45069 - DNA, 700 bp, Zea mays
  misc_feature: Ceres CLONE 1448256-F
  misc_feature: Encodes the peptide sequence at SEQ ID NO. 45070
  misc_feature (454)..(454): n is a, c, t, g, unknown, or other
tcaccgcggtggcggccgctctagaactagtggatcccccgggctgcaggaattcgcacgagaccattacctagaacatcctaatcgaaaatctgagcattctaaagctcatagccctctccttccagagcatttcacatcgctctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagaccatccccgagctctggcctatcgtcagagaacgagcatggcctgcagtggtccaacagccctgaggccacatccatgggtcttgctgcctgtcctcgctgcttcatctacgtcatgctcccaacagatgaccctcngtgcccccagtgcaaagccttggttcttcttgactttctgccggaaaccaccaaccaccgtaaaaccaccgtattaaatcccccgggggaaccgggggggaagaacaattgggtccaaggggggccctcttaaaaaaaaatttttaagccccaggggccgaattttttttgggggcttttcccgggggaggggggaatccttccaaaaaggggaaaagccccccccgggaaaaaaaaaaaaaaaaa

SEQ ID NO: 45070 - protein, 92 aa, Zea mays
  misc_feature: Ceres CLONE 1448256-F
  misc_feature (49)..(49): Xaa is any aa, unknown, or other
MRRPSPSSGLSSENEHGLQWSNSPEATSMGLAACPRCFIYVMLPTDDPXCPQCKALVLLDFLPETTNHRKTTVLNPPGEPGGKNNWVQGGPS

SEQ ID NO: 45071 - DNA, 809 bp, Zea mays
  misc_feature: Ceres CLONE 1448280-F
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (433)..(433): n is a, c, t, g, unknown, or other
  misc_feature (439)..(439): n is a, c, t, g, unknown, or other
  misc_feature (440)..(440): n is a, c, t, g, unknown, or other
aatttaccccccgggccccacacataataatagataaagaggannnaanccaccccccataactggtactccaccgcggttggcggccgctctagaactagtggatccccccggctgcaggaattcccaccaaacccttacctaaaacatcctaatctcaaaattagaaaggcagggccccatattcacacgcgcaaactgtgcgtgccccttatatccgtcttcgggctctttctcgtgagtgcccagattttgagtagatacagagagaggaatcgttgcacctaccttctccgccgccacaaagaagatgctgggacggcggtgttgctgcttcttctgctggcaacatgctgctggttttttattgttgtccaagcattttttatgatggcagcacattctgcggaggcagaaacaactcatataatanaaaaanntctacaaaacaaaaccccctgtttctgtgctgttggtgcggccacaaatattttctgccccccccgagagaactcaaggaaaaatattgatggaacgcccctcctaggagcacgcactaccacattgatggtgcgggggtcatacctcccccgtcgacaaggcgaaagagtcctagcctcttttccccccccagggggcgccccagtctttcccccagaaggatctcctcctcggcaataagggggccccccgcccggtggtgggccctccctgaggggccgctcaaaccacccgcagtctttgtaggggcgttcaaaaaaccataattttaaagaccacggggcgccccgtttccccccctccccaaa

SEQ ID NO: 45072 - DNA, 912 bp, Zea mays
  misc_feature: Ceres CLONE 1448285-F
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
ggatctccaccaatccagcggggaagaggcgannnnggtgataaattttatcaaaactggagctccccgcggtggcggccgctctattactagtggatcccccgggctgcaggaattctcacgagaccattacctagaacatcctaatcgaaaaattttctcagtctcgagcgcccgcgtccctcgccccgtcgcgacttcgcgagtcgccccgtcccaggctcccagccgtcccaggctccccgcgaccccgccctccggcagtccggcgcgggggctcctctccgatccggtgagccaaacgaggacccgaactccccgaagaaagcggccacagccagagccagggtggatcgggccctcctctcagagactgcgccacaagcgtctaacgtctcggtatggaaggggaaacgcggaccagtttggtcaagaaaccaaactgcccaactcccgccctggctaaactggaagagtcgggcccccccccctgaccgaacctggaactgactcattagagggctatcatggagggacatttggggcaggcctggcatcagagggtttgttgggccctccagaaacgttgggcggccagtcagcgcgcaataaatgttattgcgtcagctaaacgagccttccacccgtgactataggggaatctgggtatcgtatacaaatggtgagtatagtgttctttcaaatagtaacctgaaggatagcgatagatccgattacccttcctaggctgataccgccttctgtaccgaaatgtaagaaaacgctctccactattaactgtgtggagggacaataaattatgtggaccgaaaccgcttgttcattatacggtggattgggttgaagaacatcataatgaatacaaagacacatgcacataaaggtccacaa

SEQ ID NO: 45073 - DNA, 631 bp, Zea mays
  misc_feature: Ceres CLONE 1448290-F
  misc_feature: Translation starting site: 193
cccccgggctgcaggaattcgcacgagaccattacctagaacatcctaatcgagaaactttctctctctctctcaggcgtcgggctgctgtccatcccgtacgcgctgtcggagggcgggtggctgagcctggcgctgctgctcctcgtcgcggccgtctgctgctacacgggcctgctcctgcagcggtgcatggacgcgtccccagccgtgcgcgggtacccggacatcggcgccctggcgttcgggcgcggcggccgcctcgccgcgtccgcgttcctctacgccgagctctacctcgtcgccatcggcttcctcatcctggagggggacaaacctggacaagctgttcccgggcaccagcctcagcctcggcctcctcggcgccgccctcgtggtctccgggaagcagctcttcgtcgtcctccgtcgccctcgtcatcctgcccaccacgtggctccggagcctcggggtgctcgcctacgtgtccgccagcggcgtgctcccgtcggacgtcctcgtcgtctgcctgctgtggaccgcgctgggccaacggggtccgctttcctggccagggggaggatgcttcaacgtcagcgggcctcccccacgggtcccggcccctacacc

SEQ ID NO: 45074 - DNA, 675 bp, Zea mays
  misc_feature: Ceres CLONE 1448295-F
  misc_feature: Encodes the peptide sequence at SEQ ID NO. 45075
ctggagctccccgcggtggcggccgctctagaactagtggatcccccgggctgcaggaattcgcacgagaccattacctagaacatcctaatcgaaaaacggtgcacgcgcacacgcgcaccatctcctgcgcgccgccagccccgcttctcctggctcctgcgcgccgccagccgtcagcccgtcaccgattggaggtccttggacacctgcgcgccgccagcccgtcaccgcttggagacccgcgcagccgcgcttccctgcgcgccgccagccgtcgccgatccgtggccgcgtccgccgccgccagctctgaggtcgcgccgtcagccagcccgtctgccgtcgtgaggtactgagcattgtttcaagtggttattaggcttcatggatatgtctcaagagcaagaacaggattttggcgtactgctgaagcaaggtgcagaagggagggtatttgcttcgacatttgtgggacgaaagtgtgtaatcaaagagcgtttttcaaaaaagtaccgacacccattgttggactcgaagttgactctaaagcgcttaaatgctgaagctcggtgcatgacaaaagcaagaaggcttggtgttcctaccccagtactttatgctgtggatccagttctgcatactttgacctttgagcatgtggatggcttgtct

SEQ ID NO: 45075 - protein, 96 aa, Zea mays
  misc_feature: Ceres CLONE 1448295-F
  misc_feature: SWISSPROT Homolog: EC 2.7.11.1 Non-specific serine/threonine protein kinase
MDMSQEQEQDFGVLLKQGAEGRVFASTFVGRKCVIKERFSKKYRHPLLDSKLTLKRLNAEARCMTKARRLGVPTPVLYAVDPVLHTLTFEHVDGLS

SEQ ID NO: 45076 - DNA, 763 bp, Zea mays
  misc_feature: Ceres CLONE 1448298-F
  misc_feature: Encodes the peptide sequence at SEQ ID NO. 45077
aaagctggagctccccgcggtggcggccgctctagaactagtggatcccccgggctgcaggaattcgcacgagaccattacctagaacatcctaatcgaaaaacatttctcttctggaacataagtaccgtgcaaacttcgaccgggaccggcgatatccgccatggccaccatcactgccgccgctcgctggagcttccccgcccgtctccagttcctcaccagccgccgcttttgcttccccgcctcctctgccgcgccgcccacttctgtagcggggttcagttgggccgacgccctccgcgtcgctggggacggcgggcgcggcgacgagtccgacctctccgggtacttccggaaggtcaagagctgcaaccgcggaatggacaaaaaagggcagttcgtggagttctctgtggaggatcaggtcgtggggtacatccacaagggatttatcgaacacatcagagactttcatgatgtttttaccattgtcatggatgacaatggcagcaacactgtggagcatgtgtctctccagtcatcactaaggactccagaagaccgaacacatgctattggaagtgtcattaaaaagccttggagaattgatccagctctacccagtgacgtcatcttatggcatgcctgtggacttctctctggaacgtgctgctgctccctactttggataaaagcttatgggagtcatatgaatggggatgtgaaaaagatggtcagaaatttctttgatgggaaaacg

SEQ ID NO: 45077 - protein, 200 aa, Zea mays
  misc_feature: Ceres CLONE 1448298-F
MATITAAARWSFPARLQFLTSRRFCFPASSAAPPTSVAGFSWADALRVAGDGGRGDESDLSGYFRKVKSCNRGMDKKGQFVEFSVEDQVVGYIHKGFIEHIRDFHDVFTIVMDDNGSNTVEHVSLQSSLRTPEDRTHAIGSVIKKPWRIDPALPSDVILWHACGLLSGTCCCSLLWIKAYGSHMNGDVKKMVRNFFDGKT

SEQ ID NO: 45078 - DNA, 761 bp, Zea mays
  misc_feature: Ceres CLONE 1448303-F
  misc_feature: Encodes the peptide sequence at SEQ ID NO. 45079
aaagctggagctccccgcggtggcggccgctctagaactagtggatcccccgggctgcaggaattcgcacgagaccattacctagaacatcctaatcgaaaaacagacgtacagtacagtcgctgcagcgaaagggggatcgcgcgaggcgagatggagctctcgccggtggggaggtgggccgacctccccgaggacatcgccgtagccgtcgcctcctgcctccaggaggccgacgtctgcgcgctcggcggctgctcgcgctcctggcgcagagcctgcgacgctgactgcatctgggagcgcctcttccgctgccgctggccatctgccgtggcgtcggcgtcccctgtgcaggtaccgcaaagaagggtaaagggatggaaagctctctacatcagccagcacagaagaatggctgttgcaatatctaatgtggttgaatttgtgggcagcagcttaaataatgagtcacttgaatccgaatactatctgaaaagctattgctgatttggccttgatacctgatataggattcctcgatgtccagtttttcttgttctcaaggaatcatagtgcgataatcaaccttattggactgcactactcgatcgcatctttgcatgtgctgccaactgaagtcagtaaagcactccaagctcaccgagtagcaaaaagggtagtttgtgtgaactggtccattaggtggttctattggttcccggtggccgacgaatacgagtgccaccgaatctttctgg

SEQ ID NO: 45079 - protein, 118 aa, Zea mays
  misc_feature: Ceres CLONE 1448303-F
  misc_feature (7)..(54): Pfam Name: F-box Pfam Description: F-box domain
MELSPVGRWADLPEDIAVAVASCLQEADVCALGGCSRSWRRACDADCIWERLFRCRWPSAVASASPVQVPQRRVKGWKALYISQHRRMAVAISNVVEFVGSSLNNESLESEYYLKSYC

SEQ ID NO: 45080 - DNA, 597 bp, Zea mays
  misc_feature: Ceres CLONE 1448308-F
  misc_feature (231)..(231): n is a, c, t, g, unknown, or other
  misc_feature (237)..(237): n is a, c, t, g, unknown, or other
  misc_feature (238)..(238): n is a, c, t, g, unknown, or other
  misc_feature (291)..(291): n is a, c, t, g, unknown, or other
aagctggagctccccgcggtggcggccgctctagaactagtggatcccccgggctgcaggaattcgcacgagaccattacctagaacatcctaatcgaaaacacacacacttttttctccggacgcgctcgttcgttcgcgaaggcgccccttcctgccctcacatccgctcctccctcccgacaccgacgacccctcgtcgctcgccctcctcccgatcccacgcatggncgcgcnngcgcgcggtctctctttctctcgaggtcgatcgcgcccgactgctttcctcgnaagtggggtggcccgtgctcagcacggcacgtggcgcgatgcgggggcccttgctccagaaacctcagaccgccctcagggtgccccccctggggccgttttgggggccaaaggacccttccccggggggtcttaattcgggggcccctttggggcccaaaattttggaggggtgtcccccgggggggtgttttcctcttttacccccccggggggaaaaaaaactcccccccccccccggggagaaaagttgggggggtttttttttccccccccccccccctttttgaggggggggaggagggg

SEQ ID NO: 45081 - DNA, 770 bp, Zea mays
  misc_feature: Ceres CLONE 1448324-F
  misc_feature: Encodes the peptide sequence at SEQ ID NO. 45082
  misc_feature (470)..(470): n is a, c, t, g, unknown, or other
  misc_feature (478)..(478): n is a, c, t, g, unknown, or other
  misc_feature (552)..(552): n is a, c, t, g, unknown, or other
  misc_feature (569)..(569): n is a, c, t, g, unknown, or other
  misc_feature (571)..(571): n is a, c, t, g, unknown, or other
aagctggagctccccgcggtggcggccgctctagaactagtggatcccccgggctgcaggaattcgcacgagaccattacctagaacatcctaatcgaaaaacactcgcagctcgcacatctcatggtgtcctaagaacggcaagagccagctctgcctagcagcagcgcacagccacatccatggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcaacggcgcggggctccgccgcgccgcggcgcaagtggcggcggcgtgcgcaacncacggttncttcccagtgtgcgggcacggcgtgaacgcggcgctggggccggcccgctggaaggcccagcaatttcttcggntgccgctggtgaaaaananggggccgggcggtccccggaaccgggtccgggtacccaaacccaagcccaccgggttccggtcaattcccccggaaggaaaccctgtctttggggtccaaaaagggcccccggccccccttttgggaaaaatttcccgggccccccgggaaaaatattcaacccaggggcggggggtccccaaatccccccggagagaa

SEQ ID NO: 45082 - protein, 196 aa, Zea mays
  misc_feature: Ceres CLONE 1448324-F
  misc_feature (99)..(99): Xaa is any aa, unknown, or other
  misc_feature (124)..(124): Xaa is any aa, unknown, or other
  misc_feature (129)..(129): Xaa is any aa, unknown, or other
  misc_feature (130)..(130): Xaa is any aa, unknown, or other
MDASPTPPLPLRAPTPSIDLPAGKDRADAAANKAAAVFDLRREPKIPEPFLWPHEEARPTSAAELEVPVVDVGVLRNGNGAGLRRAAAQVAAACATHGXFPVCGHGVNAALGPARWKAQQFLRXPLVKXXGPGGPRNRVRVPKPKPTGFRSIPPEGNPVFGVQKGPPAPLLGKISRAPREKYSTQGRGVPKSPRRE

SEQ ID NO: 45083 - DNA, 740 bp, Zea mays
  misc_feature: Ceres CLONE 1448325-F
  misc_feature: Encodes the peptide sequence at SEQ ID NO. 45084
  misc_feature (393)..(393): n is a, c, t, g, unknown, or other
  misc_feature (396)..(396): n is a, c, t, g, unknown, or other
  misc_feature (457)..(457): n is a, c, t, g, unknown, or other
tggcggccgctctagaactagtggatcccccgggctgcaggaattcgcacgagaccattacctagaacatcctaatcgaaattttttcgcgtgctccgccgtcacgacccaaattattgagagcccaggaagtgagagatgagcctgcagattccggtgagatcaggcgccctgcgccgccttctccttctaggtggcgccgagggtctactgcgcacctactccaccggcgaccggcgccggcgggtgatccgcgaggcaaggcaagaggaggaggacgaagcgttcctccgcaccctctacttcggcgctgaccccgagaactatcctcttcctcctgctgctgagcatggcagaagattatccgacgcctcagccgggaagcagcagcancanctctgagcgaagcgcgctgaaagtcgtcggggagacgctgctggaaaagcttaagctgggncgatggcccttccgccgccgctgctataggaggccggaaatgacccccggaatttgaaggacgagcctggccccgcccaacccggggaccgggaaccaaatttttccaaagaagaaagaaaacggggttgaatcccaaaccctggggccttgttcacagggtttggtaaaaaacggcttgggggcaggacccccttaaactttttggtccttatggaaaaaaagggacccttcccgggggggggtatttaacacctttgttttcaaaaatttttctggggggg

SEQ ID NO: 45084 - protein, 87 aa, Zea mays
  misc_feature: Ceres CLONE 1448325-F
  misc_feature (85)..(85): Xaa is any aa, unknown, or other
  misc_feature (86)..(86): Xaa is any aa, unknown, or other
MSLQIPVRSGALRRLLLLGGAEGLLRTYSTGDRRRRVIREARQEEEDEAFLRTLYFGADPENYPLPPAAEHGRRLSDASAGKQQXXL

SEQ ID NO: 45085 - DNA, 796 bp, Zea mays
  misc_feature: Ceres CLONE 1448330-F
  misc_feature: Translation starting site: 140
  misc_feature: Pfam Name: BolA Pfam Description: BolA-like protein
aagctggagctccccgcggtggcggccgctctagaactagtggatcccccgggctgcaggaattcgcacgagaccattacctagaacatcctaatcgaaaactctcgtgtcgtctcttcagctatcagacggcaagacgatgctgccgctgaggtccgccgccgccgcgccgtgctcggttgcaggacttctgctccaccgattctcatcctactcgtcctcttctgtctattctgtccgccaccacgcctcgtctgctctctcctcccagccctccacccgccccaccaccacctggtcctcttcccccaattccagcagccgcaggatcaggggggttgcggcctgggcttcggcgccggggccggcggggtctgcggattccctcgctacaaggcgctagaggctaagatcaaagagcagctggagggcgacacagtcacgggtgtggatacctctgggagatggccgcaatggtttgcatagacctggattcccaggcatttgagggaaaatctgcttgtaaccgggcaagaatggtcctccagggttttgggggagagcttcaaaaccttgggcatgctggggaccacaaaactcccaaacgcctggagaaaattgcgcccaccaggaatccgaaaaggcccccaccctgggaaaaacacaaaattttggtgtttcaaaaaaaaggcgcttggcttcaccaattttttttcctgggggggcttatttttttgggggggcgccgagaggggaaaaactccccccgtggaaaaaccgcgggggaaaaaaaaaa

SEQ ID NO: 45086 - DNA, 721 bp, Zea mays
  misc_feature: Ceres CLONE 1448331-F
  misc_feature: Encodes the peptide sequence at SEQ ID NO. 45087
  misc_feature (667)..(667): n is a, c, t, g, unknown, or other
  misc_feature (668)..(668): n is a, c, t, g, unknown, or other
  misc_feature (707)..(707): n is a, c, t, g, unknown, or other
  misc_feature (711)..(711): n is a, c, t, g, unknown, or other
  misc_feature (718)..(718): n is a, c, t, g, unknown, or other
tggagctccccgcggtggcggccgctctagaactagtggatcccccgggctgcaggaattcgcacgagaccattacctagaacatcctaatcgaaaaacgaccgctcctcctcttctctgccccaggccagaatcaagggagggtgaagcaccgccgctgaccgctgtccccggctccccgccgccgcacaaagacgagaggaagaggttcccggcggcgccacgactatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgagtgacatgttggcgttggtgaaaaaggaagcgccgagcgtcagtcactgggagcccttcactataccagaggacacttccctagggtgctggatagacatggtcgcaagtattctacctctttaccgcaaatcagaacgcatcnnaataaatgcagtggatgaaactggttttttttttgtccnaccnaagtctnatt

SEQ ID NO: 45087 - protein, 163 aa, Zea mays
  misc_feature: Ceres CLONE 1448331-F
  misc_feature (11)..(114): Pfam Name: UCR_14kD Pfam Description: Ubiquinol-cytochrome C reductase complex 14kD subunit
  misc_feature (147)..(147): Xaa is any aa, unknown, or other
  misc_feature (160)..(160): Xaa is any aa, unknown, or other
MSSMMNALANWLANPRRNPLARLHMHAVSSRLRKYGLRYDDLYDPYFDLDIKEALGRLPREVVDARIQRLKRAMDLSMKHQYLPEDLQAQQVPFRGYLSDMLALVKKEAPSVSHWEPFTIPEDTSLGCWIDMVASILPLYRKSERIXINAVDETGFFFVXPKS

SEQ ID NO: 45088 - DNA, 770 bp, Zea mays
  misc_feature: Ceres CLONE 1448336-F
  misc_feature: Encodes the peptide sequence at SEQ ID NO. 45089
  misc_feature (424)..(424): n is a, c, t, g, unknown, or other
  misc_feature (673)..(673): n is a, c, t, g, unknown, or other
aaagctggagctccccgcggtggcggccgctctagaactagtggatcccccgggctgcaggaattcgcacgagaccattacctagaacatcctaatcgaaaatccgcgtggtgtgctctctgttcctacgccgtttcctctcccgactctctcctcgccggcgacgccgcggagtaggtgcaacagaaactgctcgaggcggaggcggagcctgcggctgcacagacatgggtgatcacgaggcgcgcggtgatgacttcgagaagaaggcggagaagaagctctcgggctggggcctcttcggctccaagtacgaggacgccgccgacctcttcgacaaggctgcgaactcctttcagctcgccaagaactggagcagagctgcatcagtttacatcaagattgctaactgccattttaaggnagatagcaagcatgaggctgcctcagcgtacgtcgaggcagcaaattgctaccaaaaagtttcactcaagaagctgcccagcgctaaaccaggcggttaacttttcttgaaattggaaggttgacctggctgccaaaacccccaagcaccttggggaaatttttccccaagaccaaatttaaaaaaggttccaaattcccggaaaaggcccttgacctttttaaagggggggaaggtcttccctttcancccccctcaaaaagagtgtccaaaattgtccgccctttgggaccactccccccaacaccccgggaatttttgggcgcggcccccctcctaaaacaaa

SEQ ID NO: 45089 - protein, 98 aa, Zea mays
  misc_feature: Ceres CLONE 1448336-F
  misc_feature (66)..(66): Xaa is any aa, unknown, or other
MGDHEARGDDFEKKAEKKLSGWGLFGSKYEDAADLFDKAANSFQLAKNWSRAASVYIKIANCHFKXDSKHEAASAYVEAANCYQKVSLKKLPSAKPGG

SEQ ID NO: 45090 - DNA, 773 bp, Zea mays
  misc_feature: Ceres CLONE 1448337-F
  misc_feature: Translation starting site: 108
aagctggagctccccgcggtggcggccgctctagaactagtggatcccccgggctgcaggaattcgcacgagaccattacctagaacatcctagtcgaaaaaccgggatgtccgccatggagaccgacatcaacgcgccgccgccgcccgccccagctggcgagggatcctctgcggccggtccgtcctcctcccgcaagcccaacaagcgcttcgagatcaagaagtggaacgccgtcgcgctctgggcatgggatatcgtcgtcgacaactgcgctatctgccgcaaccacatcatggatctatgcatcgagtgccaggcgaaccaagccagcgcgaccagcgaggagtgcactgttgcttggggagtctgtaatcatgcttttcacttcactgcatcagcaggtggcttacgactcgtcaagtgtgcccattaagataacagtgagtggaagttccagaaatatgggccctaatttcttgggcacccccatgtgaaggtggggtttacttttagggccggcgaccccccgaggggtgtttttttcgccaaaaacccccctcttttacaggtttggaagctcgggtggtccccggggcatttccctccaggacccccccccccggaactttttttgagttgtcccttaagaaaaaaatttcccttttaaaaaaaaaaaaaaaattttttttcccccccccccccggggggggggggggacccatatcccctaaaaaagaggataaaaaccccgccccccccgccccctttt

SEQ ID NO: 45091 - DNA, 731 bp, Zea mays
  misc_feature: Ceres CLONE 1448355-F
  misc_feature: Encodes the peptide sequence at SEQ ID NO. 45092
  misc_feature (316)..(316): n is a, c, t, g, unknown, or other
  misc_feature (708)..(708): n is a, c, t, g, unknown, or other
agctcatcgcggtggcggccgctctacaactagtggatcccccgggctgcaggaattcgcacgagaccattacctagaacatcctaatcgaaaactctgatcctctccgccatttctgtgcgcatctggagctgttgttctaaacccccaaaccctccgtcctaacctctgcgccaccggcgtcaccaccgccggagccgcagccatgaacgccttcaggttcctcggggacatgacccacctcttctcggtcctcgtcctcctcctcaagatctacgccaccaagtcctgctcaggggtgtcgaggaagacgcangagctgtacatgttggtgttcgtggcgaggtacctggacctcttcacgaatatgtctcgctctacaactcggggatgaggggccccacatcaccagttcggcgggcatcgggggaagaaggccccccaccccccggtccaaggagttcccaaaggagcggaccctttccccccgggggttcgtcccccccaattctggtccggctaaattccaaaagggtttcccttcccgagaaaattgggggttttttacttttttgggggggggggctttttccccccaaaaaaggttgtccccaaaaaaacaaaaaggggaaaacattctggggaaaattgttttttttcttgggggcctcccgcggggttttttttttcaaaaggggatatttcgtntttctctcgggggggcgccccca

SEQ ID NO: 45092 - protein, 62 aa, Zea mays
  misc_feature: Ceres CLONE 1448355-F
  misc_feature (1)..(62): Pfam Name: ER_lumen_recept Pfam Description: ER lumen protein retaining receptor
  misc_feature (37)..(37): Xaa is any aa, unknown, or other
MNAFRFLGDMTHLFSVLVLLLKIYATKSCSGVSRKTXELYMLVFVARYLDLFTNMSRSTTRG

SEQ ID NO: 45093 - DNA, 719 bp, Zea mays
  misc_feature: Ceres CLONE 1448357-F
  misc_feature: Encodes the peptide sequence at SEQ ID NO. 45094
  misc_feature (304)..(304): n is a, c, t, g, unknown, or other
  misc_feature (324)..(324): n is a, c, t, g, unknown, or other
  misc_feature (327)..(327): n is a, c, t, g, unknown, or other
  misc_feature (328)..(328): n is a, c, t, g, unknown, or other
  misc_feature (367)..(367): n is a, c, t, g, unknown, or other
  misc_feature (668)..(668): n is a, c, t, g, unknown, or other
ggagctccccgcggtggcggccgctctagaactagtggatcccccgggctgcaggaattcgcacgagaccattacctagaacatcctaatcgaaaaaaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtgaanggtcttcgcgaggctgccanggnncatgagaagcatgctgctcagctttgcgttcttgctgangactgtgaccagccgattattgtcagctggtgaagggcctctgtgctgaacccaaggtccacttggcccctggtctggctgcaaaacccttgccaaaggggctggcctttgaaaaatgactccaaaggcagggaaggaagggttaaggtggctcctgggtctttttcagggacccgggggaaaaatcgagggcctttataatgggggggggttgtccggccccccaaaaaggaacccctttccaaaaaaccctctttttggagcgggggaaaaaaaaaagtccccccctggggccctctcnaaaaaaaaaaaatttttcccacacccccccgggaggatacaattttttttt

SEQ ID NO: 45094 - protein, 73 aa, Zea mays
  misc_feature: Ceres CLONE 1448357-F
  misc_feature (42)..(42): Xaa is any aa, unknown, or other
  misc_feature (49)..(49): Xaa is any aa, unknown, or other
  misc_feature (50)..(50): Xaa is any aa, unknown, or other
  misc_feature (63)..(63): Xaa is any aa, unknown, or other
MADQEAPVAVEAPTPVLGEPMDLMTALQLVMKKSSAHDGLVXGLREAAXXHEKHAAQLCVLAXDCDQPIIVSW

SEQ ID NO: 45095 - DNA, 811 bp, Zea mays
  misc_feature: Ceres CLONE 1448366-F
  misc_feature: Encodes the peptide sequence at SEQ ID NO. 45096
  misc_feature (318)..(318): n is a, c, t, g, unknown, or other
aagctggagctccccgcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaagcccccgccccggctcccgcgntcgacgccgcggccgccgtacccctcggcggcggctccctcgccggcggccgcttcggctacctcttctgctagatccggctggaaacgtggttcccgctccaaaatatgattccccctggtccggcccgcggtgagtccacccccggggggcgggggggtctctttttgagggggtcccgcgggcttgtgtttatttttaggaatcccccccgcccccccccaaaaaaaaaagtgtccccccggggggggggaaaattttttccacccccccttttttttccggggaaaaaagacaacccccccgggtttttttggttaaagaaagaattttttttttttttcaaaaaaaaaaaaaaaaattttttcccccccccccccgcggggggggcgcccccaccccccccccaagaggggaaaaacccccccccgccgggctttttttacccggggggagagaaaaacacgtctcccaataaattgtgcgccccccc

SEQ ID NO: 45096 - protein, 57 aa, Zea mays
  misc_feature: Ceres CLONE 1448366-F
  misc_feature (34)..(34): Xaa is any aa, unknown, or other
MAGLRMKFVAVAAMAAALVASAAAAEAPAPAPAXDAAAAVPLGGGSLAGGRFGYLFC

SEQ ID NO: 45097 - DNA, 716 bp, Zea mays
  misc_feature: Ceres CLONE 1448379-F
  misc_feature: Encodes the peptide sequence at SEQ ID NO. 45098
  misc_feature (506)..(506): n is a, c, t, g, unknown, or other
  misc_feature (528)..(528): n is a, c, t, g, unknown, or other
  misc_feature (538)..(538): n is a, c, t, g, unknown, or other
  misc_feature (604)..(604): n is a, c, t, g, unknown, or other
ggagctccccgcggtggcggccgctctagaactagtggatcccccgggctgcaggaattcgcacgagaccattacctagaacatcctaatcgaaaagacagtgttgttacataatattcctccgttgttctctagctactgcctactggcgttaccagatcgaaggaaagacgggcgatccatggagatggaactggaggctgctgccgcgccggctacgtgcaggagggacgggcggaggctggtgaggtgcccgccgctgcagcaggacaccgagacggccacggccatcgaacgttccacgggggagagcgtcgccgccgacgccgccgagggcgcgatgcgcgtcaagatcgtgctcagcaagcagcagctcaagcaggtggcggcggccgtcgccgccgccgggagcggtggcgccttcgccggggctgccgcgggcgctggagcagctcgtcagcgtgctaaagcgccgccagcacgcccagaagcagcaggctgctgcngccgacgcggtggctgctgccngaaggcgccngggcccgctgtcgccggcgctgcagtgcatcccggaggaaggcttttacctagagctaggcgtgcntgcgtacgtacgtttgggaagaactctgaattcaagccccattcggccttgaaaaagctaggtagcttcccccaaattttcgggccttcttcctggggttgcgttccccaac

SEQ ID NO: 45098 - protein, 178 aa, Zea mays
  misc_feature: Ceres CLONE 1448379-F
  misc_feature (109)..(109): Xaa is any aa, unknown, or other
  misc_feature (116)..(116): Xaa is any aa, unknown, or other
MEMELEAAAAPATCRRDGRRLVRCPPLQQDTETATAIERSTGESVAADAAEGAMRVKIVLSKQQLKQVAAAVAAAGSGGAFAGAAAGAGAARQRAKAPPARPEAAGCCXRRGGCCXKAPGPAVAGAAVHPGGRLLPRARRACVRTFGKNSEFKPHSALKKLGSFPQIFGPSSWGCVPQ

SEQ ID NO: 45099 - DNA, 684 bp, Zea mays
  misc_feature: Ceres CLONE 1448384-F
  misc_feature: Encodes the peptide sequence at SEQ ID NO. 45100
ctggagctccccgcggtggcggccgctctagaactagtggatcccccgggctgcaggaattcgcacgagaccattacctagaacatcctaatcgaaaaatcggactcatctccttcgattcagcagaggacagcgctctgcctctccactacttgacagccacggatccttccatccctcgcctagcgaacagacccggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgggctctgccatcgcattcatgttacctctgaaagcactcagacaatcctctagatttattgtcaataacagctgcgtatttggcattggcttcatcaaagttgccactatcaaagttaacacgacgctagaaacactgtttgtcaggaagatgaacatcttcaacgaggccaaagtttacacttggaaaatcgaggatttctctg

SEQ ID NO: 45100 - protein, 133 aa, Zea mays
  misc_feature: Ceres CLONE 1448384-F
MRYLKLNPKYEVSNEECVSLRLELSQSSVKLDTIFEASFKFMIYDQLIGKHKVHLGNHSFQTASTGSAIAFMLPLKALRQSSRFIVNNSCVFGIGFIKVATIKVNTTLETLFVRKMNIFNEAKVYTWKIEDFS

SEQ ID NO: 45101 - DNA, 702 bp, Zea mays
  misc_feature: Ceres CLONE 1448385-F
  misc_feature: Encodes the peptide sequence at SEQ ID NO. 45102
acccgcggtggcggccgctctagaactagtggatcccccgggctgcaggaattcgcacgagaccattacctggaacatcctaatcgaaaaaagtagaaaaggcaggcaccgcaaccaacggtaaagctggtgatcgagcaagttttgtcaagagcgagctcatggaggatggcagcagtgctccaagacgggctactccccccacccgcaggagcagatctgccgacttccacaacttttcagaaaggaggagaagggacaggatcaacgagaagctgagagcgttgcaggagcttcttccaaactgcaccaagaccgacaaagtttccatgctagatgaagcgatcgactacctaaaatccctccagctacagcttcagatgctggtcatggggaaggggggaggaatggcaccggtggttcctcctgagctgcagcagtacatgcactacatcacggccgaccccgcccaccagatgatgcctccgccgctgcggccctccgccgggcagctgcaacccgccgccggccggcagtttcaaataacccaagcagcagcagaggagccaacaacgacaacgacccccagcgacgaagaaagtccaacgtcgaggcggaattcttgaacccaatgcaaaacctgacccctccaaacacccccctctatattacaaatttcctccgggccccaagaatgcatct

SEQ ID NO: 45102 - protein, 154 aa, Zea mays
  misc_feature: Ceres CLONE 1448385-F
  misc_feature (20)..(69): Pfam Name: HLH Pfam Description: Helix-loop-helix DNA-binding domain
MEDGSSAPRRATPPTRRSRSADFHNFSERRRRDRINEKLRALQELLPNCTKTDKVSMLDEAIDYLKSLQLQLQMLVMGKGGGMAPVVPPELQQYMHYITADPAHQMMPPPLRPSAGQLQPAAGRQFQITQAAAEEPTTTTTPSDEESPTSRRNS

SEQ ID NO: 45103 - DNA, 725 bp, Zea mays
  misc_feature: Ceres CLONE 1448396-F
  misc_feature: Encodes the peptide sequence at SEQ ID NO. 45104
cagagctggagctccccgcggtggcggccgctctagaactagtggatcccccgggctgcaggaattcgcacgagaccattacctagaacatcctaatcgaaaactcggtccctcctctgcttcacacagaccagtgcgcgctcaattcccccctctagcgcctccaccgcaccaaaccggtccaacgggacctatgctctagcctcagagcaaaccaccgcctgaattgtgcggcaattgggggaggattcgcggcaggcagggcgcggatccgttggcgggatgattgcggctgtcaacagagtgccggcgggctggggcgaggatgagatgtccgtgctgccacggcacaccaaggtggtggtcaccggcaacaaccgcaccaagtcggtgctcgtgggattgcacggggtcccccaagaaggccgtcggcctcgggggatggcattggctgctgcttgcagttattcagacgaaaactttcaagttgcatgcacgttcttactaatgaaatagaggaaagctgcagcgaaatgctttagtggaataaaacttcgactggcaaccaggatgaggaaaaatttgattgggaaaacttgcaggggaataattcaaaaatgggcctccaaggaggccctttccccaaagccccccgggtctccggaccagggaacaaaaggggtttcccacaaaaaatccatccccccgttaagggcaatgggaac

SEQ ID NO: 45104 - protein, 77 aa, Zea mays
  misc_feature: Ceres CLONE 1448396-F
MIAAVNRVPAGWGEDEMSVLPRHTKVVVTGNNRTKSVLVGLHGVPQEGRRPRGMALAAACSYSDENFQVACTFLLMK

SEQ ID NO: 45105 - DNA, 667 bp, Zea mays
  misc_feature: Ceres CLONE 1448407-F
  misc_feature: Encodes the peptide sequence at SEQ ID NO. 45106
aagctggagctccccgcggtggcggccgctctagaactagtggatcccccgggctgcaggaattcgcacgagaccattacctagaacatcctaatcgaaaaaatacgaggaggagcagagcaggtctctccatggatgcgagccaggatgtgtgggactgggactgggaggtggtcatgccagatcacaggagcttctccacgagccatggcagcaagaatcttgatgataaagaaacagaggagcattatctgctgccaccgtcaggagacgttgacgtgcacgacgactgcaagggcatcggcgtcgtgctggatgagacctgcaaatccgccgtgcctagtgttgccgatccgattatggcttctgagggtggcaaggaagagaaggcgatccagagccctgatgccgaggagtccgtcaccaccgacagcaactttgctcaagaagaggaggaggaggaagaagatatcaagaaggacggcaacgataaggttggagccctgatcggcgcgctgtgctcgtttggggtcgcagccgccaccgcctgcgtctttctcatcggcggcaggctgcatcatcaccacatgcagcagcacaaaattcagctgcagttcttcggcgatgataagagcatccagcaagttgtgcgccagacgtcaaggct

SEQ ID NO: 45106 - protein, 178 aa, Zea mays
  misc_feature: Ceres CLONE 1448407-F
MDASQDVWDWDWEVVMPDHRSFSTSHGSKNLDDKETEEHYLLPPSGDVDVHDDCKGIGVVLDETCKSAVPSVADPIMASEGGKEEKAIQSPDAEESVTTDSNFAQEEEEEEEDIKKDGNDKVGALIGALCSFGVAAATACVFLIGGRLHHHHMQQHKIQLQFFGDDKSIQQVVRQTSR

SEQ ID NO: 45107 - DNA, 697 bp, Zea mays
  misc_feature: Ceres CLONE 1448414-F
  misc_feature: Encodes the peptide sequence at SEQ ID NO. 45108
  misc_feature (383)..(383): n is a, c, t, g, unknown, or other
  misc_feature (457)..(457): n is a, c, t, g, unknown, or other
  misc_feature (637)..(637): n is a, c, t, g, unknown, or other
  misc_feature (697)..(697): n is a, c, t, g, unknown, or other
ctccccgcggtggcggccgctctagaactagtggatcccccgggctgcaggaattcgcacgagaccattacctagaacatcctaatcgaaaaactgcggcttcaggactcgacctcttgcgccgccgccatgaccttcaagcgccgcaacggcggccgcaacaagcatggccgcggtcacgtcaagtacatccggtgctcaaactgcgccaagtgctgccccaaggacaaggcgatcaagaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccncgtagtgtaccttggccgtacctagtgctactctctactttggagtagctgaatgataataatgtagctagcancatgcatgtaggcgatcatacatacgtacgtacatgcaggtacttgtgtgtgatcatgtatgcttccagaagggtatcctagcttaattagtccaaaaaaaaaaaaaaaaacttatccataccgtcgacctcaaggggggggccgggaccccaattcgccctataatggagcgtattacncccccctcccctggccctccttttaaaacgccgggactggaaaaacccttggcttacccn

SEQ ID NO: 45108 - protein, 92 aa, Zea mays
  misc_feature: Ceres CLONE 1448414-F
  misc_feature (1)..(93): Pfam Name: Ribosomal_S26e Pfam Description: Ribosomal protein S26e
  misc_feature (85)..(85): Xaa is any aa, unknown, or other
MTFKRRNGGRNKHGRGHVKYIRCSNCAKCCPKDKAIKRFQVRNIVEQAAIRDVQEACVYDGYVLPKLYAKVHHCVSCAIHAHIVXVVYLGRT

SEQ ID NO: 45109 - DNA, 705 bp, Zea mays
  misc_feature: Ceres CLONE 1448416-F
  misc_feature: Encodes the peptide sequence at SEQ ID NO. 45110
  misc_feature (658)..(658): n is a, c, t, g, unknown, or other
  misc_feature (696)..(696): n is a, c, t, g, unknown, or other
  misc_feature (705)..(705): n is a, c, t, g, unknown, or other
ctccccgcggtggcggccgctctagaactagtggatcccccgggctgcaggaattcgcacgagaccattacctagaacatcctaatcgaaaaatttccccgccgcctccagatcacgactctgtccttcccaattctcaggcaaccccgtcgtcttccgccatgatccggttcatcctgctgcagaaccggcaggggaaaacacggctggccaagtactatgtcgctctcgaggactccgagaagcacaaggttgagtacgaggtgcatcggctcgtggtcaaccgggaccccaagttcaccaacttcgtcgagttccgcacgcacaaagttatatataggagatatgcaggactttttttctctatatgtgtggacatcaccgacaacgaattggcatacttgcaatgtatccatctgtttgttgagatattggaccatttcttcagcaatgtgtgtgaacttgatttagtatttaatttccacaaggtttacttgatattggatgagttcattcttgctggagagcttcaagaaacaagcaaaagggcaattatagagaggatgggcgagcttgagaagctggaatgaaaagaaacaatggtgtagtgtacattagcaatttagcataggtccggagctagttctgcccaatcgancaattacctccatatttttcacaatttcttgtacctgntgtgcatcn

SEQ ID NO: 45110 - protein, 142 aa, Zea mays
  misc_feature: Ceres CLONE 1448416-F
  misc_feature (1)..(142): Pfam Name: Clat_adaptor_s Pfam Description: Clathrin adaptor complex small chain
MIRFILLQNRQGKTRLAKYYVALEDSEKHKVEYEVHRLVVNRDPKFTNFVEFRTHKVIYRRYAGLFFSICVDITDNELAYLQCIHLFVEILDHFFSNVCELDLVFNFHKVYLILDEFILAGELQETSKRAIIERMGELEKLE

SEQ ID NO: 45111 - DNA, 660 bp, Zea mays
  misc_feature: Ceres CLONE 1448418-F
  misc_feature: Encodes the peptide sequence at SEQ ID NO. 45112
ctggagctccccgcggtggcggccgctctagaactagtggatcccccgggctgcaggaattcgcacgagaccattacctagaacatcctaatcgaaaaaatgatacatttctaactgcttctggagttcttcagccatggagttgcccggatccagatgtcctcaccacccaccacccacagggcacaaggccaccactcaccagataccgaagccgtagcaaagcaaactagcaaatcaaggcaagtctggaacggccccaccgatccgacccaaagcccaaatcggattcccctcgtttctcatcacgccaccgtttacccgccgccgcactggcagcggcgatggcgtcgtcgtcgtcgcggcccctgctctgccgcctcgcggaactggccagcggccgcgtccgcgccaactaccgcatgctctcatccgccttttcatccactgcctccaccgagagggtttcgcagtcgccggcggagcccgaggcggtgctcatgacggaaggttgcgtccggagattaaaagaattacatgctaaagaaccatcctctgaaggtaagatgctgcgcttaagcgttgaagctggtggatgttctgggtttcaatattctttcgctcttgatgacaagaaaaactcagatgatagggtttttg

SEQ ID NO: 45112 - protein, 105 aa, Zea mays
  misc_feature: Ceres CLONE 1448418-F
MASSSSRPLLCRLAELASGRVRANYRMLSSAFSSTASTERVSQSPAEPEAVLMTEGCVRRLKELHAKEPSSEGKMLRLSVEAGGCSGFQYSFALDDKKNSDDRVF

SEQ ID NO: 45113 - DNA, 674 bp, Zea mays
  misc_feature: Ceres CLONE 1448419-F
aaagctggagctccccgcggtggcggccgctctagaactagtggatcccccgggctgcaggaattcgcacgagaccattacctagaacatcctaatcgaaaactctgctcatttcgaactaataaaaaaaactcccctcggtgctctcgtcttgagcttcaggttctccacagagtctactcaaagggaagaacgcgacctctgtcagtactgtcaactcccttcctagcctactatgccatcgccgccagcgcttatcgagccgagcgattacatcggcacccgaaacaccacttcgtgctgttcttattcctgatcctctagccgccagggcacggggccccacctacggctgcggctcgggcttccggggtgctatgactcctccgggaactgggcagacgccgagtacgcccgaaccaacgtatactccgatctcactcttgatcccgtgcctgcaccgacagcttttaggagtagcgccaagagcccgatcgcctactcactacacaaggccgcgaaccgagactgaaataactacatatgacaataactgtgcgtctcacgcaagaagctggagctgatgcctgaacttcgcccactgtctaggcacaaatagttggatcggcctccagttcaaaactaactcaaaagaaacctatctggagatggat

SEQ ID NO: 45114 - DNA, 689 bp, Zea mays
  misc_feature: Ceres CLONE 1448434-F
  misc_feature: Encodes the peptide sequence at SEQ ID NO. 45115
ctggagctccccgcggtggcggccgctctagaactagtggatcccccgggctgcaggaattcgcacgagaccattacctagaacatcctaatcgaaaagaaaggccagaacagacgagagcaggaggacggagagcgccggcgaggaggcatggagccagacaaggccggggaggcagcgaaggagccgacggaaacggaggctggagactccgtggatccccgcgaactagtgtccagcgacgacgagatcgactactccgtcgagcctgatttctacgaccccgacctagatgacgtcgatgagcggtgggtgagcagacagaggaaaggccgcacatctgacgccgtgcttagctgccccgcctgtttcactaccctgtgcttggattgccagaggcatgagaagtacgtaaaccagtaccgtgcgatgttcgttcgcaactgcaagatcaagactgaccaggtcctgcgagagggcaaaagcaagaggaagaaacgcagaggaggaagggctggtgatccagctgccgcatctgaaggcgaaagcaaggggcagtcctaccaccccgtctgctgcgaggtctgctcaaccgaggttggagtgttggacgaggacgaggtgtaccacttctttaacgtgatccctagcaactcctgaatgccgtgaactgttgctctgtaggagtg

SEQ ID NO: 45115 - protein, 169 aa, Zea mays; identical to SEQ ID NO: 42064
  misc_feature: Ceres CLONE 1448434-F

SEQ ID NO: 45116 - DNA, 656 bp, Zea mays
  misc_feature: Ceres CLONE 1448436-F
  misc_feature: Encodes the peptide sequence at SEQ ID NO. 45117
  misc_feature (656)..(656): n is a, c, t, g, unknown, or other
acccgcggtggcggccgctctagaactagtggatcccccgggctgcaggaattcgcacgagaccattacctagaacatcctaatcgaaaaatcttctcctctgttctccacgacgcagttcggctgccagacaaaaaccctaaccaccgtcgccgccgccgccgccgccgctcttcctcgagatgggaggcaagtgcccgcaccgcaaggtaaagaagcgccgcctatcccacaagacggctcgccgcggcaagttcctcctgaaggccgacgatgccgtctatgacgagctcgtcaagctggccgaccagggcaaggacgctgaaaccaaggagctccccgtcgatgaggaccttccaggcctgggacagttctactgcctccactgcgatcgctactttgcaagtgaaagcgtgaaggatgatcactaccgctcaaagcgccacaagaaaagggttaaggtaatgtctggaccggccccgcacacgcagcttgatgcagaactcgctgcagggatgggaaagcctgacaacggcctgaagctcatgtccatgtgaaggaacctcttgctggtactggtacttgttccgtgcctttgttgctgccgtacaattgaagctgctttgcgcagtaagtaatagcaagagttatagcan

SEQ ID NO: 45117 - protein, 124 aa, Zea mays
  misc_feature: Ceres CLONE 1448436-F
MGGKCPHRKVKKRRLSHKTARRGKFLLKADDAVYDELVKLADQGKDAETKELPVDEDLPGLGQFYCLHCDRYFASESVKDDHYRSKRHKKRVKVMSGPAPHTQLDAELAAGMGKPDNGLKLMSM

SEQ ID NO: 45118 - DNA, 640 bp, Zea mays
  misc_feature: Ceres CLONE 1448440-F
  misc_feature: Encodes the peptide sequence at SEQ ID NO. 45119
ctggagctccccgcggtggcggccgctctagaactagtggatcccccgggctgcaggaattcgcacgagaccattacctagaacatcctaatcgaaaaattgctcctcgcgtgcgctccctctcctgtctccccctccccctccccctccccctctctctcgtggagacgactgggccgccgtcgttgctgccctacgcggctacgcccaggtcttcttcgggcccttagccgcgacgagcgccaccagggagtagaagaggttaaccttctggttggaaacgatgtacttcgaaggctatggcttccgtggaagtactttcgagcagacatatcgctgctatcctgcgtctttcatcgacaagccacaacttgaggccggtgacaaaattataatgccaccatcagctcttgatcgtcttgcatctctgcatattgaataccctatgctatttgaagtccacaatgcagcagcagaacggacttcgcattggggtggtctggagatcattggagaagaaggcatgatctacatggcatattgaatgatgaaaatcttctttttgaaaagggagaatggtgtttctaaaaatgccaacctccccaagggccattggggaagtgccgcctcaaaaaaaaac

SEQ ID NO: 45119 - protein, 86 aa, Zea mays
  misc_feature: Ceres CLONE 1448440-F
  misc_feature (7)..(86): Pfam Name: UFD1 Pfam Description: Ubiquitin fusion degradation protein UFD1
MYFEGYGFRGSTFEQTYRCYPASFIDKPQLEAGDKIIMPPSALDRLASLHIEYPMLFEVHNAAAERTSHWGGLEIIGEEGMIYMAY

SEQ ID NO: 45120 - DNA, 706 bp, Zea mays
  misc_feature: Ceres CLONE 1448443-F
  misc_feature: Encodes the peptide sequence at SEQ ID NO. 45121
taaagctggagctccccgcggtggcggccgctctagaactagtggatcccccgggctgcaggaattcgcacgagaccattacctagaacatcctaatcgaaaaaccgttatctggccacgtgatatttttgccgctcgatgccgcgtctccagctccaagcgcgtccggccacccacacctctgcccctccatgcatcttcctagtcctagccgcagctcctcatcttcctgcgcgcgctccttctctgtctcccatggccgagcgtcctccctgctcctctctcctttatctccctctccatgccggcgcttccctagctcgttttcccatctccctgctccttcccatggtgcgcagggcgtcctcccctcgactccctccctagctccccaccgctcgccttcctctccttcctactcgcccgtctccagctcggtctgcactcgccgtccctgcccctcgctgtttttgtgccagccgagctcgcctagcccctcgcctctccacctcatcaacgccctcagccatggatgtcgaatcccctctctttagtgcctttctttgcagcccctgcgtcgccgtgcatgtaaggtgtttgtctaaatgctcaagaggagtgtcgtgtcgtggacagcccttttggcgtcgtcgggtgtttgatgttttgcgcatcccgtctacgacaccgtcgaccctcagtgata

SEQ ID NO: 45121 - protein, 59 aa, Zea mays
  misc_feature: Ceres CLONE 1448443-F
MDVESPLFSAFLCSPCVAVHVRCLSKCSRGVSCRGQPFWRRRVFDVLRIPSTTPSTLSD

SEQ ID NO: 45122 - DNA, 753 bp, Zea mays
  misc_feature: Ceres CLONE 1448444-F
  misc_feature: Encodes the peptide sequence at SEQ ID NO. 45123
  misc_feature (1)..(1): n is a, c, t, g, unknown, or other
  misc_feature (290)..(290): n is a, c, t, g, unknown, or other
  misc_feature (292)..(292): n is a, c, t, g, unknown, or other
  misc_feature (293)..(293): n is a, c, t, g, unknown, or other
  misc_feature (300)..(300): n is a, c, t, g, unknown, or other
natagctggagctccccgcggtggcggccgctctagaactagtggatcccccgggctgcaggaattcgcacgagaccattacctagaacatcctaatcgaaaagattcgatccgagcttacttctagggttcttggccccgctccaccgtcgcccatggcagacgatgccaaccgagcggccttcatggagctgcagtcccggatgatagataccaccgcgaagatcaagcagttacaaacccaaatgcgttctaaagaaggggaaaagaagcgtgcctaccttactttngnnagaactncgcagttgccagatgataccaaacacctacagactgtcggaaaagtgtttattctggagccaattcaattctgttcatggagcgggggcgaaccctaatgcccgtgaaatgcgccatagcttcagtggaaactcccaaaacttcccttggagaacccggggggcaagggaaaaaaatatttggggggtgtttttaaaaggacacagaaattgcgcccaaaaatccctcctagaggccgttaaaaggggggtttttcccccccccttaattttttataaaaaattgagaggcgccccttttgaacacaagcccgggggggccccccccttttagaaaaaaagaggggggcgtttttttttaagaagggtggggggggggaaaaaaaaaaaaaaaaaattttctctcctccccccccgcgcggggggggggggcggccccccctcccccccttgg

SEQ ID NO: 45123 - protein, 80 aa, Zea mays
  misc_feature: Ceres CLONE 1448444-F
  misc_feature (45)..(45): Xaa is any aa, unknown, or other
  misc_feature (46)..(46): Xaa is any aa, unknown, or other
  misc_feature (49)..(49): Xaa is any aa, unknown, or other
MADDANRAAFMELQSRMIDTTAKIKQLQTQMRSKEGEKKRAYLTXXRTXQLPDDTKHLQTVGKVFILEPIQFCSWSGGEP

SEQ ID NO: 45124 - DNA, 775 bp, Zea mays
  misc_feature: Ceres CLONE 1448451-F
  misc_feature: Encodes the peptide sequence at SEQ ID NO. 45125
cagagctggagctccccgcggtggcggccgctctagaactagtggatcccccgggctgcaggaattcgcacgagaccattacctagaacatcctaatcgaaaaagaataggaatccgacgtcgcccccgcccccccctgtgaaaattcgtgatgcggagaacagctaccgccgccctcgtcctcgtccccctcctcgctgcggcggtacagacctccggcctgcctttcatcgtcctgcacgggattggggaccagtgcgtcaaccatggcgttgcccaattcactaaactttctccccgattggttcgggtcccaacggcttctttttaaaatttgggccaaagaacctggggacttttggggttgttgttttttaacaacggggtggaattaatttggaacagggttaaggggtgcccccccggggtggggggggcgccccgggtttgtgttgggttttttccccggggaacttttttttggtccacactattggttgaaacatcccggaattagagggccccgccttataacaaaatttcctctttttgtgggggggggtcttggggggggggcgctcttctagccccctttttgggggctccggcaattttcttcgattttttggcggccgccggcgccccccaaatggggttttttttttgtaatttggggggggaaaacacttttttcgccagatgtgtcctcctccattagctccccccggcgggggggcgatatttctcaataaagtgggtaggttttctccccaca

SEQ ID NO: 45125 - protein, 59 aa, Zea mays
  misc_feature: Ceres CLONE 1448451-F
MRRTATAALVLVPLLAAAVQTSGLPFIVLHGIGDQCVNHGVAQFTKLSPRLVRVPTASF

SEQ ID NO: 45126 - DNA, 669 bp, Zea mays
  misc_feature: Ceres CLONE 1448458-F
  misc_feature: Translation starting site: 184
  misc_feature: SWISSPROT Homolog: EC 2.4.1.13 Sucrose synthase
tggagctccccgcggtggcggccgctctagaactagtggatcccccgggctgcaggaattcgcacgagaccattacctagaacatcctaatcgaaaactaagtatccagattcagacatattttggaagaatttcgatgagaagtaccatttctcctgtcagttcacggctgatataattgctatgaacaatgctgattttatcatcaccagcacataccaagaaatcgctggaaggtttttattctgcttccgtcttgttggccactgtagatttcttttgtgacttagcattcaccaattaatttgcatgcacactgaatcatgtttacctcactcatgcatatactgttctgatgttaagttactgtattaattgtagttatggtaacatgcaatccatgctttttcatgcattaatcttgcatggactgtgatcacatatgtataatagctattcttaatttcctacaagacgctcatatactaattttttcctctctctcagcaaaaatactgttggacagtatgagagtcatactgcctttactctgcctggtctgtaccgagttgtccatgggatcgatgtcttcgatccaaagttcaatatagtctctcctggagctgacatgtccatatactttccacataccgagaaggccaagcgact

SEQ ID NO: 45127 - DNA, 656 bp, Zea mays
  misc_feature: Ceres CLONE 1448466-F
  misc_feature: Encodes the peptide sequence at SEQ ID NO. 45128
  misc_feature (404)..(404): n is a, c, t, g, unknown, or other
ccgcggtggcggccgctctagaactagtggatcccccgggctgcaggaattcgcacgagaccattacctagaacatcctaatcgaaaaccccgcatcccatgcccaccaccactcgaccaaggcacccagccctccttccctcagcgcttgccggccgacgcactgcttggtgcctgtctgcctttctccttccattgacagccgtcgatggcgacgccgcctcagcagaagcagcagccgcagcaggtgtcggtgcagcacgtgggcagggcgtcctcggacgagctcctccgcaagttcgcggacccggacgcgccccgcgccgccgccaccccgccgcgccgcagcctcaagcgctcgtcccgccgcgtggcgtcggggctctccgcgcgggactcccacncgtcggcggccgcgggcgtcacggccgcggcgctggcggcgcccaagcggcggcggagcatcggcgggtccaccggcctgctcctgccgaccgcgtccgcgaggaaggcccgggcacgccgcgcgcgcgccgacgacgccgcgggcatcggcctcctcctggtcgcgctggagcggacgtggaggaagacggtggcgggggcgtccaagatgttcgtggagaagcaccggaccaccacgtcctgctcatcag

SEQ ID NO: 45128 - protein, 149 aa, Zea mays
  misc_feature: Ceres CLONE 1448466-F
  misc_feature (66)..(66): Xaa is any aa, unknown, or other
MATPPQQKQQPQQVSVQHVGRASSDELLRKFADPDAPRAAATPPRRSLKRSSRRVASGLSARDSHXSAAAGVTAAALAAPKRRRSIGGSTGLLLPTASARKARARRARADDAAGIGLLLVALERTWRKTVAGASKMFVEKHRTTTSCSS

SEQ ID NO: 45129 - DNA, 1052 bp, Zea mays
  misc_feature: Ceres CLONE 1448466-R
  misc_feature (886)..(886): n is a, c, t, g, unknown, or other
  misc_feature (1052)..(1052): n is a, c, t, g, unknown, or other
aattggggaccgggccccccctcgaggtcgacggtatcgataagcttttttttttttttttgtgtctaatatttttcttatttataacttttccacaaaccaatacattaaggtaacctttaaatgggcctaacatattgggctggcctctaagagtaaatgagatttctgatggaagcaaacagagttgtactcttggtcggatcaccgagctcagcaccgtgaacaatgccgtcagtaaaacgctccaccacatcaactcccttctccttcataagcttcgccacatctctctgcctatctatcataggatctcctccgcctccactcaccaccaccttccatcccaaccgtccgatcatctccatattcgccggtccatctactaccgtctgattataatacccctgatcccagttagctccgacatgggagacaaatcattccttcaaaacgttcttctgcagtgaggcggaaaaaaccctgatcgagcctcaagatttggattttttgacttccgtcccgctttttttttttttcccaatattccgtatgggtcgctaattacccagttccaccggtgaaaccattaccggggaaccctcagtattcccccctaaggggctggaaatcttctagcactctgaaccgtttgattcatgtgtcaaaggatttttctgtagttatgtccggctttagattctctcccatgggagggaaaatcaaccttttaggggagaataaatcatgtctctttgcgatatattgtgtataccacctaacacttaccactgaggaagggtgttcgtacgattaaacactctcacgaagtcggtcagacgccgcatagccgttatgatatatcatccacttattgggataatanctatggacttctcccgcaatcactgtatacttgtttagtgaataggcaactaattattactacacccctttatttattttttccagcctacgcttaatccggatttgagcaaataatgtccggggaaaaagactatataaccgccctctgctttctcgatatattn

SEQ ID NO: 45130 - DNA, 689 bp, Zea mays
  misc_feature: Ceres CLONE 1448475-F
  misc_feature: Encodes the peptide sequence at SEQ ID NO. 45131
  misc_feature (361)..(361): n is a, c, t, g, unknown, or other
  misc_feature (423)..(423): n is a, c, t, g, unknown, or other
  misc_feature (689)..(689): n is a, c, t, g, unknown, or other
ctccccgcggtggcggccgctctagaactagtggatcccccgggctgcaggaattcgcacgagaccattacctagaacatcctaatcgaaaaactccttcgtcatccatgcgtcccctccccgccgcggccatggccaccgcgacgctgcccctccgcctcctcccctccaaaacgctgactctctccactctcccctccctgcgccgctacctctccgtcgccgctttggagccccggcgctggcgcctccaaaccgccgccgaggaggcgcctgaggccatggaggttgagttcgtgcagccccagacggaggctgaggaaaaacccgcggcaccggagcccattgaggctcagttggngggcacgaagcccgggaaagacgcgtatattttacctgttgcccaccaccccaccacacacnacatagcggatgccggggccctatctatacccaccacagactgacagggggcaaaggcaatggatggatcatgttaaacaaggggctactggtcgtcaaccagaagaaaaatcttacatggggattgccggtggtggaccaaggttgctgttccacccagtgtttcaaaaaacctgggcccggactgaaaaaagtctatgccggtctcagtccccagaccaacaaaaatcccccaaagggaaaactgggtccccacccacccaacn

SEQ ID NO: 45131 - protein, 111 aa, Zea mays
  misc_feature: Ceres CLONE 1448475-F
  misc_feature (77)..(77): Xaa is any aa, unknown, or other
  misc_feature (98)..(98): Xaa is any aa, unknown, or other
MATATLPLRLLPSKTLTLSTLPSLRRYLSVAALEPRRWRLQTAAEEAPEAMEVEFVQPQTEAEEKPAAPEPIEAQLXGTKPGKDAYILPVAHHPTTHXIADAGALSIPTTD

SEQ ID NO: 45132 - DNA, 582 bp, Zea mays
  misc_feature: Ceres CLONE 1448480-F
  misc_feature (119)..(119): n is a, c, t, g, unknown, or other
  misc_feature (126)..(126): n is a, c, t, g, unknown, or other
  misc_feature (127)..(127): n is a, c, t, g, unknown, or other
  misc_feature (241)..(241): n is a, c, t, g, unknown, or other
  misc_feature (252)..(252): n is a, c, t, g, unknown, or other
  misc_feature (253)..(253): n is a, c, t, g, unknown, or other
  misc_feature (312)..(312): n is a, c, t, g, unknown, or other
  misc_feature (330)..(330): n is a, c, t, g, unknown, or other
  misc_feature (359)..(359): n is a, c, t, g, unknown, or other
agctccccgcggtggcggccgctctagaactagtggatcccccgggctgcaggaattcgcacgagaccattacctagaacatcctaatcgaaaagaatccagaattcctgtcactgctncgaaatnncgatccgatctccgcctcgcgctgaagcctgatctccaccgggttcgcagcaggggcgcaggacctcgatcacgaggaggcaggggagcagcatccacaacccacagccatggncgggagggccnnacatcccactaaacactcccgcctcatcgcaatcatcgccgaacgaggacaccgtcacntggcttcttgatggcccngcgttggcaattgtttgatctgccccaangaaaaaccaacttaactttctcggtcaaaaaaaaaaggacggaacggttttaacaaaatcgaaggatgccttccaaaaaattttcccaccaaggggagggaatttgctctttgggcccccacccccccgaaatttgccccaacctgaaaaaaggtttctcgggggaaaaccccacaaaaaaaaccccccccccggtattttttggggaaaaccccccccccag

SEQ ID NO: 45133 - DNA, 661 bp, Zea mays
  misc_feature: Ceres CLONE 1448498-F
  misc_feature: Encodes the peptide sequence at SEQ ID NO. 45134
  misc_feature (623)..(623): n is a, c, t, g, unknown, or other
ccccgcggtggcggccgctctagaactagtggatcccccgggctgcaggaattcgcacgagaccattacctagaacatcctaatcgaaaacactcgcatcagagcggcgccggcctacaaccgttttcgtgctcacacacccaaaccttagtcgcgatcaggccccaaggactcgagatgaagtcgagggcacggtccaccgccggcgactccaggctctcgatgaggaagaccaaggcagagaaggacccaaacaagcccaagaggcctccgagcgcgttcttcgtcttcatggaggagttcaggaaggactacaaggagaagcaccccaatgtgaagcaagtctccgtgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgagggtgacgagtgatgtatgacggatgaaactctgtccaagtgtttgcagtcagggaaaaaaatcttcgtcgttgtcggcctaaccgggctttctcgaangactttctagatgcagtagattagtgccgtcttctctg

SEQ ID NO: 45134 - protein, 119 aa, Zea mays; identical to SEQ ID NO: 43953
  misc_feature: Ceres CLONE 1448498-F
  misc_feature (28)..(97): Pfam Name: HMG_box Pfam Description: HMG (high mobility group) box

SEQ ID NO: 45135 - DNA, 680 bp, Zea mays
  misc_feature: Ceres CLONE 1448502-F
  misc_feature: Encodes the peptide sequence at SEQ ID NO. 45136
tggagctccccgcggtggcggccgctctagaactagtggatcccccgggctgcaggaattcgcacgagaccattacctagaacatcctaatcgaaaaaactaacctctgctagggtttactcgcattttggctcctcactgccgcgccgccaccccctacaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagtgaagaagtgaggagaaggttctacaagaactggtgcaagagcaagaagaaggctttcacaaagtatgctctcaaatatgaaaatgatgctggcaagaaggaaattcagctgcagcttgagaagatgaagaaatatgcttctgttatccgtgtcattgctcatacc

SEQ ID NO: 45136 - protein, 166 aa, Zea mays
  misc_feature: Ceres CLONE 1448502-F
  misc_feature (50)..(166): Pfam Name: Ribosomal_L3 Pfam Description: Ribosomal protein L3
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLNSVWAQHLSEEVRRRFYKNWCKSKKKAFTKYALKYENDAGKKEIQLQLEKMKKYASVIRVIAHT

SEQ ID NO: 45137 - DNA, 722 bp, Zea mays
  misc_feature: Ceres CLONE 1448514-F
  misc_feature: Encodes the peptide sequence at SEQ ID NO. 45138
caaagctggagctccccgcggtggcggccgctctagaactagtggatcccccgggctgcaggaattcgcacgagaccattacctagaacatcctaatcgaaaagattaccgttgcgacaatgccaccccttccctgcctactctactcccggtaccggaggccggagctatccaattcccttcccacccagaccgcgatccctaaccctacccaatgtcctcgccgccgccggcttcgcccatggccgccgagaatgaggcctgcgactgggcggagatgccgtcggacgcgctcgcggccgtgttcgcgaagctggacgtggccgagatcctgtccggcgccgggctggtctgccgcgcgtggcaccgtctcgcggcctcggaccctacgctgtggcgccgcgtcgacatgtgctaccagggggaccagctgcagaccgaggaggtcgaggccatggcgcgcgccgcggtcgaccgctctgcgggcaccatggaggcgttctgtgccgagaccttcgtcaacgacgacctgctccgctacatctctcagagggccccctcattgaagagcctccatctctgcctgtgccattacgtcactaatcaaggttttgcagaggcagttaattgcttccctcagctcaaggagctagacattacattctgctcattgtatggcatcgtgtgtgagactgctgggagagcctgcccgcagcttaaat

SEQ ID NO: 45138 - protein, 169 aa, Zea mays
  misc_feature: Ceres CLONE 1448514-F
MSSPPPASPMAAENEACDWAEMPSDALAAVFAKLDVAEILSGAGLVCRAWHRLAASDPTLWRRVDMCYQGDQLQTEEVEAMARAAVDRSAGTMEAFCAETFVNDDLLRYISQRAPSLKSLHLCLCHYVTNQGFAEAVNCFPQLKELDITFCSLYGIVCETAGRACPQLK

SEQ ID NO: 45139 - DNA, 658 bp, Zea mays
  misc_feature: Ceres CLONE 1448517-F
  misc_feature: Encodes the peptide sequence at SEQ ID NO. 45140
  misc_feature (382)..(382): n is a, c, t, g, unknown, or other
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaactcctcctgtcctccacccaagccaaagcccctcggatcggatccggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttcatcctcctcctcctcctcctccaccacgacgccgcggnccgtgctggcggcggcgccggcgctggacatcccgcggcgggagctggaggccgtgctgcggcgcctgggccacgcggagccgtccgacgccgagctcgacgccgtggccgctctcgccgcgcagcccccgccgggcgacgccgacgcggacgccgacgccgacctcatggaggcgttccgcgtgttccacgcggacggcgacggccgcatcacccgcgaggagctccgccgcctcctgggacgccgttcctcggcggccgggggcagccctcgan

SEQ ID NO: 45140 - protein, 153 aa, Zea mays
  misc_feature: Ceres CLONE 1448517-F
  misc_feature (116)..(144): Pfam Name: efhand Pfam Description: EF hand
  misc_feature (62)..(62): Xaa is any aa, unknown, or other
MKLSIQSLARKLSLPSPKRGGGGIVEDGKKKKKRSLSRGEAPSFASSSSSSSSSSSTTTPRXVLAAAPALDIPRRELEAVLRRLGHAEPSDAELDAVAALAAQPPPGDADADADADLMEAFRVFHADGDGRITREELRRLLGRRSSAAGGSPR

SEQ ID NO: 45141 - DNA, 735 bp, Zea mays
  misc_feature: Ceres CLONE 1448528-F
  misc_feature: Encodes the peptide sequence at SEQ ID NO. 45142
  misc_feature (345)..(345): n is a, c, t, g, unknown, or other
ggagctccccgcggtggcggccgctctagaactagtggatcccccgggctgcaggaattcgcacgagaccattacctagaacatcctaatcgaaaaatacgatctgacgctcatcccacatcagtagtcgaccaagcacaagcagcagagccggccggaatatgtggacgatcaggaaggtggcgacgccgcaggtggccgtcctcctgctgctcctcatcgtcgttgcgcaggaggcggcgccgttggcggaggcgcgcgtgtgccggcgccggaccgcgggcttcaagggggtctgcatgtccgaccacaactgcgcgcaggtgtgcttgcaggagggctacngcggcggcaactgcgacggcatcatgcgccagtgcaagtgcatcagggagtgctaactagcttagccccagggatctgcaagctagcttttttggcctttaaataaatttataagggatcgacctcctggcccggtccgccaaaaatgtcaccacataaacaggccaccccacttggaaaaaatggccccccttgttacccctaaccccccccccaaattttggggaaccccccactttaaaatgcccgggcccccctttcctataaaaccccccctccttggtgtttcaaaaaccccaaaaaatgtgggttaaaagaaccccccccccttgttttccgcccccccccccctttttttttggggggggcaaaaaatcctttgagaaaaaa

SEQ ID NO: 45142 - protein, 79 aa, Zea mays
  misc_feature: Ceres CLONE 1448528-F
  misc_feature (33)..(79): Pfam Name: Gamma-thionin Pfam Description: Gamma-thionin family
  misc_feature (62)..(62): Xaa is any aa, unknown, or other
MWTIRKVATPQVAVLLLLLIVVAQEAAPLAEARVCRRRTAGFKGVCMSDHNCAQVCLQEGYXGGNCDGIMRQCKCIREC

SEQ ID NO: 45143 - DNA, 698 bp, Zea mays
  misc_feature: Ceres CLONE 1448534-F
  misc_feature: Encodes the peptide sequence at SEQ ID NO. 45144
  misc_feature (449)..(449): n is a, c, t, g, unknown, or other
  misc_feature (455)..(455): n is a, c, t, g, unknown, or other
  misc_feature (456)..(456): n is a, c, t, g, unknown, or other
  misc_feature (481)..(481): n is a, c, t, g, unknown, or other
  misc_feature (482)..(482): n is a, c, t, g, unknown, or other
  misc_feature (492)..(492): n is a, c, t, g, unknown, or other
atagctggagctccccgcggtggcggccgctctagaactagtggatcccccgggctgcaggaattcgcacgagaccattacctagaacatcctaatcgaaaagagtttcctattttcctctcctcccccacagcagctcggcgaaaaccctagtaagcaaaccaccggagcagcggcgcttgcgcgagcggagccatggcggacgacgattacaacgaaattgacatggggtatgaggatgagcccccagaaccggagattgaggaaggagctgaagaagagcctgagaacaatgaagatgcccctgatgacgtcataggtggtgagggtgaagataaggaacaggaaaagaccaagcgtgaacgcaaaacaacaaaatacatgacgaagtacgaacgtgcgcgcatcctgggtacacgagccttgcagataagcatgaatgctccagntatggnntgaacttgagggagaaactgacccnntctgaaattngcatggaagagctgaaaacccccaaaaatacccttcccgatcagacgggaccttccctgagggaaaccttgaaaaccggggaattaaaaaaccccttttgggaagacccccggaacccccgggttgggggaaacccaaaaagacccctttgctctgaaaaaggtattgggggcaagggggtttccccttaattcaaaaaccccccc

SEQ ID NO: 45144 - protein, 86 aa, Zea mays
  misc_feature: Ceres CLONE 1448534-F
  misc_feature (85)..(85): Xaa is any aa, unknown, or other
MADDDYNEIDMGYEDEPPEPEIEEGAEEEPENNEDAPDDVIGGEGEDKEQEKTKRERKTTKYMTKYERARILGTRALQISMNAPXM

SEQ ID NO: 45145 - DNA, 696 bp, Zea mays
  misc_feature: Ceres CLONE 1448535-F
aaagctggagctccccgcggtggcggccgctctagaactagtggatcccccgggctgcaggaattcgcacgagaccattacctagaacatcctaatcgaaaaacgtctccctctcgtgctctctcctccatggcccagagatccaccttcccctgctcgcctccgctcacctgcgtgctccggggacatccgctttcggacttcggtttatctccaccggtgctccaaagaacgttgacgaatatgcagatctgctgaccaagaatgaattatcatcgcctctcaatgaagatgaatcacacccagtttagcccaaccatggcagattctacatattcaaagaatgacaacatttactccatcatgatatatatcaacggatcatgctccgtcacttttgatcctgagactgttctgtacatattaatcttatgtttagaccttcctaaaactgtgtctatgcatgacaatctagggctcatttgatcaaaagactgttatttgcaccttgcccacatcgaaaaggctccagtcacttttggtcgcgatacttttatgtacatattaacctgatgttgagccctttctagaactatgtgtgactgccacaagactatgacacttctggactatagacttctatgtatatctgactacactgttagagcctttttctactctgtttgcgtatgtagc

SEQ ID NO: 45146 - DNA, 709 bp, Zea mays
  misc_feature: Ceres CLONE 1448536-F
  misc_feature: Encodes the peptide sequence at SEQ ID NO. 45147
acgctctctcctagtggatgccccgggctgcaggaagttccacgagaggggtacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccttggggggagggtgagaatgctttcaacaccttcctccatggagactggtgctgggaaaaaactggcccaggtctgcccccccttgcccttggaacccaatggtattctattaaggtgaaggatcggggggcccaccccccaccccctttccaccccgtgaaatgttttttccttggcgaaaggggggtgtttgccccaaaaatatttggcgcggcggtgccccacccacatgtgcggaaaagatattgttgagacctttgggcccttctgtgcccattcggaaaagtttcgcggacacccgaccctggggttaacaaggggatctcccctctttccaccctcctttgtggtgagagaaaagagagggctacttgctttagtgtttcccctcca

SEQ ID NO: 45147 - protein, 45 aa, Zea mays
  misc_feature: Ceres CLONE 1448536-F
MRECISIHIGQAGIQVGNACWELYCLEHGIQADGQMPGDKTLGGG

SEQ ID NO: 45148 - DNA, 603 bp, Zea mays
  misc_feature: Ceres CLONE 1448541-F
  misc_feature (288)..(288): n is a, c, t, g, unknown, or other
  misc_feature (295)..(295): n is a, c, t, g, unknown, or other
  misc_feature (296)..(296): n is a, c, t, g, unknown, or other
aaagctggagctccccgcggtggcggccgctctagaactagtggatcccccgggctgcaggaattcgcacgagaccattacctagaacatcctaatcgaaaacttgctcttatcctatcctgcttttcttcgcttctctcttccccgctctctcattcttctcatacaagtctgttgttggagggacacacgtatccagcccaccaaagatttactcaatttatcccagacgagacacacactcgcaacgaccggaccgtcgaatctcgcgactccggcgacatgtcngacgggnncggtggcagaaggtgccgggcccgccccttaccggggttccccccggaaatccccggaaaaaggggaaacccggccccgcccgggttttttggggaaaagggagggggccccccttttggcccccccgcccccggggaaaaaaagaggaaaccccccccgcctttctttttattaaaaggggaagaaaagagggggggtttttaaaaaaaaaaaaaaaagtgtttttatatattaaaaaaaacaccccctccaaaatataaggggggggcggggctttcttctttccccccttcgcgaggaggaaaa

SEQ ID NO: 45149 - DNA, 644 bp, Zea mays
  misc_feature: Ceres CLONE 1448546-F
  misc_feature: Translation starting site: 168
  misc_feature (332)..(332): n is a, c, t, g, unknown, or other
ctccccgcggtggcggccgctctagaactagtggatcccccgggctgcaggaattcgcacgagaccattacctagaacatcataatcgaaaaattcccaagcaaacagccaaacacacgcgaaaagaaggagttcgagtacaggttacagagaggcagagagcaaagatgtgtggtggtgcgatcctcgccgagctcatcccgaccacgccggcgcgccgcggcggcgcggcgtggcccgccggcaagtgcaagcggcggaaggcgaacgacttcgaggccgcgttccgggagttcgacgaggactccgaggaggaggaggaggacgagggnggtggtggagagcaagcccgccttcgtcgtccgcgcctcgtccgcggcgacgcagcccagggcgcgccaggagcagcggagccggcgccgggcgcccgaccagcagcagtacaggggcgtccggcgccgcccgtggggcaagtgggccgccgagatccgcgaccccgtcaagggcgtccgcgtctggctcggcaccttcccctccgccgaggccgccgcgcgcgcctacgaccacgccgcgcgcggcatccgcgggcccagggccaagctcaacttcccctcctcctcctcctccgccggcggggcccccgc

SEQ ID NO: 45150 - DNA, 688 bp, Zea mays
  misc_feature: Ceres CLONE 1448567-F
  misc_feature: Encodes the peptide sequence at SEQ ID NO. 45151
  misc_feature (485)..(485): n is a, c, t, g, unknown, or other
agctccccgcggtggcggccgctctagaactagtggatcccccgggctgcaggaattcgcacgagaccattacctagaacatcctaatcgaaaaacgacacgtcattgccgtggcccagcgctagtttccagaagcagccgcgagcttccaccgccttcttcccgtgcattttctcgagcgacggagcgatccgttcgggccgtccaccacagcgagagagagcggcagaggcgcagagcacaaccgagcgagagagagaggacggcgacggcggagatgatggggtggggagaggaggtggtggctctgtccctgcgaggctacggctatggcaacgaggaggacgaccggccggagaagccgcggcggtacggggtgacggagatgcggagccccttctactccttccccccccgcaaccaggcgctccaggaaatattggattctcttagtccattccgtgatggtttgaaagtctctgggnggatgccatagtttgatgggaaaaggatttggttagagaaatcactgatctagcccacaggcatgactttttatgtgaacacagggatttggccagaacattttctgcgccaaggaacctctttcctttcaagaatttttaagggaatgcaaggccttagggtttaacccatttgaccctaatgcggggcctcctcacccccc

SEQ ID NO: 45151 - protein, 72 aa, Zea mays
  misc_feature: Ceres CLONE 1448567-F
  misc_feature (70)..(70): Xaa is any aa, unknown, or other
MMGWGEEVVALSLRGYGYGNEEDDRPEKPRRYGVTEMRSPFYSFPPRNQALQEILDSLSPFRDGLKVSGXMP

SEQ ID NO: 45152 - DNA, 654 bp, Zea mays
  misc_feature: Ceres CLONE 1448589-F
  misc_feature: Encodes the peptide sequence at SEQ ID NO. 45153
  misc_feature (644)..(644): n is a, c, t, g, unknown, or other
ctccccgcggtggcggccgctctagaactagtggatcccccgggctgcaggaattcgcacgagaccattacctagaacatcctaatcgaaaagcagtgtgctccatctccatttttctcctcctctcgtttttgcgtttaggcccctggggaagcagggattctggcgacggtccctccccccggctctcccgcctcgcggctccgatcgaggccgcagcgtcagtgcagttgcattaatgggaaaccaatgccaaaatggaacctacgggtacgggagcaattacaacagctacaaccactttcagaaggagcctctggcttctaggcactgtgatggggacgatactgagggttgctacacagggccatctagaccgagcatagcagaccttatgcgacaaggactgaggcagactttaacgtccatctctgttcttggtcgagagactcctaatgtcacagagcattatacccttggccggcagcttggagagggtctcactgggaccacctacctctgcaccgagaccagcactgggtgtcagttcgcatgcaagtccatcctgaagacaaggttccggaacatgcaagatgttgaagacgtgcgccgtgaggtccagataatgcgctacctttcagggncaaaggatgt

SEQ ID NO: 45153 - protein, 138 aa, Zea mays
  misc_feature: Ceres CLONE 1448589-F
  misc_feature: SWISSPROT Homolog: EC 2.7.11.1 Non-specific serine/threonine protein kinase
  misc_feature (136)..(136): Xaa is any aa, unknown, or other
MGNQCQNGTYGYGSNYNSYNHFQKEPLASRHCDGDDTEGCYTGPSRPSIADLMRQGLRQTLTSISVLGRETPNVTEHYTLGRQLGEGLTGTTYLCTETSTGCQFACKSILKTRFRNMQDVEDVRREVQIMRYLSGXKD

SEQ ID NO: 45154 - DNA, 677 bp, Zea mays
  misc_feature: Ceres CLONE 1448590-F
  misc_feature: Encodes the peptide sequence at SEQ ID NO. 45155
ggagctccccgcggtggcggccgctctagaactagtggatcccccgggctgcaggaattcgcacgagaccattacctagaacatcctaatcgaaaagcgaaactgcttcctagcttcgttcgttccggagcgccagagagagaaagaaaaggaaaagaagcgcctttgcccaccgcgcgatcaatcaatccggggtccggcggcctgccatggtgaagctggcgacggccagggaggcgcggctgtacgggccggcgctggcggcaaggcggtgggagtacatcaacgcgggaacatacgtgttcgcggcgctgctcctggtcctggcggcggcgctgtccatgtccgtgtccgcgaccaggccggggctcgccgtaggcgccgtggcgctggcggccgtggcggccgtcaacccccacgacctcgccgcgcacctggctggcgtcgactgccgcgtgggactggcgaggtacgatgcccagctcgggctcgtggagttcctcgtgccggccgtgcacgcagccgggtgcgcgctcgccgccgccggcctggcgctgctggcctccccccactcccagtcccagcagcggcacgcggcgaccatgctgctcgtcgcggcgctgctgtgggtgctgggctccgtgctcaactcctgccaggtgtacgagcgcgccgaa

SEQ ID NO: 45155 - protein, 156 aa, Zea mays
  misc_feature: Ceres CLONE 1448590-F
MVKLATAREARLYGPALAARRWEYINAGTYVFAALLLVLAAALSMSVSATRPGLAVGAVALAAVAAVNPHDLAAHLAGVDCRVGLARYDAQLGLVEFLVPAVHAAGCALAAAGLALLASPHSQSQQRHAATMLLVAALLWVLGSVLNSCQVYERAE

SEQ ID NO: 45156 - DNA, 675 bp, Zea mays
  misc_feature: Ceres CLONE 1448591-F
  misc_feature: Encodes the peptide sequence at SEQ ID NO. 45157
aagctggagctccccgcggtggcggccgctctagaactagtggatcccccgggctgcaggaattcgcacgagaccattacctagaacatcctaatcgaaaaatccgtgctttgtgcctgtttggtgcgcgtccacctttcggggtcaccggcttctgctttcttgctacgccaccgcgcctctcgtctatttatggagtcccccgatccatgaagccggtgcaggccgagagttgtcaacgacgacgtctgccggcagtgctcctgctcctcctcctccttcccggccgccgcgcgagcttgggttagtgtctcttcttcgcggaggcctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcgtactgggagggcgaagccacggccccggacgctgcggcggctccagaagccgaagcagctcccagcaccgcggcagaagcgcctcctgctgctccggcggcgccagagatcaccccagccaaagct

SEQ ID NO: 45157 - protein, 109 aa, Zea mays
  misc_feature: Ceres CLONE 1448591-F
  misc_feature (7)..(68): Pfam Name: HMA Pfam Description: Heavy-metal-associated domain
  misc_feature: SWISSPROT Homolog: EC 3.6.3.4 Copper-exporting ATPase
MAAVETVVLKVAMSCEGCAGAVRRVLSKMEGVETFDIDLKEQKVTVKGNVKPEDVFQTVSKSGKRTSYWEGEATAPDAAAAPEAEAAPSTAAEAPPAAPAAPEITPAKA

SEQ ID NO: 45158 - DNA, 668 bp, Zea mays
  misc_feature: Ceres CLONE 1448592-F
  misc_feature: Encodes the peptide sequence at SEQ ID NO. 45159
  misc_feature (457)..(457): n is a, c, t, g, unknown, or other
  misc_feature (480)..(480): n is a, c, t, g, unknown, or other
  misc_feature (511)..(511): n is a, c, t, g, unknown, or other
  misc_feature (526)..(526): n is a, c, t, g, unknown, or other
  misc_feature (529)..(529): n is a, c, t, g, unknown, or other
ctccccgcggtggcggccgctctagaactagtggatcccccgggctgcaggaattcgcacgagaccattacctagaacatcctaatcgaaaaaggcgtccacagacgcacggttctgccatcgcgcgattcccctcctccatccctattcctccgcccgcgattcccctccccgcgccctcgcctcgccgccgtcctcacggccagccgaggatagccgtcgcgcccgcaaatcacgcgaccatgccctttcatgcccgcaaatcacgtcgcctccttccatccatggcagtcgcgctccctctacgcccttccatccatggccgcggatccctgcgcgccacgattcttcccatacgctccctctgcgcccttccatccatggccgcgaatccttgatgttgagatccgggagctgaagcgggagatctcgcgggtgcggctaacagagctggagncggagcaggggctgatgaaacancaggggaagatgcgcggcggggacggcggcngcgggtggggcggcngcnaacacggccgtgccttcctcgcttcgctgtcgaggggcatcgacagcatcaccatgttcgggcgggcctgcagcggctgacagacggcgcaagaagagcggtggcgcgggctcccagtgctccgacggcaagacccgga

SEQ ID NO: 45159 - protein, 118 aa, Zea mays
  misc_feature: Ceres CLONE 1448592-F
  misc_feature (69)..(69): Xaa is any aa, unknown, or other
  misc_feature (76)..(76): Xaa is any aa, unknown, or other
  misc_feature (87)..(87): Xaa is any aa, unknown, or other
  misc_feature (92)..(92): Xaa is any aa, unknown, or other
  misc_feature (93)..(93): Xaa is any aa, unknown, or other
MPANHVASFHPWQSRSLYALPSMAADPCAPRFFPYAPSAPFHPWPRILDVEIRELKREISRVRLTELEXEQGLMKXQGKMRGGDGGXGWGGXXHGRAFLASLSRGIDSITMFGRACSG

SEQ ID NO: 45160 - DNA, 641 bp, Zea mays
  misc_feature: Ceres CLONE 1448598-F
  misc_feature: Encodes the peptide sequence at SEQ ID NO. 45161
  misc_feature (641)..(641): n is a, c, t, g, unknown, or other
acccgcggtggcggccgctctagaactagtggatcccccgggctgcaggaattcgcacgagaccattacctagaacatcctaatcgaaaaaccgctgccccagtccatcccctcctcgtccagcatccgctccctctgcagtcccccctccctcccacacgaccatggcgtcctggttggtgcccttccggtcctgctgcgtgtggaggctcgccaccgcgctagcgcctttgccgcacaacctctcgaggacccacgcgagctcatcctccgtcatctcccccgctcctccgggcagcttcttcccacctccgccggccgcgccctcctggctcccgtggtgcctctttcgccacgccgctgggccatcgccggtggcgggggcctcggaggaagagcaggaacccatcatggccaacgagagggaagcgacacggtggggcacatggtggaagtggccgttggaacctgcctgcctgcctgtctggaaactgttccgaaaaacccccaaatttgaaggctttggggagtcattttgtacgtatggtctcttgtccttggaaggcccggctttaaaaatgggatttttggttttttaattaggggttcaaaccaagggccctttggtttaagggggggan

SEQ ID NO: 45161 - protein, 144 aa, Zea mays
  misc_feature: Ceres CLONE 1448598-F
MASWLVPFRSCCVWRLATALAPLPHNLSRTHASSSSVISPAPPGSFFPPPPAAPSWLPWCLFRHAAGPSPVAGASEEEQEPIMANEREATRWGTWWKWPLEPACLPVWKLFRKTPKFEGFGESFCTYGLLSLEGPALKMGFLVF

SEQ ID NO: 45162 - DNA, 712 bp, Zea mays
  misc_feature: Ceres CLONE 1448625-F
  misc_feature: Encodes the peptide sequence at SEQ ID NO. 45163
  misc_feature (428)..(428): n is a, c, t, g, unknown, or other
  misc_feature (430)..(430): n is a, c, t, g, unknown, or other
aaagctggagctccccgcggtggcggccgctctagaactagtggatcccccgggctgcaggaattcgcacgagaccattacctagaacatcctaatcgaaaatttcaaagtggaaatattcattatgttgttaatcagaacgctatgggagttagctctaagccaccaggtgttctaaagaccgagagcactgactcactgagttgtagttatggctatattggtggtagcaccagtgtggactctggcttgttctcttctcagtccaaaaatccacagtatgatctactgcagaatcaaaatgatgttaacggcagctggtcgccttcacaagattttgatagttttggaaattctcttgggcaaggccaccctggtaccacttcatctaacttccagaagtccgcccttgggaagttgcctgaccnangacgagggagaaatcatgggtttgtcgggaaaagcacttgcattcccagcgctttgcagggaatgaagttgattcccaactaacaacttggagcccagcattgaaacagggggaacctaaggaaccccgaactattttggatttagggaaaatatgggaaacttccttgaatttccgtgaaccgggggaccttggaaaaaaacctaggggttttaaaaaaagggtgcccaaaaaattcccgttcccccccctttttttccccgggaaatgggattaaaaaag

SEQ ID NO: 45163 - protein, 170 aa, Zea mays
  misc_feature: Ceres CLONE 1448625-F
  misc_feature (143)..(143): Xaa is any aa, unknown, or other
  misc_feature (144)..(144): Xaa is any aa, unknown, or other
KAGAPRGGGRSRTSGSPGLQEFARDHYLEHPNRKFQSGNIHYVVNQNAMGVSSKPPGVLKTESTDSLSCSYGYIGGSTSVDSGLFSSQSKNPQYDLLQNQNDVNGSWSPSQDFDSFGNSLGQGHPGTTSSNFQKSALGKLPDXXRGRNHGFVGKSTCIPSALQGMKLIPN

SEQ ID NO: 45164 - DNA, 649 bp, Zea mays
  misc_feature: Ceres CLONE 1448633-F
  misc_feature: Encodes the peptide sequence at SEQ ID NO. 45165
  misc_feature (496)..(496): n is a, c, t, g, unknown, or other
ctggagctccccgcggtggcggccgctctagaactagtggatcccccgggctgcaggaattcgcacgagaccattacctagaacatcctaatcgaaaaaccaccgcatgctagggaggcagggaggggagccgagccgaggacgatggcgctgggcgtgttgttccacggcgcacagctagcgctggatctggcggtggccgggatgtcgctggcggtggcgctcgggttcttcgccctcatcactaccttgctctgctccgcggcgttcctccaccactccaagcccgccgcgtagtcatagcctccacagcgaccaacgcgtctcaacctctggggatggttctgatgatttggtccaagcatcaatgcagaacactgttctgatgatcgctgatggttcttggcatcggcatgagcgggcgtgcggagaaaattttgaggaccataacatggctagtcttagtgtcgatattggctcctcctttgatgctaangttaggctcaggagtctagaagctgccaaaatgtgtacctatagtcctatagttgcattttcttaacttttcacaattacctactaggttggggatttttgcttcccccatgtggcactggttgtcctgggatgggccccctataaataatcc

SEQ ID NO: 45165 - protein, 50 aa, Zea mays
  misc_feature: Ceres CLONE 1448633-F
MALGVLFHGAQLALDLAVAGMSLAVALGFFALITTLLCSAAFLHHSKPAA

SEQ ID NO: 45166 - DNA, 685 bp, Zea mays
  misc_feature: Ceres CLONE 1448638-F
  misc_feature: Encodes the peptide sequence at SEQ ID NO. 45167
  misc_feature (362)..(362): n is a, c, t, g, unknown, or other
  misc_feature (417)..(417): n is a, c, t, g, unknown, or other
  misc_feature (421)..(421): n is a, c, t, g, unknown, or other
ctggagctccccgcggtggcggccgctctagaactagtggatcccccgggctgcaggaattcgcacgagaccattacctagaacatcctaatcgaaaagaatctgcgcagacgacgagggagcgcgatggaggcggcgctgcgcgggatcagggccaagctgacggagcaccgggagaaggtgatcagcggtctgctgctgggctcggcggtggcgctggggtggaagtcgtcggagcagcagcgcgagatccagagcctgttggccgagaagagctctctccgagccaccaacgcctctatgtccgccgccatgtgggcctggcgggaggagctcttcgccctcgccgccgcgccctcctnccccatttccgcgtcccggctcccgcacatctacggcgaagaggaagcccgggcngttngggccccgggccgggccgggcaggagcaaatgatgggaagggaaaagaacccgacctccatagcctgaacctctttcccccttttttcccattccaagggtgggccctcccttgtaaaaaatggccggctcccctaaaaggtaaaaaagatcctttttaaaaaaacccaaaaacccgggggccctaaatcccaaaatttttttcggggccccccccccaacaaaaaaaaaaaagggggtttttccccttcccccggggaaaaaa

SEQ ID NO: 45167 - protein, 120 aa, Zea mays
  misc_feature: Ceres CLONE 1448638-F
  misc_feature (79)..(79): Xaa is any aa, unknown, or other
  misc_feature (99)..(99): Xaa is any aa, unknown, or other
MEAALRGIRAKLTEHREKVISGLLLGSAVALGWKSSEQQREIQSLLAEKSSLRATNASMSAAMWAWREELFALAAAPSXPISASRLPHIYGEEEARAVXAPGRAGQEQMMGREKNPTSIA

SEQ ID NO: 45168 - DNA, 603 bp, Zea mays
  misc_feature: Ceres CLONE 1448643-F
  misc_feature: Encodes the peptide sequence at SEQ ID NO. 45169
ggagctcaccgcggtggcggccgctctataactagtggatcccccgggctgcaggaattcgcacgagaccattacctagaacatcctaatcgaaaaatatgacagttctaggagagacaacctagcccattgcgttgttcatagagaagtgataatgggaggacattcgctcccccagtaagtttttttttctgctccgtttgtcctccaactatttggccgcaaaagcttttttttttctgctccatttgtcctccaactatttcgccgcaaaggcctctagaagcaatcaggcgagcggcggctgcggcgcgatgggagagcaggtcgtgacggagcgtatccagcggaagctggaggaggccaacgctaccgtccaacagcacctcgccggcatccaggaccacgtcaacttcaccatgcagcaagcatacttcaagtgcgcatatgattgcttcgatcggcgccgtactcaggaagcgatcaacaattgtgtggagaattgtggtatgcctgtccttgctgtcaacaatgtttttgagagtgagatggccaagtttcaggaacggttgaaccggtcattgatggtctgtcaagataagt

SEQ ID NO: 45169 - protein, 96 aa, Zea mays
  misc_feature: Ceres CLONE 1448643-F
  misc_feature (10)..(96): Pfam Name: DUF842 Pfam Description: Eukaryotic protein of unknown function (DUF842)
MGEQVVTERIQRKLEEANATVQQHLAGIQDHVNFTMQQAYFKCAYDCFDRRRTQEAINNCVENCGMPVLAVNNVFESEMAKFQERLNRSLMVCQDK

SEQ ID NO: 45170 - DNA, 701 bp, Zea mays
  misc_feature: Ceres CLONE 1448647-F
  misc_feature: Encodes the peptide sequence at SEQ ID NO. 45171
  misc_feature (528)..(528): n is a, c, t, g, unknown, or other
  misc_feature (641)..(641): n is a, c, t, g, unknown, or other
  misc_feature (658)..(658): n is a, c, t, g, unknown, or other
  misc_feature (659)..(659): n is a, c, t, g, unknown, or other
  misc_feature (694)..(694): n is a, c, t, g, unknown, or other
  misc_feature (695)..(695): n is a, c, t, g, unknown, or other
aaagctggagctccccgcggtggcggccgctctagaactagtggatcccccgggctgcaggaattcgcacgagaccattacctagaacatcttaatcgaaaagtggactgttttggaaggcgttgcgatgagacgctgctgcggcggcggcgaggagtgcatccctcggcgatgagcagaatcacctcgggatcttaatctcccttgcctcgtttgcggagagcctgcgctgtcggcggcggcgcacccccctccccttcccccggtgcttccgtctgctggctggactcagttcttccaactcggcccttaacaagagaacgacgaccatgccgatgcgtggcgtcgatttcaagtggtatgatgggttcttcctctccatgctcgccactagcgtaattatcgtttccattaattggaagaggtatcgcctgtgtgcccacccgctccacatttggatagtggtggactacaccactgtcttcatcttccgcctccctatgtttgttgataatggtctcgctgcangaatgggattagatctcggatgggcacagagatatgctcgtttttgtggaagaataaatgcccctctcagtctgtgctacttctctacccctttctctgggtttggactgtgnatggaacattgtggttnnagcactgcagaagctgcttgccaaagaaagacaanngtgggc

SEQ ID NO: 45171 - protein, 124 aa, Zea mays
  misc_feature: Ceres CLONE 1448647-F
  misc_feature (67)..(67): Xaa is any aa, unknown, or other
  misc_feature (104)..(104): Xaa is any aa, unknown, or other
  misc_feature (110)..(110): Xaa is any aa, unknown, or other
  misc_feature (122)..(122): Xaa is any aa, unknown, or other
MPMRGVDFKWYDGFFLSMLATSVIIVSINWKRYRLCAHPLHIWIVVDYTTVFIFRLPMFVDNGLAAXMGLDLGWAQRYARFCGRINAPLSLCYFSTPFSGFGLXMEHCGXSTAEAACQRKTXVG

SEQ ID NO: 45172 - DNA, 836 bp, Zea mays
  misc_feature: Ceres CLONE 1448660-F
  misc_feature: Encodes the peptide sequence at SEQ ID NO. 45173
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (38)..(38): n is a, c, t, g, unknown, or other
aatcgcgccccctctcctacaaaacccnnntccncccncgccccccctcaaagctggagctccccgcggtggcggccgctctagaactagtggatcccccgggctgcaggaattcgcacgagaccattacctagaacatcctaatcgaaaaagcgtatcgacgcttagtcgcagtcgcagcacacactgaattctctttagctagctaagagagggtagccacaccaagacaggatgcagacagcgaaggtgaaggcgaaggacatggtgagctcggcgaaggagaaggtgaaggatgggtctgcaaagatgcagggcaagacgggcgaggcgacgtcggccacgcacggcgagaaggagatggccaaggaggcggcccgcgccaagaaggaccaggccaacgctgacaagcgcgaggagaaggccgactaccgagtggacgccaccactggaaaacgtcgcgacaaccccgccactcaccggaccgtacggggcaccacgtggtctggcgcgggccggtcgaccgccgcgggccttattttccggcagacgcgcaacccgtatgttttgtgcaattccattttcgggtgccctggcctcagaacgaattaaccatcaagggcccgttgggccccgcccttgccagactcttagttaaccctaagcaatcacgacggaatattcaacacctggggttgttagcgccttgcgagaaaccgcggataataaatcgggggaacgccttaccccatattggtcctgttcgtggggtggtcacgcgcgcgatggatgaaaataaattagtttagtccgggggatcaacactaaaccgcctc

SEQ ID NO: 45173 - protein, 125 aa, Zea mays
  misc_feature: Ceres CLONE 1448660-F
  misc_feature (1)..(73): Pfam Name: LEA_1 Pfam Description: Late embryogenesis abundant (LEA) group 1
MQTAKVKAKDMVSSAKEKVKDGSAKMQGKTGEATSATHGEKEMAKEAARAKKDQANADKREEKADYRVDATTGKRRDNPATHRTVRGTTWSGAGRSTAAGLIFRQTRNPYVLCNSIFGCPGLRTN

SEQ ID NO: 45174 - DNA, 643 bp, Zea mays
  misc_feature: Ceres CLONE 1448664-F
  misc_feature: Encodes the peptide sequence at SEQ ID NO. 45175
ctggagctccccgcggtggcggccgctctatacatagtggatcccccgggctgcaggaattcgcacgagaccattacctagaacatcctaatcgaaaaatcaagccagtacccagcaaatcagaaacagctaaaacgatctcagccttcacacacacgcacatccatcgttctaggcttcgagctagttggagatggccggaggggatgacctgaagctgctcggcgcatggccaagcccatttgtcaccagggtgaagctcacgctcgccttgaaggacctgcactacaaggacgcgcaggatgcactgtccctaatttttaacttcgcactatgccaaccagggtgagcaaaaagtttttttgcgccccccaccacaggggggaggagggaggtagattatgtatgacggggccctgggggggccatctattgcacaccaagacgccgtcgaaacatacataaacacacacaaacaacccgataatttccttctgggaagccctaatttttcatagttgaacctacgaccgagggagccggccccacacgaatacgaaattacgtaatgagtataaagcacctcacccagcccgcaattagcgacggaaccagtcatatgagccgttctcacactcaaccc

SEQ ID NO: 45175 - protein, 51 aa, Zea mays
  misc_feature: Ceres CLONE 1448664-F
  misc_feature: SWISSPROT Homolog: EC 2.5.1.18 Glutathione transferase
MAGGDDLKLLGAWPSPFVTRVKLTLALKDLHYKDAQDALSLIFNFALCQPG

SEQ ID NO: 45176 - DNA, 659 bp, Zea mays
  misc_feature: Ceres CLONE 1448667-F
  misc_feature: Encodes the peptide sequence at SEQ ID NO. 45177
  misc_feature (631)..(631): n is a, c, t, g, unknown, or other
ccgcggtggcggccgctctagaactagtggatcccccgggctgcaggaattcgcacgagaccattacctagaacatcctaatcgaaaaattccaaaactccgagcaatcagtccaaacccgtgtccaccgaaagtttgatgggatcaggcctctcaagcagcagcagccaccggagcagcggcgcgtcgtcgtcgcttcaccagccaccggcggcggccccggccctggtcgtcgcggtcgacggctcgctacgggagttcgtcacgccggcggcggtgccgctcctcccccccgtctccgtctccgacgtgctgggcgcgaatgcggacaacgggcggttccttcgtgtgcagctcccagccgctccacttcaagaccaacttccggggcttcgggccagcaacctgttcccgccggggcaggttttatttcttccttccccccgcgatgctcggaaggccgctcctcggccccaaaatggccgccctggcccgggcgcccaaccaaggcccttgggcccggaaaccaaaggccccccccgggccgggcgaacccccctcgggggttccaccaagggcccgcctttattaccctggagagtgagcgggaaacccaagcggaaaggcgcancggagaaaacaaaagtgctttccaaaaa

SEQ ID NO: 45177 - protein, 41 aa, Zea mays
  misc_feature: Ceres CLONE 1448667-F
MAALARAPNQGPWARKPKAPPGPGEPPSGVPPRARLYYPGE

SEQ ID NO: 45178 - DNA, 705 bp, Zea mays
  misc_feature: Ceres CLONE 1448671-F
  misc_feature: Encodes the peptide sequence at SEQ ID NO. 45179
ggagctccccgcggtggcggccgctctagaactagtggatcccccgggctgcaggaattcgcacgagaccattacctagaacatcctaatcgaaaaagcttgcatttcaaacttcaaaccggaccaaacgccctgctccaacccaaaaccatcatcccttttttcgcagcagacgcatttattaagcgcgcctccgccaaccgcactctgcccgccgaaagcgtcgtcgggccacctcgcactcgcgcgcgcctcaaagatgcacaggcagctcagcctctccgccagcccgaagcagcagcagccgcctcctgacggcaccagcaccggcggcggcgacgcggcgaaggcgatggcggcggcggaggacgagtcgtcggcctcgcactccagctccaaggccagcagggggtggtcggcgagggacgagagggccatccacctcgtcccgctgctcaccttcctctgcttcctcctgctcttcctctgctcccacgacccgtcccccgccgatatgtcgagcttcgctggaggcggcggcggaggaggaggagcgagatctgggaaccggaggttaaggatgctttagtgtgcgtattacctacccattggagtattattatccgcgatgcggatgttgtacttgtccagcagtaaccaagtatgggaccaaagtatgtcaccatacaaaacactcttgctgtg

SEQ ID NO: 45179 - protein, 109 aa, Zea mays
  misc_feature: Ceres CLONE 1448671-F
MHRQLSLSASPKQQQPPPDGTSTGGGDAAKAMAAAEDESSASHSSSKASRGWSARDERAIHLVPLLTFLCFLLLFLCSHDPSPADMSSFAGGGGGGGGARSGNRRLRML

SEQ ID NO: 45180 - DNA, 682 bp, Zea mays
  misc_feature: Ceres CLONE 1448675-F
  misc_feature: Encodes the peptide sequence at SEQ ID NO. 45181
  misc_feature (290)..(290): n is a, c, t, g, unknown, or other
  misc_feature (314)..(314): n is a, c, t, g, unknown, or other
  misc_feature (352)..(352): n is a, c, t, g, unknown, or other
  misc_feature (353)..(353): n is a, c, t, g, unknown, or other
tccccgcggtggcggccgctctagaactagtggatcccccgggctgcaggaattcgcacgagaccattacctagaacatcctaatcgaaaacatccactcccaagtcccaacacccgtcggcgtcgagcagcggcagcggcggcggcgatgacgacgagcctgaagaagaaccggaagaagcgcgggcacgtgtcggcggggcacggccgcatcggcaagcaccggaagcacccggggaggccgcgggcacgccgggcggcatgcaccacccaccgcatcctcttcgacnagtaccacccgggctacttcggcnaggtggggcatgcgctacttcccacaggctcccgcacnnagtccacctgcccgtcgggtcacctggaagcggctcctggtcaaatgtgccccgccggcaaaggccccggaagcggccgggcccgaaccaggcccggctcgttcaattaacccaatttcggcaccttcaaggggcctccgaaaggggaagcttgctttccggccccttcgttttaagggccaagctcattccccaggccccccaaaaaaaaaacaaggcctcccggaaggccccctcccggggaaaacccttaagccccttttggccccctgtttccccccattcccccccccaaaaaaaaaccccccctcttttttgggggggggaaa

SEQ ID NO: 45181 - protein, 104 aa, Zea mays
  misc_feature: Ceres CLONE 1448675-F
  misc_feature (48)..(48): Xaa is any aa, unknown, or other
  misc_feature (56)..(56): Xaa is any aa, unknown, or other
  misc_feature (69)..(69): Xaa is any aa, unknown, or other
MTTSLKKNRKKRGHVSAGHGRIGKHRKHPGRPRARRAACTTHRILFDXYHPGYFGXVGHALLPTGSRTXSTCPSGHLEAAPGQMCPAGKGPGSGRARTRPGSFN

SEQ ID NO: 45182 - DNA, 705 bp, Zea mays
  misc_feature: Ceres CLONE 1448679-F
  misc_feature (388)..(388): n is a, c, t, g, unknown, or other
  misc_feature (705)..(705): n is a, c, t, g, unknown, or other
aagctggagctccccgcggtggcggccgctctagaactagtggatcccccgggctgcaggaattcgcacgagaccattacctagaacatcctaatcgaaaaaggaactggcggacttgagagctctcagactgtctacgcctccgatctctctcaagccagcagtgcgatccttgagccactgccgccgtgaggagcttcgcacgtctagccgtcatccgtcaaatcaggtgaatctgccaccacatcgtctcattcgaggcaccctcttctcttcccccaccggcgcctttcctcctccggtatctgtgcttctgccatcactttcttcctccacgctgtcagtagatctgctctgacttctcctcccttcaccagatatgccgggngcacggagcttcacatagatgtatctgaaaaccccccggagatggctcaaaagacccggcctctacccatttgggggcgctttcccatctgctgtggtgccgtccgtacgaccggatttagggtcctaaacggcacaccatattagtctggtccacgggaaccatggtcaggcaaaagccgccccaaaaaattattaggcttaaaaaataaggggtcccctttgtgggaaagggggaacaactcttccaaagtttgggataaaaaacaaaaacggggtgggacacatgggaacttttttgggaaaaaacaaaaaacn

SEQ ID NO: 45183 - DNA, 631 bp, Zea mays
  misc_feature: Ceres CLONE 1448687-F
  misc_feature: Encodes the peptide sequence at SEQ ID NO. 45184
  misc_feature (631)..(631): n is a, c, t, g, unknown, or other
gctcttgaactagtggatcccccgggctgcaggaattcgcacgagaccattacctagaacatcctaatcgaaaaactctttgcgccgccgcagccccaaaccctcatcccccatcagcctcaggggtgccccagccaccccacccttcactcacctaaccatggcggagcgcggcggcgagcgtggtggagagcgcggcgggttcggccgtggcttcggtcgcggcgggcgcggtgaccgtggtgggcgtcgcggcggccgccgtggcccgcgccaggaggaagagaagtgggttcccgtcaccaagcttggccgccttgtcaaggagaacaagatcaccaagatcgaggagatctacctccactcgctccccgtcaaggagcaccagatcgtcgagaccctcgtcccggggctcaaggacgaggtcatgaagatcacgcccgtccagaagcagacccgtgccgggcagcgcacccgcttcaaggccttcgtcgttgtcggcgattgcgacggccacgtcggcctgggagtcaagtgcgccaaggaggtggccaccgccatccgcggcgccatcatcctagccaagctctccgtcgtccccgtcagggagaggtactggggggacaagatn

SEQ ID NO: 45184 - protein, 156 aa, Zea mays
  misc_feature: Ceres CLONE 1448687-F
  misc_feature (84)..(150): Pfam Name: Ribosomal_S5 Pfam Description: Ribosomal protein S5, N-terminal domain
MAERGGERGGERGGFGRGFGRGGRGDRGGRRGGRRGPRQEEEKWVPVTKLGRLVKENKITKIEEIYLHSLPVKEHQIVETLVPGLKDEVMKITPVQKQTRAGQRTRFKAFVVVGDCDGHVGLGVKCAKEVATAIRGAIILAKLSVVPVRERYWGDK

SEQ ID NO: 45185 - DNA, 714 bp, Zea mays
  misc_feature: Ceres CLONE 1448688-F
  misc_feature: Encodes the peptide sequence at SEQ ID NO. 45186
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (424)..(424): n is a, c, t, g, unknown, or other
actctggagctccccgcggtggcggccgctctagaactagtggatcccccgggctgcaggaattcgcacgagaccattacctagaacatcctaatcgaaaaagattcggagcttcgggggaaaaaggcaggcacagtatcgtcgaacatgctgccaggtcgccacccggcgcgccgggccgacaccaccgggacggggccgctcctgccggacgccactcgcgcggtggtgtcggagttcgtcgccacagccatgttcgtgttcgccgccgaaggctccgtctacggcctctggaagctgtacaaggacacggcaacgccgggcggcctgctcgcggtggccatcgcgcacacgctggcgctgttgttcccccccccccgaggggaggagggggtcnnntnnncacctccaccccccccccacnttcggcctgctcgtgggccgtcccatctcttttcgggccgggccgccgttatactggcttcgcgccaaatgctcggggcccttggtcgcgttctttctctgccaacgcctcggctccgggcggccgggaatttcaacctaatttcccccccgtgtccccttccaaatactaccataccttttttcaccttcgactaatcaaaaaaaaaaaggttcccacctcagcccccccaaggcccccccgcggggccttttggggtacatatgtcctcgaccatccccaatggtctc

SEQ ID NO: 45186 - protein, 157 aa, Zea mays
  misc_feature: Ceres CLONE 1448688-F
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (93)..(93): Xaa is any aa, unknown, or other
MLPGRHPARRADTTGTGPLLPDATRAVVSEFVATAMFVFAAEGSVYGLWKLYKDTATPGGLLAVAIAHTLALLFPPPRGEEGVXXXPPPPPHXRPARGPSHLFSGRAAVILASRQMLGALGRVLSLPTPRLRAAGNFNLISPPCPLPNTTIPFFTFD

SEQ ID NO: 45187 - DNA, 666 bp, Zea mays
  misc_feature: Ceres CLONE 1448692-F
ggagctccccgcggtggcggccgctctatactagtggatcccccgggctgcaggaattcgcacgagaccattacctagaacatcctaatcgaaaatcttcatgtttagaggtgacctgccgttctgcatcgagagtgccgggaggatcttatggagatcgaggaggtgagggagcagcggctgaagcattacggggcgggccgagcatcttcggctgcggcagcagaagcagagcccccagaggatccccatctgggcgtggtaggatgagaaaaattttgggcgccgggaaaacgaacgaacgaacgtagtaggatttagctgcacctcaagaagaaccccccaagcaagggcgacgcgctgcgtgtggaaacaaacgcccgtggatgaccgccggctcgacgcaggaggaggaaggccacgcgccacggcacatgccggcagggcagggcagagagcccatccaagcggctgctgcgtctttttaccttcgtttgttgacgaaaccgaatggcctccctcctcctgatctccgaaagatggatacggaggggttggtttgtgcgtgagtttttgcacggttgcacgagtgacatggtgtgcgtgctgatcgccgtgtaaaccctgtctatactgtatgaaacacgcgagaggcctaaacgagtt

SEQ ID NO: 45188 - DNA, 621 bp, Zea mays
  misc_feature: Ceres CLONE 1448697-F
  misc_feature: Translation starting site: 228
ggagctccccgcggtggcggccgctctataactagtggatcccccgggctgcaggaattcgcacgagaccattacctagaacatcctaatcgaaaaacctacttccaccatttcggcaaccccgcaggaaaaaaaaaagggcgaaacgaggccaccagctcaccgccgagcggaagcggcgccgagcaaccaacccctctcctcgtccgccgccgtctccccggaccatgtgcatgggcgcctcctcccggatgctctgggcgtcccgcgccgccgcctacctaaaaatctccgccttccccagggccttctccaccgtgctgaaggatctgaagtatgctgacactcagtagaatggctgaaagttgacggtgattcaccaaccgtggggagtactgaccatgcccaggatcattggggagaggttgtttttgtggagctaccacaagttggcatcagtgtatcccagggaaataactttggtgctgttgacagggtgaaggcaaccaacgatatcaattcaccattgtctggagaggtggttgaaatgaacaaaaaactcagtgaggagccgggattgattaatgcaattccatatgagaagggatggattatcaaggt

SEQ ID NO: 45189 - DNA, 637 bp, Zea mays
  misc_feature: Ceres CLONE 1448698-F
  misc_feature: Encodes the peptide sequence at SEQ ID NO. 45190
  misc_feature (359)..(359): n is a, c, t, g, unknown, or other
  misc_feature (398)..(398): n is a, c, t, g, unknown, or other
  misc_feature (424)..(424): n is a, c, t, g, unknown, or other
ggagctccccgcggtggcggccgctctataactagtggatcccccgggctgcaggaattcgcacgagaccattacctagaacatcctaatcgaaaacacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtaaccctcgccgcggcctncctcgccgccgcggccttcggctacctcttctgctagantcgcgctggatacctggttcctgctncaaaatatgattcgtcctggtctggcccgcgtgaatccagctcgggtgccgtgtgtgttccggtgtgaggtgccggcgggcgtgggtgtatgtatgggaatccccccccgccgccgccgcccaagaaagggtgcccccgggtggtggttacctggtcccacacccccctggttttgcgcgggaataaagaaaaacccggggggggtttttggc

SEQ ID NO: 45190 - protein, 57 aa, Zea mays
  misc_feature: Ceres CLONE 1448698-F
  misc_feature (46)..(46): Xaa is any aa, unknown, or other
MAGLRMKFVAVAAMAAALVASAAAAEAPAPAPASDAAAAVTLAAAXLAAAAFGYLFC

SEQ ID NO: 45191 - DNA, 635 bp, Zea mays
  misc_feature: Ceres CLONE 1448708-F
  misc_feature: Encodes the peptide sequence at SEQ ID NO. 45192
gctctagaactagtggatcccccgggctgcaggaattcgcacgagaccattacctagaacatcctaatcgaaaaccaaacctccaatccacccatcccctcctcatccactccgggcggccatggcctgctccttcgccgccgcgaccgtcgtctcttccgcccccaccccggccgccaggcccctcgccgctgccccgcagtccgtctctgtttcccgctccgcggtcgccaccgccgccaggccgctccgccttgtcgcctccagatccgcgcgggccaccagactcgtcgcccgcgccggcggcgtcgatgacttgccgctggtcgggaaacaggcgccagacttcgaaagcgaagggccggttcaacaagagttcatcaacgtgaagctctctgaatacctcgggaaggaatacgtcgtttctgtccttctaaccccttggatttcccctttggccgcccgaaccgaaattactgcctttcggggcaaaaattgaggaatttcgaaaatttgaacccgggggtttttgggggtcccttttggaaagggggttcccccccctttgcagggggggaaaacaaaaaaggaaacctggggggggtttggcaattttaaaaaccccccctttgtcg

SEQ ID NO: 45192 - protein, 125 aa, Zea mays
  misc_feature: Ceres CLONE 1448708-F
  misc_feature: SWISSPROT Homolog: EC 1.11.1.15 Peroxiredoxin
MACSFAAATVVSSAPTPAARPLAAAPQSVSVSRSAVATAARPLRLVASRSARATRLVARAGGVDDLPLVGKQAPDFESEGPVQQEFINVKLSEYLGKEYVVSVLLTPWISPLAARTEITAFRGKN

SEQ ID NO: 45193 - DNA, 637 bp, Zea mays
  misc_feature: Ceres CLONE 1448713-F
  misc_feature: Encodes the peptide sequence at SEQ ID NO. 45194
ggagctccccgcggtggcggccgctctataactagtggatcccccgggctgcaggaattcgcacgagaccattacctagaacgtcctaatcgaaaactttttatttcgatccctcaatgattgagaaattatgaattaactattcccttccatttcctctcccctgccgcgctgtttacgcccacatctccttccgtttctcggcatcgtcctccgatctctccacgagcctccgctccaatccgaggatccgcggcggcgggcagtggtcggccggcgatggcgcaccgagtggacaacgagtacgactacctcttcaagatcgtgctcatcggcgactccggcgtcggcaagtccaacatcctttcccggttcacccgcaacgagttctgcctcgagtccaagtccaccatcggcgtcgagttcgccacccgcaccctccagattgaagggaaaaccatcaaagctcaaatatgggatactgcggggcaagagaggtaccgtgcaatcacaagtgcttactacagaggagccgtgggtgcacttctagtctatgacatcacgaagaagcagacatttgaaaacatacagaggtggctccgcgagctccgtgaccacgcggactccaacatcgtga

SEQ ID NO: 45194 - protein, 119 aa, Zea mays
  misc_feature: Ceres CLONE 1448713-F
  misc_feature (14)..(117): Pfam Name: Ras Pfam Description: Ras family
  misc_feature: SWISSPROT Homolog: EC 2.7.11.1 Non-specific serine/threonine protein kinase
MAHRVDNEYDYLFKIVLIGDSGVGKSNILSRFTRNEFCLESKSTIGVEFATRTLQIEGKTIKAQIWDTAGQERYRAITSAYYRGAVGALLVYDITKKQTFENIQRWLRELRDHADSNIV

SEQ ID NO: 45195 - DNA, 638 bp, Zea mays
  misc_feature: Ceres CLONE 1448718-F
  misc_feature: Encodes the peptide sequence at SEQ ID NO. 45196
  misc_feature (402)..(402): n is a, c, t, g, unknown, or other
  misc_feature (408)..(408): n is a, c, t, g, unknown, or other
  misc_feature (410)..(410): n is a, c, t, g, unknown, or other
cagctggagctcaccgcggtggcggccgctctagaatagtggatcccccgggctgcaggaattcgcacgagaccattacctagaacatcctaatcgaaaaaccccagccgccgccgccgccaccgccaccgccaccgccacctgccccagcgcgccgccgccgcaaccaccatgggtcgcgtccgcaccaagaccgtgaagaagacctccaggcaggtgatcgagaagtactactcccgcatgaccctcgacttccacaccaacaagaaggtgctggaggaggtctcgattctgccctcgaagcgcctccgcaacaaggtggctggcttcagtacccacctgatgcgccgcatccagcttgtttcactccgcgccatctgggtggggggtggggatgaggancgcgancnccccccccacttcgtgccggaaaatccgcgctcgaggtcgaagagatccgcgtcgacaaggaaaccatggatatgctcgctgccctcggcatggccgacctgcccggggtttaaccgccagctgaagtctccaacgcccccgcctacggccccccgcaatacggtggcccccccccgggcccgcgtttagacttcccggggggttgcctcttgatccccctgctattc

SEQ ID NO: 45196 - protein, 142 aa, Zea mays
  misc_feature: Ceres CLONE 1448718-F
  misc_feature (1)..(122): Pfam Name: Ribosomal_S17e Pfam Description: Ribosomal S17
  misc_feature (77)..(77): Xaa is any aa, unknown, or other
  misc_feature (79)..(79): Xaa is any aa, unknown, or other
  misc_feature (80)..(80): Xaa is any aa, unknown, or other
MGRVRTKTVKKTSRQVIEKYYSRMTLDFHTNKKVLEEVSILPSKRLRNKVAGFSTHLMRRIQLVSLRAIWVGGGDEXRXXPPHFVPENPRSRSKRSASTRKPWICSLPSAWPTCPGFNRQLKSPTPPPTAPRNTVAPPRARV

SEQ ID NO: 45197 - DNA, 630 bp, Zea mays
  misc_feature: Ceres CLONE 1448726-F
  misc_feature: Encodes the peptide sequence at SEQ ID NO. 45198
acccgcggtggcggccgctctagatctagtggatcccccgggctgcaggaattcgcacgagaccattacctagaacatcctaatcgaaaagagggaggaaccctagcggaacaggtgacggcggcgcgctaccggtgacgggggatacggcggcatcgtccccctcggcccctcctccatccccggcgcggcggcgccagcagccggcctgcagctttataatggatcccaacatgaagcagcttcaagaggctctggttgatattgagactgatgcagaaaaagttcttctggctagacatcagttggtggaaaatgataagataagaaatggtaacagggaggctctgacagcccttcggaaacaagctaggacgtccaagactagcgtgccatctccctttgaggtcataatgaaagagatggaaggaagctctggcaagcagctgataaaggagatatgcccaacttgtggagatcatgaccccaaggaacatacttggctaatgtttcctggatcagatatgttttctcgtgttccatttcatgtggcacacactgttgtggaaaaagaccaagaacgcctggatttggataccaagaaactgcaaagctttgtcaaggagaaat

SEQ ID NO: 45198 - protein, 136 aa, Zea mays
  misc_feature: Ceres CLONE 1448726-F
MDPNMKQLQEALVDIETDAEKVLLARHQLVENDKIRNGNREALTALRKQARTSKTSVPSPFEVIMKEMEGSSGKQLIKEICPTCGDHDPKEHTWLMFPGSDMFSRVPFHVAHTVVEKDQERLDLDTKKLQSFVKEK

SEQ ID NO: 45199 - DNA, 652 bp, Zea mays
  misc_feature: Ceres CLONE 1448730-F
  misc_feature: Encodes the peptide sequence at SEQ ID NO. 45200
  misc_feature (422)..(422): n is a, c, t, g, unknown, or other
  misc_feature (494)..(494): n is a, c, t, g, unknown, or other
  misc_feature (652)..(652): n is a, c, t, g, unknown, or other
tccccgcggtggcggccgctctagaactagtggatcccccgggctgcaggaattcgcacgagaccattacctagaacatcccaatcgaaaaaaaccaaacaccatccgccacgaccacgactccacgagagagcggaggaggagggggagcaatggcagagccgggccagcagttgctgcggtcgttcgtggaggtggcagcgggctcgcacttccctatccagaacctgcccttcggggtcttccgccggcgggggtcgccaccgcaggctccgctccccccggtggccatcggggacttcgcgctcgacctcgccaccgtcgccgacgcgggtctcttcgacgggcccgcgctctccggctccccgtgcttccaccaggagacgctcaacatgttcttggggatgggccgaccggcgtgnagggaggcgcgcgccacgctacaaaaatcctctcagccgacgagccagtcttgcgtgacaacgaagccctgnagaataaatgtcttatttccaaggagtgatatcgagatggttctaccaatcacgggttggaggttacacagaatttctttttgttctgtgcaccatgcaaggaactgcggattcctcttccggagggccgcagactccagtttattccaaatttggtn

SEQ ID NO: 45200 - protein, 166 aa, Zea mays
  misc_feature: Ceres CLONE 1448730-F
  misc_feature (11)..(130): Pfam Name: DUF1969 Pfam Description: Domain of unknown function (DUF1969)
  misc_feature: SWISSPROT Homolog: EC 3.7.1.2 Fumarylacetoacetase
  misc_feature (90)..(90): Xaa is any aa, unknown, or other
  misc_feature (114)..(114): Xaa is any aa, unknown, or other
MAEPGQQLLRSFVEVAAGSHFPIQNLPFGVFRRRGSPPQAPLPPVAIGDFALDLATVADAGLFDGPALSGSPCFHQETLNMFLGMGRPAXREARATLQKSSQPTSQSCVTTKPXRINVLFPRSDIEMVLPITGWRLHRISFCSVHHARNCGFLFRRAADSSLFQIW

SEQ ID NO: 45201 - DNA, 706 bp, Zea mays
  misc_feature: Ceres CLONE 1448736-F
aagctggagctccccgcggtggcggccgctctagaactagtggatcccccgggctgcaggaattcgcacgagaccattacctagaacatcctaatcgaaaaaaaacgatttcgtcgccatgaccatgacgtctcgtttcgttgcggcggcctcttcctcctcgtcctcgtgccccctcgcccgcctaatctctcgccgcggccttgccggtgccgcagacggccatggacctgcgaaggtgcccttgtggaaagatccgttgagcccgagcaagtggaaggaagagcactttgttctagcaagcctctctatgtggggggctcttttttatggtggtttcaagttttttggtggaaagaaggaagacaagattgaggcggcatcaggacagacataggtggctgggatgggagttcttgcctatttctgtggccaggcaacaatgttaaataaaaggaatgtgttatattgtgctttcaagttgataaattgtggcaaccaggttttgattatgtaggcaatattttgacaagctactcttatccagcatgaatgacttcacgtttgtgaatgctgcaaatgttgtacttctttcatgcgattgagtagatgttttacttctgttgccatcaccagttcaacgctgtacttttaattgattcgatcacgtgctttctaaaaaaaaaaaaaaaaagcttatcgatac

SEQ ID NO: 45202 - DNA, 721 bp, Zea mays
  misc_feature: Ceres CLONE 1448737-F
  misc_feature: Encodes the peptide sequence at SEQ ID NO. 45203
  misc_feature (19)..(19): n is a, c, t, g, unknown, or other
  misc_feature (29)..(29): n is a, c, t, g, unknown, or other
  misc_feature (31)..(31): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (497)..(497): n is a, c, t, g, unknown, or other
ttccttccgtgttccgtgngcagccgggnanaaaaacttctctccgtccgccttccccccccaagacannnnnnnnnnnnnnncaaaactggagctccccgcggtggcggccgctctattttcaaaggatcccccgggctgcaggaatttccacgagaccattacctagaacatcctaatcgaaaaaatttcgaatctccccttcccctcagtctctcacacgcacgctcctcccctacgcagcaaaaccctaaccctagctgcggacgccgtcgccgcctccgcgcccaaccgatgtctgattctgaggcgtccccaccgcccactccggccgccgcaacgcccgcagcgccggtggagacctccccgtcctcggcgaggaaggaagaactgctgcctgtggaggaaaagatctcggaattaagtgaatcacaatcagagcttctagggaggctccgcgggcttaaggaggatttgctgagttggaggagtaattnaaactcccaaccgaccaaatacaaagtggaactctctgacatcaagagtgcactcaataatgaaatagagcagcttcgctcagatttccaagagctgaggaccacccttaaaaagcagcaggaaaatgtgtcaccttacctggaagaaattgggggcttcagatgcctaccgaaaagatgggaaacaaaggaaaagggagacgggcccaaatggagcccccgcc

SEQ ID NO: 45203 - protein, 142 aa, Zea mays
  misc_feature: Ceres CLONE 1448737-F
  misc_feature (68)..(68): Xaa is any aa, unknown, or other
MSDSEASPPPTPAAATPAAPVETSPSSARKEELLPVEEKISELSESQSELLGRLRGLKEDLLSWRSNXNSQPTKYKVELSDIKSALNNEIEQLRSDFQELRTTLKKQQENVSPYLEEIGGFRCLPKRWETKEKGDGPKWSPR

SEQ ID NO: 45204 - DNA, 818 bp, Zea mays
  misc_feature: Ceres CLONE 1448744-F
  misc_feature: Encodes the peptide sequence at SEQ ID NO. 45205
  misc_feature (234)..(234): n is a, c, t, g, unknown, or other
  misc_feature (264)..(264): n is a, c, t, g, unknown, or other
  misc_feature (279)..(279): n is a, c, t, g, unknown, or other
  misc_feature (285)..(285): n is a, c, t, g, unknown, or other
  misc_feature (334)..(334): n is a, c, t, g, unknown, or other
ggagctccccgcggtggcggccgctctagaactagtggatcccccgggctgcaggaattcgcacgagaccattacctagaacatcctaatcgaaaatatgcagagtcgtcttcacaggcactagaactggttggtcctgcctatagaacaatggactcatttgttggtgtgcgagagaaaacctgtatcatttttgtttatggactattacttatgagacagcataatccgcangaagcacggaaccgcctttgcagtggtttngaaatagcgcaccancagttnggtaacatccagttagtttctcagtatttgacaatactgggcacattgncgcttcagctacatgacgcagcacaggctaaaagagatcctgaattcttcgttgaccttagctaagaagctacttaaaattcccaacccaaatctgggatcttggtcaggatttcccagatttttttcctggaccttgaaaaaaaagggaaatttaaattgggaaacctttggtttccaagggaaaaaaagggaaaaatattttccaaaaaaaaactttttgagaattttttttctctttttttttccccgagggcggggggaaaaaaacaaaaaaaaccccccctctccccttttcaaaaaacaacccccaaaaaggggggtccccccccccacgaggggggttttttaccccccaaaaaaagggggggtttttttcccccccccctttttttataaaaaattttttggggcccccccccacaaagggccccctcaccaaggggggggggggggaaaaaaacaacccctttttttattataac

SEQ ID NO: 45205 - protein, 132 aa, Zea mays
  misc_feature: Ceres CLONE 1448744-F
  misc_feature (78)..(78): Xaa is any aa, unknown, or other
  misc_feature (88)..(88): Xaa is any aa, unknown, or other
  misc_feature (93)..(93): Xaa is any aa, unknown, or other
  misc_feature (95)..(95): Xaa is any aa, unknown, or other
  misc_feature (112)..(112): Xaa is any aa, unknown, or other
GAPRGGGRSRTSGSPGLQEFARDHYLEHPNRKYAESSSQALELVGPAYRTMDSFVGVREKTCIIFVYGLLLMRQHNPXEARNRLCSGXEIAHXQXGNIQLVSQYLTILGTLXLQLHDAAQAKRDPEFFVDLS

SEQ ID NO: 45206 - DNA, 592 bp, Zea mays
  misc_feature: Ceres CLONE 1448746-F
  misc_feature: Encodes the peptide sequence at SEQ ID NO. 45207
  misc_feature (234)..(234): n is a, c, t, g, unknown, or other
  misc_feature (523)..(523): n is a, c, t, g, unknown, or other
  misc_feature (550)..(550): n is a, c, t, g, unknown, or other
ctccccgcggtggcggccgctctagaactagtggatcccccgggctgcaggaattcgcacgagaccatacctagaacatcctaatcgaaaaatcgcttcagctcggcgtcttcacaaacgccggcgcaaactctcgcccgagcccgacagatctctaattccccataccgtccaccggtcgaccttcacgccagtctcggtctcttccgaaggcgtcgcgcgcggttgtttganaggagaggaagaagatgagggagtgcatctcccgtccacatcgggcagccggcatccaagtcgggaaccccgtggctggaaactttacttgccccgggcccgggttcccagcctggagggccaagggcccttagaaataaaaccccgggggaaatccccataaaagtctttttaacccttttttttaaccaaaagtgggggtggggaaaaaaaatttccccccccggaaatttttttttgttaattaaaaccccccctttgaattataaaaagggggggcccttggganaaaaaaaccccccctttttttttcccnctccgggaggggtttttctttgggggggggggggggggggcc

SEQ ID NO: 45207 - protein, 39 aa, Zea mays
  misc_feature: Ceres CLONE 1448746-F
MRECISRPHRAAGIQVGNPVAGNFTCPGPGFPAWRAKGP

SEQ ID NO: 45208 - DNA, 505 bp, Zea mays
  misc_feature: Ceres CLONE 1448747-F
  misc_feature (273)..(273): n is a, c, t, g, unknown, or other
ctcccgcggtggcggccgctctgaactagtggatcccccgggctgcggattcgcacgagaccattacctagaacatcctaatcgaaaaaaggatccaccacaacagcgaaggagaaagcagaccaacctagccacccaggagaaagaggccaaaagggaggggagagtgtcgtcatggcttcattgtcgcttcaggaggccgttctctagtcgcgctctggagagctcatcgcagcgtctccgctcccggaactgctccgccctcaggcgtgnaatcgcggcggctccccggtacaaaccgggcttccttccaaactaccagggggccaatcgaaaacacaaacccccccccaaatacaatgggggaacggggcccggaataccctttggccccccccgtttccaaaatttttccccggaaccccttaatggccccccaaaaatttgcccccctttaaacctttggaaaaatttggggggggggcccccatttttggggggcccc

SEQ ID NO: 45209 - DNA, 703 bp, Zea mays
  misc_feature: Ceres CLONE 1448748-F
  misc_feature: Encodes the peptide sequence at SEQ ID NO. 45210
  misc_feature (635)..(635): n is a, c, t, g, unknown, or other
  misc_feature (661)..(661): n is a, c, t, g, unknown, or other
  misc_feature (662)..(662): n is a, c, t, g, unknown, or other
  misc_feature (665)..(665): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaaatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactaactggcctggcaaacccccaacagaggcacatagaaatacttggctatctcctctatgctgccaaggttgttgcgaagcaggaaggacttgaagatggctatcgcgtcgtcatcaatgacggcccaagtggatgtcaatctgtttaccacatccacgttcatctcctcggaggcaggcaaatgaactggcccccaggctaagaatatcttgggaatgatcagtgctaatgccaaggactgctactccatttctctagaataatccctggtattttccataaaaggtnagtgcggcagggcgggacccccgcgnnaanttnggggaatacccgaagcatggtggcgggaccaaggg

SEQ ID NO: 45210 - protein, 129 aa, Zea mays
  misc_feature: Ceres CLONE 1448748-F
  misc_feature (25)..(124): Pfam Name: HIT Pfam Description: HIT domain
MSSEKEAALAAVLDDSPTIFDKIIKKEIPSTVVYEDEKVLAFRDINPQAPTHILIIPKVKDGLTGLANPQQRHIEILGYLLYAAKVVAKQEGLEDGYRVVINDGPSGCQSVYHIHVHLLGGRQMNWPPG

SEQ ID NO: 45211 - DNA, 615 bp, Zea mays
  misc_feature: Ceres CLONE 1448749-F
  misc_feature: Encodes the peptide sequence at SEQ ID NO. 45212
  misc_feature (347)..(347): n is a, c, t, g, unknown, or other
  misc_feature (398)..(398): n is a, c, t, g, unknown, or other
  misc_feature (423)..(423): n is a, c, t, g, unknown, or other
  misc_feature (470)..(470): n is a, c, t, g, unknown, or other
  misc_feature (477)..(477): n is a, c, t, g, unknown, or other
tccccgcggtggcggccgctctagaactagtggatcccccgggctgcaggaattcgcacgagaccattacctagaacatcctaatcgaaaaaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttccggctccgccccctccaatctgggagggttcagggtttacgtctgcgagcacagcacagatcccccagaaggacaagttataaagacggattncacgaatatttttatcaggcatctccagttttgacagcagaagactgaggncaaagatgtggattccagaactgtncgcgaaaacaacagagggaaagatctgctgccagaagtttggatgtncacattncaacaaggaggctaacttgggtactccatctggacatccgcctatgaagaatttctggggtttccccacccccctgcagctttaacggggaaaaaattgggtgcccttcaccacaaaagggccaattgaccaaaggca

SEQ ID NO: 45212 - protein, 90 aa, Zea mays
  misc_feature: Ceres CLONE 1448749-F
  misc_feature (80)..(80): Xaa is any aa, unknown, or other
MPTEEGSDGGGGAGAGAGEKKSSQAPAKPGACGAAKFLAGLPSRGNFSSGSAPSNLGGFRVYVCEHSTDPPEGQVIKTDXTNIFIRHLQF

SEQ ID NO: 45213 - DNA, 650 bp, Zea mays
  misc_feature: Ceres CLONE 1448760-F
  misc_feature: Encodes the peptide sequence at SEQ ID NO. 45214
  misc_feature (641)..(641): n is a, c, t, g, unknown, or other
ctggagctccccgcggtggcggccgctctagaactagtggatcccccgggctgcaggaattcgcacgagaccattacctagaacatcctaatcgaaaagattcagcgatttccgatctttccgtcctcggtcttcttgatttttccttcctacctccacctgctagcgccgtccgccgttcctcaggaaaatcctctcacctgagtatggagcagcaccccacttgcgcccagccaccggcgccggcgcccctggctgggcccgtcgtcccggtggacttcaaggtcgtcaagaagggacccgagatggcgatgcacgacgcgatcggccgcctcgccttccgcgtcgcgggcagcgccggcggggccacggcgctccaggatgacgctggaggtgtcctggtcaccgtcaggagcagcggccagggtgagtggcaagcattcagtgggaatagtttggaggagagacacatcattttcactgcaaaagctatacctgcttcttcaagtcgagaggaggtacatgtgttcatctcaccaagaagcactgttgaagattcaaaaccaagctacagactcgtaggaagtgcattccaaagagcgtgcacagtaataaagggggactccatcgttgctcagacnaatctcttg

SEQ ID NO: 45214 - protein, 148 aa, Zea mays
  misc_feature: Ceres CLONE 1448760-F
  misc_feature (18)..(148): Pfam Name: DUF567 Pfam Description: Protein of unknown function (DUF567)
MEQHPTCAQPPAPAPLAGPVVPVDFKVVKKGPEMAMHDAIGRLAFRVAGSAGGATALQDDAGGVLVTVRSSGQGEWQAFSGNSLEERHIIFTAKAIPASSSREEVHVFISPRSTVEDSKPSYRLVGSAFQRACTVIKGDSIVAQTNLL

SEQ ID NO: 45215 - DNA, 594 bp, Zea mays
  misc_feature: Ceres CLONE 1448766-F
  misc_feature: Encodes the peptide sequence at SEQ ID NO. 45216
tccccgcggtggcggccgctctagaactagtgggatcccccgggctgcaggaattcgcacgagaccattacctagaacatcctaatcgaaaagcccgctccgtgttcattgccccactccctcacgcctctcgcgcccgccgctccaccacccccatccacgctcagggaaagggggtctgggttgcgtacaggcgaaaggcacgcgccgccgctgccgcgcgagcctctccgtccccatcgccgcgcagatggatccgtcgtcggagcccctgtacgcgcaggtcgagtcgtacgactccgggttcctcaaggtctccgatgtccacaccatctactacgagcagtccgggaacccgcagggccatgcggccgtgtttctccacggcggtcccggagccggcacgtcgcccgggcacaggaggttctttgacccgcagttctacaggatcgttctgtttgaccagaggggtgcaggcagaagcactccccatgcttggttagagcagaacactacttgggacttggttgctgacattgagaaactcaggaagcatcttggcatccctgaatggcaagggttttggtggttcat

SEQ ID NO: 45216 - protein, 114 aa, Zea mays
  misc_feature: Ceres CLONE 1448766-F
  misc_feature: SWISSPROT Homolog: EC 3.4.11.5 Prolyl aminopeptidase
MDPSSEPLYAQVESYDSGFLKVSDVHTIYYEQSGNPQGHAAVFLHGGPGAGTSPGHRRFFDPQFYRIVLFDQRGAGRSTPHAWLEQNTTWDLVADIEKLRKHLGIPEWQGFWWF

SEQ ID NO: 45217 - DNA, 826 bp, Zea mays
  misc_feature: Ceres CLONE 1448768-F
  misc_feature: Encodes the peptide sequence at SEQ ID NO. 45218
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (455)..(455): n is a, c, t, g, unknown, or other
gaaagcgccccaccacaaaccacccaaccacccnnnnnnnccaaaannnnnccaaactgggactccccgcggtggcggccgctctagatctagtggatcccccgggctgcaggaattcgcacgagaccattacctagaacatcctaatcgaaaaaaaaaaccgaatccaaataatcgccaccgctctccgcaccgaatcgaagaaagcggcaatggcagcggagaagccggccccggagcgcgtgctgtactgcggcgacagcggcctcccggccgagtactgcgagctcggccccgacatccagagcagcaagccctggctgctggcgcacgcgcccggcgtctaccccgacgaccttgacgccggtccctcctcgaccggcggtgctggtggcaacagagacctccacaaggtcggggagcgcctgaagggaaacgggatctccgacagtttnagaagaggaagaacccaacggttgcgccctcaaaatcccgtctcaggttcaaagcgcctgccgtgatggcgcagcatcaatgaaaagaggaaaaacccatccagggttgtccactcgaagaaagattgatcgccccaacaaggcggcaaagtgtagtttcccggggttcgcaaggggaccttgagaattggtatgggcgcgaaaagctggaggggcatgctttcaaaagcaagctctgggaaataagattttcgccccgggaaagatatctgttcgttagaggcaccgaaccgcaagaaggaaaccagaatgggcgttccaagggggcacctgtgcatatcgagcctggggggccccccctcgccgcctcc

SEQ ID NO: 45218 - protein, 102 aa, Zea mays
  misc_feature: Ceres CLONE 1448768-F
  misc_feature (81)..(81): Xaa is any aa, unknown, or other
MAAEKPAPERVLYCGDSGLPAEYCELGPDIQSSKPWLLAHAPGVYPDDLDAGPSSTGGAGGNRDLHKVGERLKGNGISDSXRRGRTQRLRPQNPVSGSKRLP

SEQ ID NO: 45219 - DNA, 445 bp, Zea mays
  misc_feature: Ceres CLONE 1448781-F
  misc_feature: Encodes the peptide sequence at SEQ ID NO. 45220
  misc_feature (47)..(47): n is a, c, t, g, unknown, or other
  misc_feature (245)..(245): n is a, c, t, g, unknown, or other
tggagctccccgcggtggcggccgctctagaactagtggatcccccngggctgcaggaattcgcacgagaccattacctagaacatcctaatcgaaaaatacggaggaggatgacaccgcagccactcaagatccgtgctgacgtcgagatgaaatgtttccaatttgatggggtgctccatattaagcaagccatgaggaaagctgaagctgctggggacactaattgtcctgtgaagattaangctgggtgctccctccactttatggtttctgaactcccaaactctcaacaggaccaagcattcaattctccctgagcgttaagctgcccgcaaatttgaaacccagggaatttggccgaaaaaaccccaagcttttatggaaggaaataccttttacccccctttggaccccggtttaaaaaaagcgaagttgcggggaa

SEQ ID NO: 45220 - protein, 105 aa, Zea mays
  misc_feature: Ceres CLONE 1448781-F
  misc_feature (1)..(96): Pfam Name: EIF_2_alpha Pfam Description: Eukaryotic translation initiation factor 2 alpha subunit
  misc_feature (81)..(81): Xaa is any aa, unknown, or other
ELPAVAAALELVDPPGLQEFARDHYLEHPNRKIRRRMTPQPLKIRADVEMKCFQFDGVLHIKQAMRKAEAAGDTNCPVKIXAGCSLHFMVSELPNSQQDQAFNSP

SEQ ID NO: 45221 - DNA, 621 bp, Zea mays
  misc_feature: Ceres CLONE 1448790-F
  misc_feature: Encodes the peptide sequence at SEQ ID NO. 45222
acccgcggtggcggccgctctagaactagtggatcccccgggctgcaggaattcgcacgagaccattacctagaacatcctaatcgaaaactgatctgttcttggagtggggaggcgaggagaggagaggaggaagatggcggcgcaggagcacgagcacgagcacgagcacgagaagcagcaggcgaagacgagcaccacgagctcgctcccctccagcagcgagcgctcctccagctccgcccccaacaaccttagggaaggaggcgtggagagcgacgaggagatacggcgggtgccggagctgggcggcgcgtcggcgtcggcgtcggcgtcgtcgggcgcgggcaaggaggacggcgcgcgggcggtggccgcgggggcgcaggggcaccctccggccgccgggaagaagcgcggccgcgccccgggggacaaggagcagaaccggctgaagcggctgctgcggaaccgcgtgtcggcgcagcaggcgcgggagcggaagaaggcgtacctgacggagctggaggcgcgggccaaggacctggagctccgcaatgccgagctcgagcagcgggtgtccacgctccagaacgagaacaacacgctccgccagattcc

SEQ ID NO: 45222 - protein, 161 aa, Zea mays
  misc_feature: Ceres CLONE 1448790-F
  misc_feature (100)..(154): Pfam Name: bZIP_2 Pfam Description: Basic region leucine zipper
MAAQEHEHEHEHEKQQAKTSTTSSLPSSSERSSSSAPNNLREGGVESDEEIRRVPELGGASASASASSGAGKEDGARAVAAGAQGHPPAAGKKRGRAPGDKEQNRLKRLLRNRVSAQQARERKKAYLTELEARAKDLELRNAELEQRVSTLQNENNTLRQI

SEQ ID NO: 45223 - DNA, 494 bp, Zea mays
  misc_feature: Ceres CLONE 1448804-F
  misc_feature (257)..(257): n is a, c, t, g, unknown, or other
  misc_feature (264)..(264): n is a, c, t, g, unknown, or other
cccgcggtggcggccgctctagaactagtggatcccccgggctgcaggaattcgcacgagaccattacctagaacatcctaatcgaaaaaactaaaccaattattgatgatccagccattgttgagcagaacaaggaaaaggtattcgaagaatggaaatctatgcgcagggctgagctgactcggtttcaaaagcaagttgaggagcaatatctctcaaatgtggagaggcaattggagaggatccagaatgcccnggaacgnctcggaagggcgaatggggcctggtaacatgcaagaaatgggacaagggaagctgggacacccaccagggcggaaagcatggtcccaaagccttcggggaaggttccgaaagaagggcggcattgattgtgacaaaaatgccaaagaaatgggctgcgaaaaacaaacttgagggaaaaagttttggggcccccccagggccttcctggggggccccctccccacccggc

SEQ ID NO: 45224 - DNA, 625 bp, Zea mays
  misc_feature: Ceres CLONE 1448812-F
  misc_feature: Encodes the peptide sequence at SEQ ID NO. 45225
acccgcggtggcggccgctctagaactagtggatcccccgggctgcaggaattcgcacgagaccattacctagaacatcctaatcgaaaaatccctagtacagatcgagtgtcccgtagccactccacgtctccacgctccacggtcacactcggaacctcagctcagaggatcggaagaacggacggcgagatggcaagcggggaagaaggcaagggcgagacggtgctggtcaccggggccagcggcttcatcggctcgaccctcgtccgcggcctcctcggccgcggctacaaagtccgcgccggcgtcatcgaccccgacgacagggcggagacggaccacctccacgcgctcgccgccggcgccggccgcctcagcttcttccgctgcgacctcctggacggcgccgcgctgctcgacgcagcaagggggtgctcgggcgtcttccacctcgcgtcaccctgcaccgtcgaccccgtcaaggacccccagaatcagctgatggtgcctgcggtggaagggacgctgaacgtggtgcgcgcggccaaggacgccggcggagtgcggcgggtggtcgtgacctcgtccatctcggccgtcgtgcccaaccccgggtggcccg

SEQ ID NO: 45225 - protein, 144 aa, Zea mays
  misc_feature: Ceres CLONE 1448812-F
  misc_feature (10)..(144): Pfam Name: adh_short Pfam Description: short chain dehydrogenase
  misc_feature: SWISSPROT Homolog: EC 1.1.1.219 Dihydrokaempferol 4-reductase
MASGEEGKGETVLVTGASGFIGSTLVRGLLGRGYKVRAGVIDPDDRAETDHLHALAAGAGRLSFFRCDLLDGAALLDAARGCSGVFHLASPCTVDPVKDPQNQLMVPAVEGTLNVVRAAKDAGGVRRVVVTSSISAVVPNPGWP

SEQ ID NO: 45226 - DNA, 631 bp, Zea mays
  misc_feature: Ceres CLONE 1448817-F
  misc_feature: Encodes the peptide sequence at SEQ ID NO. 45227
tggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggctaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcct

SEQ ID NO: 45227 - protein, 133 aa, Zea mays
  misc_feature: Ceres CLONE 1448817-F
  misc_feature (14)..(123): Pfam Name: Ribosomal_L32e Pfam Description: Ribosomal protein L32
MAVPLLTKKIVKKRVKQFKRPHLDRYKCLKPSWRRLKGIDSRVRRKFKGCTLMPNIGYGSDKSTRHYLPSKFKKFVVHNVSELELLMMHNRTYCAEIAHNVSTKKRKEIVERAAQLDIVVTNKLARLRSQEDE

SEQ ID NO: 45228 - DNA, 583 bp, Zea mays
  misc_feature: Ceres CLONE 1448834-F
  misc_feature: Encodes the peptide sequence at SEQ ID NO. 45229
acccgcggtggcggccgctctagaactagtggatcccccgggctgcaggaattcgcacgagaccattacctagaacatcctaatcgaaaactgcccagctgcccgctgaaaaacaaactcacccaacaaagtgacctgaaactgggagcaagcaaccgaaggggagaaccatggcgaaccctcgcaacggcggcggcggcggcctcctggacttagaggggcactacgccttctacggcgcctaccacagcaaccccgtcaacgtgggcatccacgagctcttcgtctggcccatcttcctcaccgcgctcatgctcctccacctcaccgccccctccacgcacgccgacggaatcagcgccgcggactacgcggcctactacttcctcctcgaccgccgtgggagcgcgctcgccaccctcctctgctacctctgctgggacgccagaggcgccctctctgcacgactcggtttctctgttggatggaaggttgtatcgctcggccagttgttctgatggattatgcagttcatcggtcatggagttttcaagagcgagcgcctgctctccttgacaatctg

SEQ ID NO: 45229 - protein, 115 aa, Zea mays
  misc_feature: Ceres CLONE 1448834-F
  misc_feature (12)..(115): Pfam Name: DUF962 Pfam Description: Protein of unknown function (DUF962)
MANPRNGGGGGLLDLEGHYAFYGAYHSNPVNVGIHELFVWPIFLTALMLLHLTAPSTHADGISAADYAAYYFLLDRRGSALATLLCYLCWDARGALSARLGFSVGWKVVSLGQLF

SEQ ID NO: 45230 - DNA, 779 bp, Zea mays
  misc_feature: Ceres CLONE 1448840-F
  misc_feature: Encodes the peptide sequence at SEQ ID NO. 45231
aagctggagctccccgcggtggcggccgctctagaactagtggatcccccgggctgcaggaattcgcacgagaccattacctagaacatcctaatcgaaaaatcaaccgcagtacacggcgtatcattcccagcgaccacgagagactagctagccaagtgcatgcaaccagccatgcaggccgggaagacggcagtggaggcgacgaaggaggccgcggccaacgtcggggcctcggcgaacgccggcatgcagaagacccgtgccgccgtgcaaggccaggtggagaaggccacggcgcgcaacgcgtcggacaaggtcgcggccgaggagcgccagcgggagcgcgtgcgcgccgcggagctggagaagcaggacgccgtgcgcgccaacgcggccgcgaaggagcgcgccattggcggcgcggccacgtaccagcaccagcacccgtcgcagggcgcgcccgggatcggcgcccagcaggagtatggcggcggaagagtcgcccccgcgggcgggcacgtcgaggccggcgtcggcgagacccgtcccgtcgctaggggcaccggcacggcgcggcccagcgccgcgcacaacccgctcgtcggcagcgacttctcgcaggcgcgcggcaccggcggacagtaccagtgagcggctgccgccgggacgtgcccctacgtgtgacgtatcatgtgtgtgagataggcatgtacacgaatgggtctccgtgtgataatctatgctaaataatatgtctcctatagtgtattagaaat

SEQ ID NO: 45231 - protein, 159 aa, Zea mays
  misc_feature: Ceres CLONE 1448840-F
  misc_feature (8)..(80): Pfam Name: LEA_1 Pfam Description: Late embryogenesis abundant (LEA) group 1
MQAGKTAVEATKEAAANVGASANAGMQKTRAAVQGQVEKATARNASDKVAAEERQRERVRAAELEKQDAVRANAAAKERAIGGAATYQHQHPSQGAPGIGAQQEYGGGRVAPAGGHVEAGVGETRPVARGTGTARPSAAHNPLVGSDFSQARGTGGQYQ

SEQ ID NO: 45232 - DNA, 875 bp, Zea mays
  misc_feature: Ceres CLONE 1448841-F
  misc_feature: Encodes the peptide sequence at SEQ ID NO. 45233
  misc_feature (400)..(400): n is a, c, t, g, unknown, or other
  misc_feature (428)..(428): n is a, c, t, g, unknown, or other
  misc_feature (663)..(663): n is a, c, t, g, unknown, or other
  misc_feature (875)..(875): n is a, c, t, g, unknown, or other
acagctggagctccccgcggtggcggccgctctagaactagtggatcccccgggctgcaggaattcgcacgagaccattacctagaacatcctaatcgaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgccctcgacgaccaggggggcggggccggcatacggcagccgagccgcgagtaccccgggaggaaggtgggggccgtgattatggtgctttttccacaggggggggggggatttccantattttttttttttttcccccccccaanaataaaaaccggcattatcccagaaagtagcacggcggccgaccgccacgcacgcaaattacctccgcgctgttgcgcgggcccaatccctaagcgggagctagggggggttccaaggacaaccctccgtgcgcgagtggtccccctacagagagagcgcgcgcccgggtgaacttaggtcgagcgcaagaacccccggatacgcaccccccgcggattcgcgcaacaaatcccncgacagtgcacctcgagcccaactcgatggtctataacactttcctcccgtcagtcggcgccacataggcgccccactaagactccggcggagacagatcagggccccggccacagaagctcttcgagtaaaactctaaactctcagctcgcccgactgtcccggccaatagacccttgaccgtctccttcgccactcctcaagcggcgcgn

SEQ ID NO: 45233 - protein, 130 aa, Zea mays
  misc_feature: Ceres CLONE 1448841-F
  misc_feature (65)..(65): Xaa is any aa, unknown, or other
  misc_feature (74)..(74): Xaa is any aa, unknown, or other
MARALGACVLLAVLLGALAPAAAARALDDQGGGAGIRQPSREYPGRKVGAVIMVLFPQGGGGFPXFFFFFPPPXIKTGIIPESSTAADRHARKLPPRCCAGPIPKRELGGVPRTTLRARVVPLQRERAPG

SEQ ID NO: 45234 - DNA, 703 bp, Zea mays
  misc_feature: Ceres CLONE 1448844-F
  misc_feature: Encodes the peptide sequence at SEQ ID NO. 45235
  misc_feature (399)..(399): n is a, c, t, g, unknown, or other
aaagctggagctccccgcggtggcggccgctctagaactagtggatcccccgggctgcaggaattcgcacgagaccattacctagaacatcctaatcgaaaaacgagaggagatcgaaggagactccaattccagtcgcccccatccgttcctcatctcaccagaagcgaagccggaggagggaggaaggagatcgcgagcagccggagccggaggccgagaggatgaagacgttcgacctgtggccggtcttcttccgccgggagtggaagcgcaactgggccctttctcacgggggttcgccatcaccgggctcatcatcaccaagatgacggccaacttcaccgaggaagacctcaagaactccaaggtcgtccaggaacacagaagcgctgaccnaccgggtggagcctccgaatcgcctgcggatgaaaaaataccccctaatttcttggctttttttaacccaaaggcgggcccccaattggaaaaaggaaaaaaaggcattgggttggtccaaccccaacccggtttcgggatttgagacccgtttccgggaaatttggggggccaaaacaaaatgggggcctttttttttcccggggggggggaggggcccaaacccccggggaaatgggggggggggggccccccggggagtttcccttcccccggaaaaacccccagaagaaaaaaaaaaaaa

SEQ ID NO: 45235 - protein, 71 aa, Zea mays
  misc_feature: Ceres CLONE 1448844-F
  misc_feature (24)..(24): Xaa is any aa, unknown, or other
MTANFTEEDLKNSKVVQEHRSADXPGGASESPADEKIPPNFLAFFNPKAGPQLEKGKKGIGLVQPQPGFGI

SEQ ID NO: 45236 - DNA, 756 bp, Zea mays
  misc_feature: Ceres CLONE 1448845-F
  misc_feature (468)..(468): n is a, c, t, g, unknown, or other
aagctggagctccccgcggtggcggccgctctagaactagtggatcccccgggctgcaggaattcgcacgagaccattacctagaacatcctaatcgaaaaactcactcactcacaagtaaaacggccgcgcttgaaccgctgcacacaacagagggagcttgtgaggcccaacgaaaacgtaacaccagctcgccatccatggcctggtgagctgcagtgctggctctggccacggctctgtcactctcgtgacctccgcgcgcttcggccacatgaccctggacaaccgggataggcctacacggtgtcggcctggtcccgtgcctgcaggacctgcacggacaggcccgcccgccgccaccccactgatgccgggggctgcgccacctgctgggcaaaagcctcaagtgcctgtgcatgctcctcaaggacaatgacgaaccgcaacctgggcatgcagattaanaccaccctgactctcgcgctgcgcaatgcgtgcggcgctacccgcggccatgactgccactgcgctcatttactggatatccctcgggctccatagatacgcccatctcagcaccgggagacgaagagggctcatctgctcccagtcaaggaacactcgatgagcaacaccgactgccgccgctgcatggaccaccggacgttcttctactactcgacggagacgtccgtgctgcctcgcggggctttcgcaggtaaactcacctggcgtggcaaggtgccactaggt

SEQ ID NO: 45237 - DNA, 793 bp, Zea mays
  misc_feature: Ceres CLONE 1448849-F
  misc_feature: Translation starting site: 186
  misc_feature (299)..(299): n is a, c, t, g, unknown, or other
  misc_feature (301)..(301): n is a, c, t, g, unknown, or other
  misc_feature (302)..(302): n is a, c, t, g, unknown, or other
  misc_feature (336)..(336): n is a, c, t, g, unknown, or other
  misc_feature (344)..(344): n is a, c, t, g, unknown, or other
  misc_feature (345)..(345): n is a, c, t, g, unknown, or other
aaagctggagctccccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagcccgggcgcgggctgatcaaggtgacngnncgtccgatgagctcatcaggccggagatgctccngctcaggnncttcgagcccatcctgcttgcggggcgcctccagttcaagaacatcgaactgaggatcccgctccaagcggcgggaaaactcccaaaatttccccattcccagggccttcccaaggggctcgcccccaaatcccaaaaaccttcccaaagccgcccaaaaggggggcaaggaatttttccccggggaaaagcgcccctttttggcccaaacccagggtttgaaagaaaaaaaattggggggggggcgccccccccggtttaaaaaaatccccttaggggagtttgccccccctttgaaaaaaaaagggtggtggccccacctccaaaataggcgggccccgggtgtttttttttctccgcaacccgtgggggtgtaaaaaaaaaggggtctccccccccgggggggggggccaccattaataatttatagccggtggcgccccgctgt

SEQ ID NO: 45238 - DNA, 773 bp, Zea mays
  misc_feature: Ceres CLONE 1448854-F
  misc_feature: Encodes the peptide sequence at SEQ ID NO. 45239
aagctggagctccccgcggtggcggccgctctagaactagtggatcccccgggctgcaggaattcgcacgagaccattacctagaacatcctaatcgaaaaattcaaaaagaagtaaacggaaagtcttgtctcatccacctcctcacgccggcagggcagagcagagcaggtgcagcggatcgacatcgacccatggattcttcggccctcagcaatccgcgtctcatggcgctcattgaggaggagaaaaaaaagggccatggcgaacgagctggtggcgaagctgacgtttgtctgctgggacaagtgcgtgacggggagcgtggggagcagcctgagcaggagcgagacctcgtgcctgtccaactgcgcgaaacgcttcgccgaggtgaagatgatggccctgcagcgcttcaccactaccggccgcggctgaagtcccaaccaccacgcgcgcaaacgcaggcaggcatttctctctctctctctgcctctgcgtggacggagcaatgtgtgtgtggtgtcctctggagtgtgccattgttggtgagatggtagaaaactagaaagacatgtcaatgtatcctatgcattttattttgtttaagacggtgttagaattaagttgattctgagatgttgatgcaacaagtggctgcgtttttttaatagatagaatagattggccgctccaaaaaaaaaaaaaaaaagctatcgataccgtcgacctcgaggggggcccgggtaccattcgccctatagtgagtcgaa

SEQ ID NO: 45239 - protein, 58 aa, Zea mays
  misc_feature: Ceres CLONE 1448854-F
  misc_feature (1)..(55): Pfam Name: zf-Tim10_DDP Pfam Description: Tim10/DDP family zinc finger
MANELVAKLTFVCWDKCVTGSVGSSLSRSETSCLSNCAKRFAEVKMMALQRFTTTGRG

SEQ ID NO: 45240 - DNA, 761 bp, Zea mays
  misc_feature: Ceres CLONE 1448857-F
  misc_feature: Encodes the peptide sequence at SEQ ID NO. 45241
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (404)..(404): n is a, c, t, g, unknown, or other
aagctggagctccccgcggtggcggccgctctagaactagtggatcccccgggctgcaggaattcgcacgagaccattacctagaacatcctaatcgaaaaactccactccactccaaacctccctctctcgatctcgaccaccccccttggaccgcaagccagcccagccgtcccgctccctcggtaagcttccaagcgagtccggcggcgtcgagtcgaatggcgggcaagtcgcacacgcgcaaggcgttcctcctgtgcaactacgtcctcatgggcgccgcctccagctgcatcttcctcacgctgtcgctgcgcctgctgccgtccccgtgcggcctccctctggtcttcnnntcacgcctcaccgccgtcttctccgcggccggctgctcggggtcnttcacggcgccccgcacgccccgcgcagtgggacaacgcgcacaccgcggggggcgcgctccaccgcatttttccagggggccgtcgcgcttggtcggttccacccgcacttcgaattccctggcgagctccaatcctaattccggaacaagaaggggccctcatccctaaaaaggtggggggctttggaccccctttttttcccccaagggggccgggtttgggttccctttcccctcgccttaaaagaaaacaaaaaaaaacctccgggcaaaaaatggggcccccaccttgtttaaccccccaaaggggtgttccctcccaaagaaaataaaaaaaaatttttttttttttccc

SEQ ID NO: 45241 - protein, 117 aa, Zea mays
  misc_feature: Ceres CLONE 1448857-F
  misc_feature (46)..(46): Xaa is any aa, unknown, or other
MAGKSHTRKAFLLCNYVLMGAASSCIFLTLSLRLLPSPCGLPLVFXSRLTAVFSAAGCSGSFTAPRTPRAVGQRAHRGGRAPPHFSRGPSRLVGSTRTSNSLASSNPNSGTRRGPHP

SEQ ID NO: 45242 - DNA, 817 bp, Zea mays
  misc_feature: Ceres CLONE 1448858-F
  misc_feature: Encodes the peptide sequence at SEQ ID NO. 45243
  misc_feature (234)..(234): n is a, c, t, g, unknown, or other
  misc_feature (235)..(235): n is a, c, t, g, unknown, or other
  misc_feature (286)..(286): n is a, c, t, g, unknown, or other
  misc_feature (756)..(756): n is a, c, t, g, unknown, or other
aagctggagctccccgcggtggcggccgctctagaactagtggatcccccgggctgcaggaattcgcacgagaccattacctagaacatcctaatcgaaaaagaaccgatccttacagagagacacacccagcgcgcgagatatctacatcgatcatcatcaccagcgagcgagccggccgagcagcaccgatggcggcgtacatgcgcgtgacgcaccgcgacgaggaaggcnnagaggtgacggagaagatgccggtctcggagacgcggcgcccggacacggncaagcacttcgagcgcaagctggaggagcaggggctcccacgcttcgagcggcaccggggaaccggccccggggcttgggcatccgcgccccccccgcccaattcggggccggggggaaattaacccctggaggccccggagaggtttttaaagaaaattttaacccgggcccccccccctttacccaaaacccctttttaaggggggggggggggggggaaaaaaaaaaaacaaagcccccgggaggggttctcccggaggggggggtctttttttgcccaaaaaaggggagggccccccggggacacccccccccccgccctccccccaaaaaaaaaaaaaaaaggggttttttttgtgagcccccccacccaaaaaaaggtggggggggggtgactattttttgccccaagaaaaagggcccccccccccccacaaaaaaggtgttttttttttttttccccccccncaaaacggcggggggggaaaaaaaaaaaaaaatatttttcctccccccccccgcgcgccgc

SEQ ID NO: 45243 - protein, 72 aa, Zea mays
  misc_feature: Ceres CLONE 1448858-F
  misc_feature (15)..(15): Xaa is any aa, unknown, or other
  misc_feature (32)..(32): Xaa is any aa, unknown, or other
MAAYMRVTHRDEEGXEVTEKMPVSETRRPDTXKHFERKLEEQGLPRFERHRGTGPGAWASAPPPPNSGPGGN

SEQ ID NO: 45244 - DNA, 745 bp, Zea mays
  misc_feature: Ceres CLONE 1448866-F
  misc_feature: Encodes the peptide sequence at SEQ ID NO. 45245
  misc_feature (670)..(670): n is a, c, t, g, unknown, or other
  misc_feature (671)..(671): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
aaagctggagctccccgcggtggcggccgctctagaactagtggatcccccgggctgcaggaattcgcacgagaccattacctagaacatcctaatcgaacatccaaaattcccagtccgcgatacaagaccaatccaatccaatccaatcccagcggaagtggaagcagcttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaggcagctagtagtagatactgtaggttgaccagtgatccacggtgtgtttctcgctttccttttgtctgttgatttctattggctatactacacggtgctgtaaaggatcaattagttctgcctttgaggccctcatttggtgtaaatatttttgataacatggaccatggaaaaaactttcctttgacattttctttnnaaaaaaaaannnaaaaaggaaaaaaaaaaaaaaaaagcttatcgataccgtcgacctcgagggggggcccggta

SEQ ID NO: 45245 - protein, 65 aa, Zea mays; identical to SEQ ID NO: 44442
  misc_feature: Ceres CLONE 1448866-F

SEQ ID NO: 45246 - DNA, 777 bp, Zea mays
  misc_feature: Ceres CLONE 1448870-F
  misc_feature: Encodes the peptide sequence at SEQ ID NO. 45247
  misc_feature (564)..(564): n is a, c, t, g, unknown, or other
  misc_feature (648)..(648): n is a, c, t, g, unknown, or other
aaagctggagctccccgcggtggcggccgctctagaactagtggatcccccgggctgcaggaattcgcacgagaccattacctagaacatcctaatcgaaaaggagcagggcaggggttgcgtctcagttcctggttgtgttgttgtaagctcccaggtttcttctcttcgcgtgagctagctagactagagtgggatcgcgaggaagaaggatgtcgtgctgcggaggaaactgcgggtgcggcagcggatgcaagtgcggcagcgggtgcggagggtgcaagatgtacccggacatggctgagcaggtgaccaccaccaccaccatcatgggtgttgcaccatccaagggcgggttcgaggcggccgccggagctgagaacggcgggtgcaagtgcggcgccgccagctgcacctgcgacccctgcacctgcaagtgaggatgaccgggtgcagcatgcaggccgtgacgatggaggaagtagatcggaaggacacccttcagtttctctagctaaatcaagctctgagagtatgttgtagcagcgtcgtctgtgtttgccngcatgcgtagctagctagctagtggtggtaaacgaataattgtcccctgtctcttccctcctcgccccctgcagtgttgcgtcntgtgggccggccgggtgcatgcacagcacccaggcatggccgctgctatgtaagtgctcgagccagtagcatcgtaactcggtttggtaccgctagaactcgagccagttcgagagtagcctttttaaa

SEQ ID NO: 45247 - protein, 75 aa, Zea mays
  misc_feature: Ceres CLONE 1448870-F
  misc_feature (1)..(74): Pfam Name: Metallothio_2 Pfam Description: Metallothionein
MSCCGGNCGCGSGCKCGSGCGGCKMYPDMAEQVTTTTTIMGVAPSKGGFEAAAGAENGGCKCGAASCTCDPCTCK

SEQ ID NO: 45248 - DNA, 844 bp, Zea mays
  misc_feature: Ceres CLONE 1448871
  misc_feature: Encodes the peptide sequence at SEQ ID NO. 45249
agccgccgcctccctcacgtctctccctcacctcacgtctctctctccctcacgtctccctctctcctctctgttttctctctcccttgctttttctctctcacgcacaagcaggacaggcagcaggcggccgagcgcccgccccaccgcgacgccgcacaggccccgccctgcgcgagcagcgcgctgccgcgccagcccaccgcgatgccgagcgcgcccgacgaccaaacgccgcgaaccgtccatttgaagcctgcggcaccccatgacctccctggcagactcttcttctcccctccttctctctataaatggggacagcagagctctctcttctctcctgcctacccaagcgccccatctctctagctcaccattgcactgctcgacgccgtcgttcgttgctgttcgccggagttcgccgctcgttgccggagcccgtggagttcgccggagtgtgccgttcgtcgccggagttcaccggagccgcgtactagctgtccgtagtcgagccccgctctccgtcgatccgtccccgtcacacgcacgaacccgagaagcggattgtgcggtagacgatccgaactcgttcgaagacgatccgcaggacccgcttgagcaagagggtgatgctggagactttgatggagattttatcgacgacgatgatttctaagtctaacgatgcgccggtcatcttcctgtgggagattgcccagttgtttatttccgctttactttgatgtgatacttgttaaagatacaatgtttcagatgatgtaataaagtattatactctctttaaaaaaaaaaaaaaaaaaaaaaaaaaaaaaaaaaaaaa

SEQ ID NO: 45249 - protein, 136 aa, Zea mays
  misc_feature: Ceres CLONE 1448871
MTSLADSSSPLLLSINGDSRALSSLLPTQAPHLSSSPLHCSTPSFVAVRRSSPLVAGARGVRRSVPFVAGVHRSRVLAVRSRAPLSVDPSPSHARTREADCAVDDPNSFEDDPQDPLEQEGDAGDFDGDFIDDDDF

SEQ ID NO: 45250 - DNA, 690 bp, Zea mays
  misc_feature: Ceres CLONE 1448873-F
  misc_feature: Pfam Name: DUF231 Pfam Description: Arabidopsis proteins of unknown function
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (484)..(484): n is a, c, t, g, unknown, or other
  misc_feature (534)..(534): n is a, c, t, g, unknown, or other
  misc_feature (590)..(590): n is a, c, t, g, unknown, or other
ccccgcggtggcggccgctctagaactagtggatcccccgggctgcaggaattcgcacgagaccatacctagaacatcctaatcgaaaactcttgggtataagcatggttacagagttgatgtggatattcctgaccaaacatgggtagaggcatgtagcttccatgatgttcttattttcaacactgggcattggtggtgggcaccctcgaaatttgatccaatacggtcaccaatgctgttctttgagaaagggagggcaattgtgccctcttttactgccacctgctggactggatttggctctttcaaacatgttaatgttttgcaaacaaagccatgggaaccaaaacctgtgaaatttcttcccaacccaagtcccctaaaaattttcaaaggtggggaactggaacaaaaaggggtttttgtataaaaaaacccggccctttggnnnacccccccttctccaaaaattccccctttnaaaaaaaaaggtttaaaagtgtgggggttgtccccccaaaaaaaaaaacnggggaagagggttttaaaaaacactctttttttaaaagaccgggacaacccccccncaccccaaattttctaaggggggtttccgcccccccccacaacgggggaaaaaaaggggttttttcccccccctgtttttccccccccctctgttgttgt

SEQ ID NO: 45251 - DNA, 745 bp, Zea mays
  misc_feature: Ceres CLONE 1448874-F
  misc_feature: Encodes the peptide sequence at SEQ ID NO. 45252
  misc_feature (411)..(411): n is a, c, t, g, unknown, or other
  misc_feature (412)..(412): n is a, c, t, g, unknown, or other
agtcgtggagctccccgcggtggcggccgctctagaactagtggatcccccgggctgcaggaattcgcacgagaccattacctagaacatcctaatcgaaaaaccaatcttttggcccttcgcttctccgttctcccccaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccacggcgatgggggaggccgtctcctactccggctacnncccccaaaacctcgccgcgtcgctcgggcaccgcttctcctccgcctccgcctcggggagccgcctcctccatgacggcgcctggcgccccttctggatcttcacctccacccgccagcccgagcagcaccgcggcagcggaggcgaccgcatgacggaggcgactacaccacccgaagccccaggcaatcccgccggagctcactccttggtgctcccgcggggggcttttcggccaagtcgcccccccgttccttgcccgggggctgctctcggcgttgccaaaaagcgggacaaaaccctggaccccccgatcgggggttttccctcggc

SEQ ID NO: 45252 - protein, 121 aa, Zea mays
  misc_feature: Ceres CLONE 1448874-F
  misc_feature (11)..(11): Xaa is any aa, unknown, or other
MGEAVSYSGYXPQNLAASLGHRFSSASASGSRLLHDGAWRPFWIFTSTRQPEQHRGSGGDRMTEATTPPEAPGNPAGAHSLVLPRGAFRPSRPPVPCPGAALGVAKKRDKTLDPPIGGFPS

SEQ ID NO: 45253 - DNA, 758 bp, Zea mays
  misc_feature: Ceres CLONE 1448878-F
  misc_feature: Encodes the peptide sequence at SEQ ID NO. 45254
  misc_feature (758)..(758): n is a, c, t, g, unknown, or other
aaaggtggagctccccgcggtggcggccgctctagaactagtggatcccccgggctgcaggaattcgcacgagaccattacctagaacatcctaatcgaaaagcataagacacgggcctacgtccagtcgtccacagatcggaggagagagcactgactcgtctcccttctcgtctccagcgacggcgaaggcgaagcggaggagcgggagcagaaacagaagaggcagccatggccgtgatggagaagctcaagatcttcgttgtgaaggagcctgttgtcgcagcttcctgtctcatcgccggattcggtctctttcttccagcagttgtccggccaatcctggattcatgggagaccgcagaaaaagttcctccaccacctctgagtgatgtggttgcgggtgtcaccggcaacaaaaagtagtgaacttgcattgttttctcatgtcgatgctggcccacattttcttccccatgtttttctggcgtccagattggagggtctccaaagtcccgtctccaaagtgacagcttgcttgattttaaaagaatcgacggtgttttgtctctacccagaatgcagatatacggggtttaaaaagttccctttaatcccaaacgaacaggcttttttttctgaaccttatactgccatgggtcaattttaaaattttccccctaaaacaaagggtgatagaatggcgaaaaaaaaaaaaaaaaagcttttttgtctccgcgccctctcagggggggccn

SEQ ID NO: 45254 - protein, 64 aa, Zea mays
  misc_feature: Ceres CLONE 1448878-F
MAVMEKLKIFVVKEPVVAASCLIAGFGLFLPAVVRPILDSWETAEKVPPPPLSDVVAGVTGNKK

SEQ ID NO: 45255 - DNA, 776 bp, Zea mays
  misc_feature: Ceres CLONE 1448880-F
  misc_feature: Encodes the peptide sequence at SEQ ID NO. 45256
cgcctggagctccccgcggtggcggccgctctagaactagtggatcccccgggctgcaggaattcgcacgagaccattacctagaacatcctaatcgaaaaatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttcgacacgacggccacgaagcaccgccgcccagcggaggagaacatccgcgaggatgctgcgccgcctcccaggcccgggcgagggtttctctgcctggaacaagcccccccccccgcccccgggggggacccaaaaaaagggtattcgtgggaaaaggcccccacccctcccacctggggggccccctcaaggggccccccactggaggggctgggccccccaccccgggggcccaaggggggaaccctttaaacaccccggtggggacaccccggggccataaaggtggggtgtgggtcaaaaaagaattgtgccccccaaaaaaaactaccaaaaatttgtccctctttggggggaacccaactctttggtgggaggcgccgcgcgcagaacccccgggggagaaaaagctcggcgcgcgaggagcggtctcccccccgatccctcaaaaagatcccgcgagggct

SEQ ID NO: 45256 - protein, 142 aa, Zea mays
  misc_feature: Ceres CLONE 1448880-F
MATFTAASSLSLLFSHPHSHSRQPSAQGPTASSHLHLHPRASRARCASSTRRPRSTAAQRRRTSARMLRRLPGPGEGFSAWNKPPPPPPGGTQKKGIRGKRPPPLPPGGPPQGAPHWRGWAPHPGGPRGEPFKHPGGDTPGP

SEQ ID NO: 45257 - DNA, 766 bp, Zea mays
  misc_feature: Ceres CLONE 1448885-F
  misc_feature: Encodes the peptide sequence at SEQ ID NO. 45258
ggagctccccgcggtggcggccgctctagaactagtggatcccccgggctgcaggaattcgcacgagaccattacctagaacatcctaatcgaaaaacctcaccaaccatcactcacccagtcaccctccataactcttctcctcctctctcccagtctcactcccctcacttcgtgcatggtcttcagagtagtagagagagcaggaggaggagcacgagagaggagcagcgaagaagaagaagaagagcagcaggcagcttccgatgtgctgctacgtgggcaaggccaccaagatcttcctgtgcctcgtggcggcgctcctggtcgcgggcctcgtcctcggcttcggcctggcccgccacacgtggggagccgaaaggacccggcagcaaccggactgccgctggcccgactgccagcagcagcaccagggcggcgaccccccgctcgtcccggatgccgtcaccacgcagcccaacccgctcacgcagccggccgtcgccgcgttccccggtgccaccgccaccccgtcgccgtccgccgccgtcgccgcgccgcccacgggcgtgccgtactttggaccacctggcccgttcgtcgtgggcctcggcccagctgctcatgcgtgaggggggctgtcttttttcttttttttccttacttttgctcgaagtcctctcccttctggaatcagtgcttcagaattgtttattattactgaaaccattttttataggtttccctagtttttgaccccgttcgc

SEQ ID NO: 45258 - protein, 121 aa, Zea mays
  misc_feature: Ceres CLONE 1448885-F
MCCYVGKATKIFLCLVAALLVAGLVLGFGLARHTWGAERTRQQPDCRWPDCQQQHQGGDPPLVPDAVTTQPNPLTQPAVAAFPGATATPSPSAAVAAPPTGVPYFGPPGPFVVGLGPAAHA

SEQ ID NO: 45259 - DNA, 751 bp, Zea mays
  misc_feature: Ceres CLONE 1448887-F
  misc_feature: Encodes the peptide sequence at SEQ ID NO. 45260
gctggagctccccgcggtggcggccgctctagaactagtggatcccccgggctgcaggaattcgcacgagaccattacctagaacatcctaatcgaaaaaccgcaccgtccaaaaaaaccctcacccaccctcgactcccactctcgccgccggagtgaggggctgagcacagaaccgggcaatccccccccccccccccccactcttcctcgccgctgccagatgctccgccgcagcctccccgaggccgggtccttcttccgccggctccttggccgcgtctcgaacgagggcgggcttgctgccggctcctccgcgtctgtccgacatttcgtcgaacagcttgtaggcggcacggccccgatctcccgcgtcccctccgccctcgccgtcgcctccgcggagcgtgggaccggaggaagcaacggcgcttccttgacggtccacttccttcgccactcctgcggcctcgaagaagccgacgccgcgaaggcggccgagcgcgtgcacctccgctccaccaagaacgcgcacgccgtggtcgcgctcctccgcgacacgctcggcatgccccccgcctccgtcgcgcgtctcgtctccgcgtaccccgcggtcttttctcggtccactcggcgctaagttgaacttctactccgcgagctcggcctctcctccgcgagttgcgcgcttcctctcgcgagccccaccgctccctctcgcgggatcagactcgctgcgccccactcagct

SEQ ID NO: 45260 - protein, 138 aa, Zea mays
  misc_feature: Ceres CLONE 1448887-F
MLRRSLPEAGSFFRRLLGRVSNEGGLAAGSSASVRHFVEQLVGGTAPISRVPSALAVASAERGTGGSNGASLTVHFLRHSCGLEEADAAKAAERVHLRSTKNAHAVVALLRDTLGMPPASVARLVSAYPAVFSRSTRR

SEQ ID NO: 45261 - DNA, 704 bp, Zea mays
  misc_feature: Ceres CLONE 1448888-F
  misc_feature: Pfam Name: LMBR1 Pfam Description: LMBR1-like membrane protein
  misc_feature (639)..(639): n is a, c, t, g, unknown, or other
ggagctccccgcggtggcggccgctctagaactagtggatcccccgggctgcaggaattcgcacgagaccattacctagaacatcctaatcgaaaatgctaatggatggaaatatgtatcaagttttagtgaaagtcgctcgggcacacttggatcaattttggacactatcgagttcatttggtgctgtatactgagaaagcagcttcaaaaagcatttgctgttatccttggctgcatgtcagctgctatactgctggctgaagctactttacttccaagtggtgttgatctatctctcttttctattcttataaaagctgtaggaaaacaagaggttttagttcaggttgctgcttttgtccccttgatgtatatgtgcatttgcacatattattcattattcaagattggcatgttgatgttctattctctgactccaagacaaaccagctctgtcagcttgcttatgatctgttcaatggtgcaagatatgcacctcctatttcttataactttctgaatctcatccgccttggtggcaatgctaaaactacatttgagaagagaatggggaacattgatgatgcagtttctttctttggcagagcttcaacagatctatccactgattatggnttgttaacactattggttgctagtaatgtctttgttcgggtgattgactttttgggaagatggaa

SEQ ID NO: 45262 - DNA, 760 bp, Zea mays
  misc_feature: Ceres CLONE 1448892-F
  misc_feature: Encodes the peptide sequence at SEQ ID NO. 45263
  misc_feature (565)..(565): n is a, c, t, g, unknown, or other
  misc_feature (698)..(698): n is a, c, t, g, unknown, or other
aagctggagctccccgcggtggcggccgctctagaactagtggatcccccgggctgcaggaattcgcacgagaccattacctagaacatcctaatcgaaaaaacctctgtctcgtgagagacctcgtccgtcgcgcccgaggcgaggaagcaacccgccccagtttcacgctatggcgacggcgacgtcatcgaggcgcgtgtcggtgccggccctggcggccgccgccgtgctcctgctcgcgtccgtagccgcggccgacgaccacaacggcgtctacgacccctgcgcggacgcgtcggtgcagcgcggcgacgggttcaccttcggggtggtcttctccgggcgcgactccttcttctccggcggcgtgcagctctccccctgcgacagccgcctcgggctcgccaaccgcgcgcaggtcgcgctgttccgcccccaggtcgacgagatttcgctcctcaccgtcaactcctcctccttcgacccgtcttcttctggtgtgtacatggtggctttcgccgggaagaatacgcagcgaggtcaccccctgtgttcgtcggcnacatctcgtacacggtgaccggcttcaccctggtcctggagttccagaaggcacgctccagaaactgttctggaaggcggcgggtgctcgtcgtgctccggcgctccgactcccgtgcgtggaggcagctgcncggtcagacggcaagctgcggggcaagggcgggcagtgagtgcaccccgggatcagctcgcg

SEQ ID NO: 45263 - protein, 136 aa, Zea mays
  misc_feature: Ceres CLONE 1448892-F
MATATSSRRVSVPALAAAAVLLLASVAAADDHNGVYDPCADASVQRGDGFTFGVVFSGRDSFFSGGVQLSPCDSRLGLANRAQVALFRPQVDEISLLTVNSSSFDPSSSGVYMVAFAGKNTQRGHPLCSSATSRTR

SEQ ID NO: 45264 - DNA, 752 bp, Zea mays
  misc_feature: Ceres CLONE 1448896-F
  misc_feature: Encodes the peptide sequence at SEQ ID NO. 45265
ctccccgcggtggcggccgctctagaactagtggatcccccgggctgcaggaattcgcacgagaccattacctagaacatcctaatcgaaaaaaccgcgtcgccgaaggccggaaccatgaagcctgtcagtgtcgccgaacacaacaaccaccagcctcgcctgcactcccccacgccggcgtcggcgaccaagatctcgatccccatctcttcgagcgaggcggcgctgttcgggaagggtaggtacaaggtgtgggccctcgcggccatcgcgctcctagcgctctggtccatgttcgccgcctccgtcacgctgcgcttgtcctccgtcgatctcgccaccacgttcggggacgcgagcgatccgctcatcgacgaacttgatcccctggagatggagcaagagaaaagctattgcgcccgatgtgggatgtgtccacccgccagataatctggacggctaccccggtcttggcaagagcatttgaggctgctatgaggagcttgcgggggagaaacccttacacggagccccttaactgaaattgcccgagtggcaacccaagggcccggggtgaaaccctccccaaaagggtttgcagacccagggaccggccaaatttttggaggggggaacgggccccccaaggggagaaaactaaaatgggggccccccctaaaaaaggggtgtttaaatttccccccttcccccccaacatttggagggggtggggggaaaaaaaacacatt

SEQ ID NO: 45265 - protein, 111 aa, Zea mays
  misc_feature: Ceres CLONE 1448896-F
MKPVSVAEHNNHQPRLHSPTPASATKISIPISSSEAALFGKGRYKVWALAAIALLALWSMFAASVTLRLSSVDLATTFGDASDPLIDELDPLEMEQEKSYCARCGMCPPAR

SEQ ID NO: 45266 - DNA, 730 bp, Zea mays
  misc_feature: Ceres CLONE 1448899-F
  misc_feature (216)..(216): n is a, c, t, g, unknown, or other
  misc_feature (253)..(253): n is a, c, t, g, unknown, or other
  misc_feature (316)..(316): n is a, c, t, g, unknown, or other
ggagctccccgcggtggcggccgctctagaactagtggatcccccgggctgcaggaattcgcacgagaccattacctagaacatcctaatcgaaaagcatcgccgccccccgtcccgacgaattggaatacggaaagcgaaagatgatggatctcgccgacccccagcagcagcagcggctcatcgccggcgcggcgctgctgctggcaaccgcgnccttctcaggctcatcctgggctcccgctccggggcnggcagcgcctgccgcccacatcccgggggcgccggtgtcggcggctcgtcaagtcatgccggncccatcccatgatccggagcagtacgcccgcctgggagcgcctccacgtcccataatccccgaaggatccgttcctcgccgccctaaggttcgccccttctttaaggcaccaggcccaaatgccccccggggggtacgggttaacggcccctttgggcccggggtgtttaaaataaaaatcccgggggggaaatttggttttttaggggcccccggaaaaaattccccatttttacaaaatgggtggggggggaaagcccctccaaaggggaaaaaggccctttttttataaatttttggcccccccttttttaaaccccccctttttttcgggagggggaaaaaaaaaactccaaatttttttccttcccccccccggaagggggggggaaaaaactttcttccccccccccc

SEQ ID NO: 45267 - DNA, 758 bp, Zea mays
  misc_feature: Ceres CLONE 1448900-F
  misc_feature: Encodes the peptide sequence at SEQ ID NO. 45268
  misc_feature (416)..(416): n is a, c, t, g, unknown, or other
  misc_feature (575)..(575): n is a, c, t, g, unknown, or other
  misc_feature (580)..(580): n is a, c, t, g, unknown, or other
  misc_feature (603)..(603): n is a, c, t, g, unknown, or other
  misc_feature (692)..(692): n is a, c, t, g, unknown, or other
aagctggagctccccgcggtggcggccgctctagaactagtggatcccccgggctgcaggaattcgcacgagaccattacctagaacatcctaatcgaaaatttaaaatgaaatttggacatcatggcgggaatcaccctgtctgtgatctccgtagtggacgtgtagacataagtgcacagaaccataactacgcagttgacccagaatcactcccagaaggagcaaaagtaactcacgtcaatctcaacgataatagctgcgctggcctccagtactccaagatgaagcttatgtctctccagtaccatcccgagtcttcccctggtccgcatgactccgacacagccttcggcgagtttatagagctcatgaagagcaacagattgtaagaaaggggatcaggggagtacttngaaaggtcaataattgtattggtgctccctcgcaccaaccctcaaagatttgttgtatctgtagtggttttcttttggttttgggacgttcatgtgcttgaatttttggggtcagaagacatagcataagatgctctgcgcattgtaccatgaaatggnctggnttgatttcgtgaagatacatgtncatcaactgtacggtacggtacactcactcggacagcggctcgcgaatttcttagccgcaggtaaagtcgtcagtggatggccatgaangccggtcagtggatgctttacttttgttgttccagctatcagaatggcacgacgttgttgcatcaa

SEQ ID NO: 45268 - protein, 129 aa, Zea mays
  misc_feature: Ceres CLONE 1448900-F
  misc_feature (1)..(123): Pfam Name: GATase Pfam Description: Glutamine amidotransferase class-I
  misc_feature: SWISSPROT Homolog: EC 6.3.5.5 Carbamoyl-phosphate synthase (glutamine-hydrolyzing)
AGAPRGGGRSRTSGSPGLQEFARDHYLEHPNRKFKMKFGHHGGNHPVCDLRSGRVDISAQNHNYAVDPESLPEGAKVTHVNLNDNSCAGLQYSKMKLMSLQYHPESSPGPHDSDTAFGEFIELMKSNRL

SEQ ID NO: 45269 - DNA, 736 bp, Zea mays
  misc_feature: Ceres CLONE 1448901-F
  misc_feature: Encodes the peptide sequence at SEQ ID NO. 45270
  misc_feature (413)..(413): n is a, c, t, g, unknown, or other
ctggagctccccgcggtggcggccgctctagaactagtggatcccccgggctgcaggaattcgcacgagaccattacctagaacatcctaatcgaaaaactcgctccacttccattcccagcgaccccgcccgcccggaggcgtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggctacgggaccgtgggcgggcccacggncacgccatcgctccccgcacagacaccaagtccaccgccgtcgagaccaccgtcgagagggtgatcttcgacttccggttcctggcactcctcgccgtcgccgggtcactcgccggctccgtcctgtgcttcctcaatggctgtgtcttcatcaaagaagcgtaccaggtttactggtcgagctgtgtccagggggttcatacggggcagatgtccctcaagtcgtcgagggcatcgatgtgtatcttgctggaccagcatgctgaaatttgggagggtctctacggccctctcatcagaacgctcccgccggtgttcctctg

SEQ ID NO: 45270 - protein, 244 aa, Zea mays
  misc_feature: Ceres CLONE 1448901-F
GAPRGGGRSRTSGSPGLQEFARDHYLEHPNRKTRSTSIPSDPARPEASHLHAAAAAKPLSSRAASATQTPDGAPAAARLRRAASRPRGPGGVPAAPSGAAAAAARGRRLFGLLRSVRRGGVVVPGRPRLRDRGRAHGHAIAPRTDTKSTAVETTVERVIFDFRFLALLAVAGSLAGSVLCFLNGCVFIKEAYQVYWSSCVQGVHTGQMSLKSSRASMCILLDQHAEIWEGLYGPLIRTLPPVFL

SEQ ID NO: 45271 - DNA, 730 bp, Zea mays
  misc_feature: Ceres CLONE 1448905-F
  misc_feature: Encodes the peptide sequence at SEQ ID NO. 45272
  misc_feature (539)..(539): n is a, c, t, g, unknown, or other
  misc_feature (723)..(723): n is a, c, t, g, unknown, or other
ggagctccccgcggtggcggccgctctataactagtggatcccccgggctgcaggaattcgcacgagaccattacctagaacatcctaatcggaaaattccttccattttacccctccgtccgtctctcacactgtctctctccaccttctcgctctccgacaaggcgacgacgggtaggccaccgccgccggcgccgtcccactacgacaactgctgaggccttcatcgctttcttcgccggcgacgagcacccaccaactaaggtcatggaagagatgatagatctaacgggggatggaggtgttcttaagacagtagtgcggaaagcaaaagaatgatgctatagcgccatccgagagcctgcccttggttgatgttcattacaaaggtacacttgctgagactgccgaagttttcgataccacccatgaagataactctattttctcattttgaattggacaaggcgctgtcatcaaagcatgggatatagcccttagaactatgaaggttggcgaggttgcaaaaattacatgncaatcagaatatgcatatggagctgcaggctcaccaccagagatacctcctaatgccacccttatttttggagtggagctagtagcttgcaggcccgagaaaaggttcagcttaggtagtgtatctgatgagaaagccagactttgagaacttaagaaagcacgggagctagctgctgctaccnaagagaa

SEQ ID NO: 45272 - protein, 59 aa, Zea mays
  misc_feature: Ceres CLONE 1448905-F
  misc_feature: SWISSPROT Homolog: EC 5.2.1.8 Peptidylprolyl isomerase
  misc_feature (11)..(11): Xaa is any aa, unknown, or other
MKVGEVAKITXQSEYAYGAAGSPPEIPPNATLIFGVELVACRPEKRFSLGSVSDEKARL

SEQ ID NO: 45273 - DNA, 756 bp, Zea mays
  misc_feature: Ceres CLONE 1448909-F
  misc_feature: Encodes the peptide sequence at SEQ ID NO. 45274
  misc_feature (518)..(518): n is a, c, t, g, unknown, or other
  misc_feature (523)..(523): n is a, c, t, g, unknown, or other
  misc_feature (556)..(556): n is a, c, t, g, unknown, or other
ctggagctccccgcggtggcggccgctctagaactagtggatcccccgggctgcaggaattcgcacgagaccattacctagaacatcctaatcgaaaaaatttccaagagagacagagagagcgtgtggatttgggggagcttcttcactggagagtggagagctccggtagcgaggcgaaggaaggaagagggaggaggggaatcagagaggtctccccgatggcggactggggccccgtgatcgtagcgacggtgctgttcgtggtcctcacgccggggctgctctgcacgctgcccgggccggggccgcgtcgcagagttcggcagcatgcacaccagcggcctggcccatcctcgtcacgccgtcctctacttcgcgctcatcagcatctttctcatcgccatcggcatccacgtctacgcgggctagtagccgcccggagcaggatgcgatatacggagtagtaggttgcgccgcccgcgtgatccagatcaagatctgtttttttttccttngtccnttttcgctctctctctctctctgccctcctccntcgatttgctgccagtatggacgaaatcattgattatgtctggacgtctgcttgtatccatcatgacttgtgaaatctggctgccgccatcgtatcgatcaaaaaaaaaaaaaaaagctatcgataccgtcgacctcgagggggggccgggtaccaatccgcctaagtgagtcgaatacccgcgctccctgccgctttta

SEQ ID NO: 45274 - protein, 33 aa, Zea mays
  misc_feature: Ceres CLONE 1448909-F
MHTSGLAHPRHAVLYFALISIFLIAIGIHVYAG

SEQ ID NO: 45275 - DNA, 759 bp, Zea mays
  misc_feature: Ceres CLONE 1448911-F
  misc_feature: Encodes the peptide sequence at SEQ ID NO. 45276
  misc_feature (365)..(365): n is a, c, t, g, unknown, or other
  misc_feature (759)..(759): n is a, c, t, g, unknown, or other
tccccgcggtggcggccgctctagaactagtggatcccccgggctgcaggaattcgcacgagaccattacctagaacatcctaatcgaaaaaattctgaaataagagaacctttactactgttcactcagaggacccgcctccctgaattcctcgccgccgtcttcgtccaccagaaccatggcctccgacaccgcctcggcagttccgtcgtctgtggtctcagctgccgaggagacgctcggatataccgaatccgtaggggaccatctctcccatctgctcgcggcggcggcggcggaccccgacgccgtggccgagctcccaccccttctccgggcgcgcgctttccttgccttggcgcangccgcgacctcccttctcggagttcgtttaaggtgttcgggagttgaccctgacgagcaccccatcagaaaggagtttgaaaagttaagcctattgcaggagaagttaaatcaatttgagaactgggacaaagcaccacttcgcccttctactacactaaatacacaagcagcagcaaagttcattggacactcactttcccatctgacatctgatcagaggaagagcatgcatgaaataagtaaaggaaaaaggcggatttgggctgggcaaaaaaaaaaccttgaccttcaataaaaaaaaatgctgttcgtgctgctgcaaaaaagtcctttgaaaggcttctcaggacttatggaaatagtgaaaacggggcaaaggccctgttatctcn

SEQ ID NO: 45276 - protein, 160 aa, Zea mays
  misc_feature: Ceres CLONE 1448911-F
  misc_feature (16)..(97): Pfam Name: Sas10_Utp3 Pfam Description: Sas10/Utp3 family
  misc_feature (62)..(62): Xaa is any aa, unknown, or other
MASDTASAVPSSVVSAAEETLGYTESVGDHLSHLLAAAAADPDAVAELPPLLRARAFLALAXAATSLLGVRLRCSGVDPDEHPIRKEFEKLSLLQEKLNQFENWDKAPLRPSTTLNTQAAAKFIGHSLSHLTSDQRKSMHEISKGKRRIWAGQKKNLDLQ

SEQ ID NO: 45277 - DNA, 749 bp, Zea mays
  misc_feature: Ceres CLONE 1448913-F
  misc_feature: Encodes the peptide sequence at SEQ ID NO. 45278
  misc_feature (504)..(504): n is a, c, t, g, unknown, or other
  misc_feature (505)..(505): n is a, c, t, g, unknown, or other
  misc_feature (552)..(552): n is a, c, t, g, unknown, or other
  misc_feature (583)..(583): n is a, c, t, g, unknown, or other
  misc_feature (694)..(694): n is a, c, t, g, unknown, or other
  misc_feature (710)..(710): n is a, c, t, g, unknown, or other
tggagctccccgcggtggcggccgctctagaactagtggatcccccgggctgcaggaattcgcacgagaccattacctagaacatcctaatcgaaaaccattctctctctttctcctgttccccgcgagagtcgctcaaggccgcggcgaggagaagcggcagcgcgtcacctctccaatggcatccccgtccttcctccgtgcaacctgtgcaccctcatgaggactagttcactccctgctgtcattgaggcttctggcaatgatgactggaagaaacgaaaggaagcacagagcctgaagaggctcgaggttaagaagaagaggattgagaggaggaactctctcacctgcaacacttcaaaagaagctgctgggcagagtccagaagagatgaatgcaaacactgacaaattagtaagttctgatgaaactattgccagcgctaacgaaagccatagcagtggcaagcatctggtgaaggggcttccaccaaagtaccanngctacattacatcacaagacagttcgtcagcaatgcgaaagaagccnaactcggccttcaaggaacagccatcactgnagagcagaactcgtcatcgtctgttccttcctccgtgaaagctatagtagcgtgacggcacaagtctgcctgcgttgtctttggtcccatacagcaccccttggtccaggnaaagacaagcatttangcagggctggtgcaaggcaaacgcatggggacgtgaaaa

SEQ ID NO: 45278 - protein, 133 aa, Zea mays
  misc_feature: Ceres CLONE 1448913-F
  misc_feature (95)..(95): Xaa is any aa, unknown, or other
  misc_feature (96)..(96): Xaa is any aa, unknown, or other
  misc_feature (122)..(122): Xaa is any aa, unknown, or other
MRTSSLPAVIEASGNDDWKKRKEAQSLKRLEVKKKRIERRNSLTCNTSKEAAGQSPEEMNANTDKLVSSDETIASANESHSSGKHLVKGLPPKYXXYITSQDSSSAMRKKPNSAFKEQPSLXSRTRHRLFLPP

SEQ ID NO: 45279 - DNA, 747 bp, Zea mays
  misc_feature: Ceres CLONE 1448914-F
  misc_feature: Encodes the peptide sequence at SEQ ID NO. 45280
  misc_feature (469)..(469): n is a, c, t, g, unknown, or other
  misc_feature (678)..(678): n is a, c, t, g, unknown, or other
ctccccgcggtggcggccgctctagaactagtggatcccccgggctgcaggaattcgcacgagaccattacctagaacatcctaatcgaaaagattcggaaaacctccaaggctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtncacaacctcggtaccatcgccaggtccgggacccaaggagtcatggaagcccttgctgctggcgctgatgtgtctatgattgggcaagtcggtgtcggtttctactctgcctacctcgtcgacgagagggtcgtcgtgaccacccagcataacgatgacgagcagtacgtgtgggaatccaaggcgggcgggtcgttcactgttactcntgaacgtctggggagccacttggcaggggactaagattacacttttcctcaaggagatcagttagataa

SEQ ID NO: 45280 - protein, 172 aa, Zea mays
  misc_feature: Ceres CLONE 1448914-F
  misc_feature (28)..(165): Pfam Name: HATPase_c Pfam Description: Histidine kinase-, DNA gyrase B-, and HSP90-like ATPase
  misc_feature (162)..(162): Xaa is any aa, unknown, or other
MATETETFAFQAEINQLLSLIINTFYSNKEIFLRELISNSSDALDKIRFESLTDKSKLDAQPELFIHIVPDKASNTLSIIDSGIGMTKSDLVHNLGTIARSGTQGVMEALAAGADVSMIGQVGVGFYSAYLVDERVVVTTQHNDDEQYVWESKAGGSFTVTXERLGSHLAGD

SEQ ID NO: 45281 - DNA, 829 bp, Zea mays
  misc_feature: Ceres CLONE 1448916-F
  misc_feature (486)..(486): n is a, c, t, g, unknown, or other
  misc_feature (701)..(701): n is a, c, t, g, unknown, or other
aagctggagctccccgcggtggcggccgctctaccactagtggatcccccgggctgcaggaattcgcacgagaccattacctagaacatcctaatcgaaaaaggaaaagcaagaaagtcatacacatacacacacgcatccgcagcactccctcctcggtccctcctctgcttcacacagaccagtgcgcgctcaattcccccctctagcgcctccaccgcaccaaaccggtccaacgggacctatgctctagcctcagagcaaaccaccgcctgaattgggcggcaattgggggaggattcgcggcaggcagggcgcggatccctttgccggaatgattgcggctgtcaacagattgccggcgggttgggggcaaaataaaaatgtcaggcccccaaagaaaattaaaaccccccccagggggaataaccgggaccaaagtccggcgctcctcggcattgccaccccctccccgaaaaaaaaccncacagtcctccaaacaaacgcattgggctgggccctctaccaaaggcaaaaaaaggctaaagcctcccctgagacattgcttctaattgtggaaaaaccccccatccggcccccaccagagtgattaaacaatttacccacttccgcaaaacacccccacgcgaaacgaagttaataatcggcccccgcagaaattttacctaactcccaaaacnccccgacccgccccaacacacactcgcgctactaggatcttttccccaaaaaaaacacacacgaccgttctaagggcacgttgtggacaccccccccaaaggtgcacttgtaactccctatcccctag

SEQ ID NO: 45282 - DNA, 768 bp, Zea mays
  misc_feature: Ceres CLONE 1448917-F
  misc_feature: Encodes the peptide sequence at SEQ ID NO. 45283
  misc_feature (281)..(281): n is a, c, t, g, unknown, or other
  misc_feature (292)..(292): n is a, c, t, g, unknown, or other
  misc_feature (295)..(295): n is a, c, t, g, unknown, or other
  misc_feature (307)..(307): n is a, c, t, g, unknown, or other
  misc_feature (324)..(324): n is a, c, t, g, unknown, or other
gcggtggcggccgctctacaactagtggatcccccgggctgcaggaattcgcacgagaccattacctagaacatcctaatcgaaaaacgggctggtttcgcgggccgaccatggggacgctcatccggccggggcccgccgcgtcgcctctccccatcgcttccccctcctcctcatccgcccacgtggctgtcgttggcggtggtgcgaggagcttgcggcatcgggtgtcggtgggcgtgggcgtgtcccggtccccgagtacgcaggttctggcgacnaagatgcgccnccngagaagtatggntgtgcggtcggatgtcntccccggtgccgcacccgccgcggcagctggggattcgacccggggcgctccaagtcagcaaatgggttccaaaaccaaaaggggtttgcttccatttgggggactggaagtgcagcaacccttttggttggaaccaaagttggggggtcaacccattggggttgccattttacccgggcccgaggaaaaccccaacccaccctcccaaaattggggggcacggggaaaaatccccgggtttcaaaaacttggggggggagaagaaaggaaaaaaccccccccacaaaaagggccgggggggttttgtggtcaaacccaaaaactctctggaaattaatccccccccccacaacggggggggggtgcataaattaaaagaaaaacaccacacttttttgtttccccaaataaagggggggaaagatttttctgtgtggggattc

SEQ ID NO: 45283 - protein, 183 aa, Zea mays
  misc_feature: Ceres CLONE 1448917-F
  misc_feature (61)..(61): Xaa is any aa, unknown, or other
  misc_feature (62)..(62): Xaa is any aa, unknown, or other
  misc_feature (66)..(66): Xaa is any aa, unknown, or other
  misc_feature (72)..(72): Xaa is any aa, unknown, or other
MGTLIRPGPAASPLPIASPSSSSAHVAVVGGGARSLRHRVSVGVGVSRSPSTQVLATKMRXXRSMXVRSDVXPGAAPAAAAGDSTRGAPSQQMGSKTKRGLLPFGGLEVQQPFWLEPKLGGQPIGVAILPGPEENPNPPSQNWGARGKIPGFQKLGGGEERKKPPPQKGPGGFCGQTQKLSGN

SEQ ID NO: 45284 - DNA, 849 bp, Zea mays
  misc_feature: Ceres CLONE 1448919-F
  misc_feature: Translation starting site: 206
  misc_feature (727)..(727): n is a, c, t, g, unknown, or other
agctccccgcggtggcggccgctctagattagtggatcccccgggctgcaggaattctcacgagaccattacctagaacatcctaatcgaaaaccaccacaccacacgcgccgtaaagcagagcacggggcctgagagcagagcgccaccagccatcctttgcctgcccaagcagcaagcagcatcagcaacggcggctggcccgatggctctgtctctctccggcacctccgcccgcttcgccctcgcgtcactggtcccccgggccagggcctacgcggcgtcggcggcgtccgggggcatcaggcgcgcagctgagggcgcggccccgggcgaggccaatgaggccgggagcgcctgtagtgttggttgaccaaggctcgtggttgccccaaccccgtaactggccccccccctctcttttcaattggggtgggtcgccgtccaacccccccaaacctgcggggccgcggcacttccccccggcacctaaccccccgggcctgaaccgggcccccggtctcccttttccacccttggttcgcgccccgccatacgtcctccggaaggaacattcccccgccacccgtaacccaaggattgaacaacaaaggcctaagggggcccgccgtctcccttgtggtgctaaccggcagtgttatgagacaaactacgcgcgctccttccttttaacctgccgagaacaccttcttttgaaaaagacgcnagcgaaggtttctttttctctttctcggtcgcggcgtccgactaaaacgcgtccggcaccagggtattgggatagatacactgtgataaatttctgggctctccaacccagcaagaacaaag

SEQ ID NO: 45285 - DNA, 760 bp, Zea mays
  misc_feature: Ceres CLONE 1448923-F
  misc_feature: Encodes the peptide sequence at SEQ ID NO. 45286
  misc_feature (522)..(522): n is a, c, t, g, unknown, or other
  misc_feature (559)..(559): n is a, c, t, g, unknown, or other
  misc_feature (580)..(580): n is a, c, t, g, unknown, or other
  misc_feature (725)..(725): n is a, c, t, g, unknown, or other
ggagctccccgcggtggcggccgctctataactagtggatcccccgggctgcaggaattcgcacgagaccattacctagaacatcctaatcgaaaaacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagcccactcgcctccgccacccccggcgcgcgtcgcgatttccctgtacggctgctgctccaggcatctgcactcgcggcgcgccggcgcgccttggccgtgaccgtgagggcccaaagcgacgacgccgaggccgaggcaaaggaggaggcggcgccggccaccaccccggcgccaaagtccaaggcggcggcgacggcgagccccgggctgtgggacgcgctggcgttcagcggcccggctcccgagcgcatcaacggccgcctcgccatggntggcttcgtgtcggcgctcgccgtcgaagcgtcccgncggcggggcctcctctcgcangccggcagcgggtccgggctcgcctacgttcgcggcaacgctgccgtgctgtccgtggcctcgctgttgccgctgctcaagggccgacagcgccgaagccaggagcggcgccctcatgagcgccgacgccgagctctggaacggncgcttcgccatgctcggtctcgtcccgctcgcctt

SEQ ID NO: 45286 - protein, 180 aa, Zea mays
  misc_feature: Ceres CLONE 1448923-F
  misc_feature (101)..(101): Xaa is any aa, unknown, or other
  misc_feature (120)..(120): Xaa is any aa, unknown, or other
  misc_feature (169)..(169): Xaa is any aa, unknown, or other
MAATVMASMSPLASATPGARRDFPVRLLLQASALAARRRALAVTVRAQSDDAEAEAKEEAAPATTPAPKSKAAATASPGLWDALAFSGPAPERINGRLAMXGFVSALAVEASRRRGLLSXAGSGSGLAYVRGNAAVLSVASLLPLLKGRQRRSQERRPHERRRRALERXLRHARSRPARL

SEQ ID NO: 45287 - DNA, 831 bp, Zea mays
  misc_feature: Ceres CLONE 1448924-F
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (473)..(473): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (483)..(483): n is a, c, t, g, unknown, or other
gagctccccgcggtggcggccgctctagaatagtggatcccccgggctgcaggaattcgcacgagaccatacctagaacatcctaatcgaaaaaagacgtacaagcacacggccaccgaaccaagcaagcagcatcggaccagcgggcgcatcgatcgagccagtactcctcgaccggcccggccatagaagcataataacactacagggggtgtgcagcggagaggtaaatggcaagcgggagcggtaacggcaaacgcgtcttcgtgggcgggtgctattaacgttcgcaccgtgaagcggctcaagaccaggccggcctgggccgttggaactaacggttccgggaggggggttatggggtggcccagaagggcaggggcacgcgttattgttttataacccccccggaaggggccaccggaagcgccccaccccccccccctggtttatccctcccccnnnctttccgnggggnnnngnaaaagaagaaaacgccagcccatcaaccaggaagtaagaaatccccgggagggtccatgtgacacccaacacaactgggggcgtccccttatgcgctggggcccctaccaaaactatcacatttactgggtgtattcgctgcgaggacagcccaaaaccccaaatatgggggggggccccgggcaaacaacctttaaagaagcgagatcacctttggtgaccccccccccacctctcttgttagcacaagatacctactccactaagcccgtccccttggggggataaatcaccccacttctcgcccactatatatagggaggctccaccaaatagatcggcacatgg

SEQ ID NO: 45288 - DNA, 782 bp, Zea mays
  misc_feature: Ceres CLONE 1448925-F
  misc_feature: Encodes the peptide sequence at SEQ ID NO. 45289
  misc_feature (375)..(375): n is a, c, t, g, unknown, or other
aagctggagctccccgcggtggcggccgctctagaactagtggatcccccgggctgcaggaattcgcacgagaccattacctagaacatcctaatcgaaaaatcgcttccttgtccatcctacctccccttccccccgcccaaatcccgtgacggtcgccgcccccgccgtgctctcgcccgcgcgggagacgacgcagcacccccccgcgtaggatccgcggcggtcggcaggatggtggtggccacggaggagatggtggtctactgctttgacaccctcgtcgcctatttcaccggcgagcggccgccgcctcccgccttcgaggatggaaaccacccattgttttgtgacttgaaagaggctgccaatggntcaaaaccacgcctccggggatgcataggaactctggagtcccgtcagattgtcagcgggcttagggactacgccctaactagtgcgctgagggaccgacgcttttccccaatacaatcaaaggaactccccacccttggagtgcacggaatctatactcactgattatgaaatttgcaaaggacttccctcgactgggaaggttggaaaccttgggtttaattatttgaatttaccgcttcccaactccaaccacaaaacacagtggccacctatttgccttgaatttgcggcccctgaaaggttgacacccttttagaaacttattgatttccctcgggagggaaaggagggttaccagaagaacccttccctgggtcccttgaggaaagaaaaattcaattccc

SEQ ID NO: 45289 - protein, 101 aa, Zea mays
  misc_feature: Ceres CLONE 1448925-F
MVVATEEMVVYCFDTLVAYFTGERPPPPAFEDGNHPLFCDLKEAANGSKPRLRGCIGTLESRQIVSGLRDYALTSALRDRRFSPIQSKELPTLGVHGIYTH

SEQ ID NO: 45290 - DNA, 783 bp, Zea mays
  misc_feature: Ceres CLONE 1448930-F
  misc_feature: Encodes the peptide sequence at SEQ ID NO. 45291
  misc_feature (261)..(261): n is a, c, t, g, unknown, or other
  misc_feature (287)..(287): n is a, c, t, g, unknown, or other
  misc_feature (297)..(297): n is a, c, t, g, unknown, or other
  misc_feature (300)..(300): n is a, c, t, g, unknown, or other
aagctggagctccccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgccctacacaaggatcccagccccgtgaanggtcaccctcgggtcggcgcctaccnggacgagaanggnaagccctagtgctgaacgtggtcaggcgcgccgagcaaatgtggatcaataatcgtcacgtgtcagggagtactaccaatcacgggtctgctgaattcaatagctgaggcctaacttactttggccctaacgccttgctatcaggaaaaaagggtgctaccggggatgccattggggacggggttttaaaaagcggagggaatttttggaggggtttatcaagggcttttttttttccccaaccacgggggaaaaccccaaaaatttcccccctttgggttaaggggaggcccccccttttttttcccgaaggagcccctttcttaagagaagctaagaaaaccccctcccccctcccaaaaaaaatggggggggggggggggccccccccccgcgggagaatcctcccccccaggggggagaaaaaagggggagaaaaaaacccaaccttcttttttttttaaaaaaaaaaaaagagaaaaa

SEQ ID NO: 45291 - protein, 50 aa, Zea mays
  misc_feature: Ceres CLONE 1448930-F
  misc_feature: SWISSPROT Homolog: EC 2.6.1.1 Aspartate transaminase
  misc_feature (35)..(35): Xaa is any aa, unknown, or other
  misc_feature (44)..(44): Xaa is any aa, unknown, or other
  misc_feature (47)..(47): Xaa is any aa, unknown, or other
MASQGSSVFAALEQAPEDPILGVTVALHKDPSPVXGHPRVGAYXDEXGKP

SEQ ID NO: 45292 - DNA, 761 bp, Zea mays
  misc_feature: Ceres CLONE 1448937-F
  misc_feature: Translation starting site: 273
  misc_feature (396)..(396): n is a, c, t, g, unknown, or other
  misc_feature (406)..(406): n is a, c, t, g, unknown, or other
  misc_feature (425)..(425): n is a, c, t, g, unknown, or other
  misc_feature (434)..(434): n is a, c, t, g, unknown, or other
  misc_feature (437)..(437): n is a, c, t, g, unknown, or other
  misc_feature (481)..(481): n is a, c, t, g, unknown, or other
  misc_feature (493)..(493): n is a, c, t, g, unknown, or other
  misc_feature (567)..(567): n is a, c, t, g, unknown, or other
  misc_feature (570)..(570): n is a, c, t, g, unknown, or other
  misc_feature (573)..(573): n is a, c, t, g, unknown, or other
  misc_feature (647)..(647): n is a, c, t, g, unknown, or other
aagctggagctccccgcggtggcggccgctctagaactagtggatcccccgggctgcaggaattcgcacgagaccattacctagaacatcataatcgaaaaacttcctcgccctccaacctctcctgatctcctcctctggtccgcatagaggagcagcttgccagccaaggacaccggagcacgggcacgggcgcacggccagcgcgaacctcctcccctcccctcttcttccgtttccaacagcgaggcatagtggagaaggcgaggagcatggcgcgcaaactagagatcccccagtggaagcacgacggccttccgtcgccgacgagcccgctggaccgcgcgtcgccccgtgggtggcgccaccgcgacgccgtcggaggcgtcgggctcnggatcctggncgcgctggaggccgagggnccgctgccnggngccggcgccgccgccgcgccgcgggtgtccatcccgcggcgcgncgcgcggctggnagtatcggagctcgcgtgcagcgggcggtgcgccaccagtctgtgcggcggccccgtgtccgggccggcccgcngcngcngtggaaccgccttccccgtggcggagtcctctcgtgctgcgacatgtgcccgcgggcgctggacgggaaggacntcttcatgtaccgcggggagcgcgccttctgcagcatggagtgccggtaccaccgcatcgtgagcgacagttcccgggaagcggaaggaggagaagaaacgaagcccccccgcc

SEQ ID NO: 45293 - DNA, 768 bp, Zea mays
  misc_feature: Ceres CLONE 1448939-F
  misc_feature: Encodes the peptide sequence at SEQ ID NO. 45294
  misc_feature (497)..(497): n is a, c, t, g, unknown, or other
  misc_feature (499)..(499): n is a, c, t, g, unknown, or other
  misc_feature (522)..(522): n is a, c, t, g, unknown, or other
  misc_feature (592)..(592): n is a, c, t, g, unknown, or other
  misc_feature (593)..(593): n is a, c, t, g, unknown, or other
  misc_feature (629)..(629): n is a, c, t, g, unknown, or other
  misc_feature (729)..(729): n is a, c, t, g, unknown, or other
aaagctggagctccccgcggtggcggccgctctagaactagtggatcccccgggctgcaggaattcgcacgagagcattacctagaacatcctaatcgaaaactaggccctactcactgtggaccccaaatccccaactgctcctcttcctcgtcgtcttcctccccgtccccgtccccctcccggcctccccctccactagccccaaattctccgtctcctcctgtccctctccgcgtccaagggttgcagccatccgcatccaccggaccccaccgggaatggcggtttgagtaagttcccgtaccagggttcttcgatctgggaggccgaggggacaccgggtcggagtgaggggccgccatggcgagcgacgtgcccatgaccccggagctcgagcaaatcgacggagagatccacgatatcttccgcgccctccaaaatggattccaaaagatggataagattaaagattcaaataggcaagctaaacattngnaagatcttactgtgaaaatgaangagtgcaagcgcttgatcaaagagtttgatcgcatttctcaagatgaagagtcaaataatccacctgagnnatcacagcagctaaatgacagaaaacagttcatggntggtaaactcagtagcctgattgtatttcacctgcacatttttgtaatgtttcttgtgcactgtacagatcaaagagttgaattcctatgtcaccttgangaaaacataccaagtagccttggtaacacaataagaggt

SEQ ID NO: 45294 - protein, 135 aa, Zea mays
  misc_feature: Ceres CLONE 1448939-F
  misc_feature (45)..(45): Xaa is any aa, unknown, or other
  misc_feature (46)..(46): Xaa is any aa, unknown, or other
  misc_feature (53)..(53): Xaa is any aa, unknown, or other
  misc_feature (77)..(77): Xaa is any aa, unknown, or other
  misc_feature (89)..(89): Xaa is any aa, unknown, or other
  misc_feature (122)..(122): Xaa is any aa, unknown, or other
MASDVPMTPELEQIDGEIHDIFRALQNGFQKMDKIKDSNRQAKHXXDLTVKMXECKRLIKEFDRISQDEESNNPPEXSQQLNDRKQFMXGKLSSLIVFHLHIFVMFLVHCTDQRVEFLCHLXENIPSSLGNTIRG

SEQ ID NO: 45295 - DNA, 752 bp, Zea mays
  misc_feature: Ceres CLONE 1448940-F
  misc_feature: Encodes the peptide sequence at SEQ ID NO. 45296
  misc_feature (257)..(257): n is a, c, t, g, unknown, or other
  misc_feature (470)..(470): n is a, c, t, g, unknown, or other
  misc_feature (471)..(471): n is a, c, t, g, unknown, or other
  misc_feature (598)..(598): n is a, c, t, g, unknown, or other
ctggagctccccgcggtggcggccgctctagaactagtggatcccccgggctgcaggaattcgcacgagaccattacctagaacatcctaatcgaaaaaagaagggggagagggagatggaggaggcgcgcaaggaaaaggagcggaaggaggaggcgggggacaggaatacccaggagccgcagcaaggtcaaggcctcagcctctcactcgccaacggcagcgacagcggcaggtctggaatgttgccgatgtcnaacccttcagctaatccacacagcttacaattttctatggtggatcagtatgtgtgtatgactcggtgccacagaaaaggctcaggcaatcatgcttatagctgcggctgcagcagctgcggcagccacccaaggcagtgctgccactgcttttaatcctcccatgagcacttctgtagcagctggacaagctcaagttgttgctgaccctannctcataagcaagcttcaggctgatctcccccatggcaggaggcactctcctcagcgctcctttgaaaacgtcgtgacaagttcgtgaacaaagctccctacagccccgcaagttcttcgatgggctnagtcaccgggaattaagatgactgcggacggcaagcagggcgccaggcccaatttcttgaaaggtgggggaccccccaatctgaatcctgacgggaaggctgctcttaaccctggggggagaaaggaccggaacctgcttttggttttttatat

SEQ ID NO: 45296 - protein, 69 aa, Zea mays
  misc_feature: Ceres CLONE 1448940-F
  misc_feature (41)..(41): Xaa is any aa, unknown, or other
MLIAAAAAAAAATQGSAATAFNPPMSTSVAAGQAQVVADPXLISKLQADLPHGRRHSPQRSFENVVTSS

SEQ ID NO: 45297 - DNA, 769 bp, Zea mays
  misc_feature: Ceres CLONE 1448941-F
  misc_feature: Encodes the peptide sequence at SEQ ID NO. 45298
  misc_feature (376)..(376): n is a, c, t, g, unknown, or other
  misc_feature (409)..(409): n is a, c, t, g, unknown, or other
  misc_feature (422)..(422): n is a, c, t, g, unknown, or other
  misc_feature (434)..(434): n is a, c, t, g, unknown, or other
  misc_feature (556)..(556): n is a, c, t, g, unknown, or other
  misc_feature (557)..(557): n is a, c, t, g, unknown, or other
  misc_feature (605)..(605): n is a, c, t, g, unknown, or other
  misc_feature (613)..(613): n is a, c, t, g, unknown, or other
  misc_feature (676)..(676): n is a, c, t, g, unknown, or other
  misc_feature (694)..(694): n is a, c, t, g, unknown, or other
  misc_feature (765)..(765): n is a, c, t, g, unknown, or other
ctggagctccccgcggtggcggccgctctagaactagtggatcccccgggctgcaggaattcgcacgagaccattacctagaacatcctaatcgaaaaccgtttttcttcctgtggtcgctcgttgagtgcggaaattccacgaacgtgagctcaacatggagccggcgacccctccggcacccgccgccggcgtcacggctaccgtcgacctctcctcagtcgcagccgacctcggtggggcgcacctcctgccctgcggcatcaggcagaacggcggcgcccccgtatccgactacttcaagcctagggccacaggtgtggaggtggagggggtgaagatggaagaagccttctttcgtgggaagaaactgcanggcactaccctagctctcccggatggctaccgnagttatgtattgnagaagagttgcngacagaattcagatgctgaagtcagcaattttacatcgcgagctgaattccagagcataacctactggaatcacgatacagcgccatcagcagaggatttccctccggagtgcttccattgnnctaacgtcgctaatgcgatgcatagagcagtgactgctgaagacctgnctaacatnggcagcatgcagaaatcagggcagtagattcgttctataacgtagccgtgcaatttcgatttnggtgaacatctcgacaanggatcttcctgtaacaagcaacatgtttatttgacgcatccagtaggtaatgtttaggcttttgggtaagnataa

SEQ ID NO: 45298 - protein, 160 aa, Zea mays
  misc_feature: Ceres CLONE 1448941-F
  misc_feature (28)..(140): Pfam Name: RNase_H1_sml Pfam Description: Ribonuclease H1 small subunit
  misc_feature (73)..(73): Xaa is any aa, unknown, or other
  misc_feature (89)..(89): Xaa is any aa, unknown, or other
  misc_feature (93)..(93): Xaa is any aa, unknown, or other
  misc_feature (133)..(133): Xaa is any aa, unknown, or other
  misc_feature (134)..(134): Xaa is any aa, unknown, or other
  misc_feature (150)..(150): Xaa is any aa, unknown, or other
  misc_feature (152)..(152): Xaa is any aa, unknown, or other
MEPATPPAPAAGVTATVDLSSVAADLGGAHLLPCGIRQNGGAPVSDYFKPRATGVEVEGVKMEEAFFRGKKLXGTTLALPDGYRSYVLXKSCXQNSDAEVSNFTSRAEFQSITYWNHDTAPSAEDFPPECFHXXNVANAMHRAVTAEDLXNXGSMQKSGQ

SEQ ID NO: 45299 - DNA, 779 bp, Zea mays
  misc_feature: Ceres CLONE 1448950-F
  misc_feature: Encodes the peptide sequence at SEQ ID NO. 45300
  misc_feature (669)..(669): n is a, c, t, g, unknown, or other
acagctggagctccccgcggtggcggccgctctagaactagtggatcccccgggctgcaggaattcgcacgagaccattacctagaacatcctaatcgaaaaaattcgcttctccgtcaacttcacttcctcgtcgacgcctccgtcccaccaaccatgccggcggccatggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgcccgccgtcgagatccccgagccgctcgagtcgctccaccacgaggtcgagggtggcggtcgtcatctcccggcgtgtgccccacccttcccgaggcgtccggccatgaaattttgttggaggttatgcacttgctttggaaatgacccccaggggacctccggttctgttgcaaattctcccagccctccctgggattttgggtaaaggaaaaaaacccctcccccccaattaagggagaattttcaaaatacaggtggccataaccccaataaacccaagccctgggggaagggggaataaaaaaacaaggggaaaaaaagccccccccaccncttcttttttaaaaatcctttttttgaaaagattataacccccccacacaaactaaggggggggggggtttatttaaaacggctctcccggggggggggcgccccacaaa

SEQ ID NO: 45300 - protein, 103 aa, Zea mays
  misc_feature: Ceres CLONE 1448950-F
MAAAAAQRLLAASTKIIGVGRNYIAHAKELGNPVPKEPVLFLKPTSSFLHAGVATARRRDPRAARVAPPRGRGWRSSSPGVCPTLPEASGHEILLEVMHLLWK

SEQ ID NO: 45301 - DNA, 716 bp, Zea mays
  misc_feature: Ceres CLONE 1448955-F
  misc_feature: Encodes the peptide sequence at SEQ ID NO. 45302
  misc_feature (379)..(379): n is a, c, t, g, unknown, or other
  misc_feature (380)..(380): n is a, c, t, g, unknown, or other
  misc_feature (422)..(422): n is a, c, t, g, unknown, or other
  misc_feature (542)..(542): n is a, c, t, g, unknown, or other
  misc_feature (606)..(606): n is a, c, t, g, unknown, or other
  misc_feature (665)..(665): n is a, c, t, g, unknown, or other
aagctggagctccccgcggtggcggccgctctagaactagtggatcccccgggctgcaggaattcgcacgagaccattacctagaacatcctaatcgaaaaagccatggcgtcgcggcgctgtctcctccgcttcctctcgatccgcctcgttcctcagagatctcaacctcttgcgccgatctcgactgcgacccggaccctaacctctttgtccgaggccctcggctccccagctccccgggccctcgcctccccccggctgtactacccctcgcgctgccacttcgcgacccgctcctccggcgacgaggacgacggagaagacgaagaagagcactacgacgatgaggggagcgatggggaatggggggacgatnngagagtggtggcggcaaaaaaaccgagcggaagaccgaaaangagaaggtagcggaggcggcggagatcggctacaaggtgttgggaccgctcggggctgacgataaacccttcaagccctacgagcccgtcttcgccgtcgtacagatcggctcgcactanttcaaggtgagcaatggcgactccatcttcacggagaggttgaagttctgtgatgtgaatgacnagttggtcttaaaacgagttctcatgcttgggtcacagctcaaacagttatggggaggncaatactacctgatgctgctgttcatgctggtgtaaaagaacatgccttaa

SEQ ID NO: 45302 - protein, 111 aa, Zea mays
  misc_feature: Ceres CLONE 1448955-F
  misc_feature (49)..(106): Pfam Name: Ribosomal_L21p Pfam Description: Ribosomal prokaryotic L21 protein
  misc_feature (5)..(5): Xaa is any aa, unknown, or other
  misc_feature (19)..(19): Xaa is any aa, unknown, or other
  misc_feature (59)..(59): Xaa is any aa, unknown, or other
  misc_feature (81)..(81): Xaa is any aa, unknown, or other
MGGRXESGGGKKTERKTEXEKVAEAAEIGYKVLGPLGADDKPFKPYEPVFAVVQIGSHXFKVSNGDSIFTERLKFCDVNDXLVLKRVLMLGSQLKQLWGGQYYLMLLFMLV

SEQ ID NO: 45303 - DNA, 773 bp, Zea mays
  misc_feature: Ceres CLONE 1448959-F
  misc_feature: Encodes the peptide sequence at SEQ ID NO. 45304
  misc_feature (364)..(364): n is a, c, t, g, unknown, or other
  misc_feature (365)..(365): n is a, c, t, g, unknown, or other
ccccgcggtggcggccgctctagaactagtggatcccccgggctgcaggattcgcacgagaccattacctagaacatcctaatcgaaaaattcactttgcctccgctttagcctttgtgctgcctgtactatactaacttgcaagggacgtcggcgacggccaggcgcaccactcggcggcccggccagcccacccagagaccacctagccatggcgtccaggtgcttcttccccagggacgcgtccggcgccgacggccggcaccagcagtcgaagggcgcggcggaggccctcgagcagctgcgccacggcgggcgcctcctgtcccgggaggacgtgggcggcgcgttgcgcgttaggatnntcgtcagcaggcgcgagctcaagcagatgggtcccggccctccgtttattattatggtgcttggccggcggcggcggcggccaccagcgagcgccgccaccggcaacgtgccgcgggcccgggcccgggaccgggcccgggccccaaacaaagcctgcattccctgccgcggcgcacctggcgcaagggcggtcaaagcggcccgcccgaacaatcctgccggccggggaattggaacccccgcctgccaaacatcgccaaaggaggtttaactacccaagaaacctcccgctttccctaaattatgggcttggggtaccttttttgatcacctccctcccctgcctaactgctctctaatatataaaattgccttgttgtgctttaaacccccctttttgttcctcc

SEQ ID NO: 45304 - protein, 141 aa, Zea mays
  misc_feature: Ceres CLONE 1448959-F
  misc_feature (51)..(51): Xaa is any aa, unknown, or other
  misc_feature (52)..(52): Xaa is any aa, unknown, or other
MASRCFFPRDASGADGRHQQSKGAAEALEQLRHGGRLLSREDVGGALRVRXXVSRRELKQMGPGPPFIIMVLGRRRRRPPASAATGNVPRARARDRARAPNKACIPCRGAPGARAVKAARPNNPAGRGIGTPACQTSPKEV

SEQ ID NO: 45305 - DNA, 761 bp, Zea mays
  misc_feature: Ceres CLONE 1448960-F
  misc_feature: Translation starting site: 137
  misc_feature (458)..(458): n is a, c, t, g, unknown, or other
  misc_feature (491)..(491): n is a, c, t, g, unknown, or other
  misc_feature (611)..(611): n is a, c, t, g, unknown, or other
aagctggagctccccgcggtggcggccgctctagaactagtggatcccccgggctgcaggaattcgcacgagaccattacctagaacatcctaatcgaaaacattccttccttccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgcacgccgcctgccgctcgccccgctcgccgcctccgattccgccttcgagtcctccgtcggagttaactacgcggagcccgacgactcggagaaggataaggaggtggagttgttcggatcgggtgacgacgagggggcgggtgagttggtggatgaccattcccgtagagtctcagccgctgtcnaggacaaggtggaggaggaggtcggggagtacnttgagccgcccgaggaggccaagtctacgtcggaaacctgccctacgacgtcgacagcgagcgcctcgctcagctcttcgacaggcccgcgtcgtcgaggtcgcagaagtcttttacacngaaaaacagatcaaagtcgtgggtttgggtttgtcactatgaacactgtcaaggaggctgagaaggctgtgaaaatgtcccatcgctattatgtcaatggaaggccctgactgtaataaagcagctcctaaaagctctcctgtggaccaa

SEQ ID NO: 45306 - DNA, 760 bp, Zea mays
  misc_feature: Ceres CLONE 1448962-F
  misc_feature: Translation starting site: 397
  misc_feature: Pfam Name: RLI Pfam Description: Possible metal-binding domain in RNase L inhibitor, RLI
  misc_feature (600)..(600): n is a, c, t, g, unknown, or other
  misc_feature (601)..(601): n is a, c, t, g, unknown, or other
  misc_feature (670)..(670): n is a, c, t, g, unknown, or other
  misc_feature (720)..(720): n is a, c, t, g, unknown, or other
  misc_feature (723)..(723): n is a, c, t, g, unknown, or other
  misc_feature (760)..(760): n is a, c, t, g, unknown, or other
ctggagctccccgcggtggcggccgctctagaactagtggatcccccgggctgcaggaattcgcacgagaccattacctagaacatcctaatcgaaaaaataagaatcagaagaaaaggacccgagcctagggttcggtctgcctcccacagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgaaatgtccatttgatgccattgaaatcatcaaccttccaaaagacttggaaaaggataccactcaccgatatgggcctaataccttcaagttgcacagcttgcccctttcggggcattactgatctagccacctacaggttgcctgtcccaaggcctggtcaggttttgggccttgttggaacaaacgggattggaaattcgacagctcttaaagtgttggctggcaagctgaaacctaacttggggcgcttcaaaaacccacctgattggcanngaaaatctacatactttcgtgggtctgaacttcagaactacttcacacgcatattggaagataacctgnaaggcatcatcaaacctcagtatgttgaccacattccaaaagctgttcanggnaatgtaggacaagtacttgaacagaaggacgagaggn

SEQ ID NO: 45307 - DNA, 751 bp, Zea mays
  misc_feature: Ceres CLONE 1448964-F
  misc_feature: Encodes the peptide sequence at SEQ ID NO. 45308
  misc_feature (490)..(490): n is a, c, t, g, unknown, or other
  misc_feature (491)..(491): n is a, c, t, g, unknown, or other
  misc_feature (627)..(627): n is a, c, t, g, unknown, or other
  misc_feature (628)..(628): n is a, c, t, g, unknown, or other
  misc_feature (634)..(634): n is a, c, t, g, unknown, or other
  misc_feature (655)..(655): n is a, c, t, g, unknown, or other
  misc_feature (664)..(664): n is a, c, t, g, unknown, or other
  misc_feature (669)..(669): n is a, c, t, g, unknown, or other
ggagctccccgcggtggcggccgctctagaactagtggatcccccgggctgcaggaattcgcacgagaccattacctagaacatcctaatcgaaaaatttttcaaatcccattatcaccaagagttttgacccacatgcttgtgtttgggcttttggaatgaatgtgtttgacctggctgaatggaggcggcagaacataactgaaatttatcactcgtggcagaagcttaatgaagatagatcactctggaaacttggtactctccctccgggtttggtcacattctggaacaagacatttcccctcagccggtcatggcatgttcttggtctaggttacaatccccatgttaacagcagagacattgagcatgctgcagtcatacattacaatggcaacatgaagccctggttggagattggtctacccaagttccggagctactggtccaagtatctggattatgaccaatctttccttcgggaatnngcacatcatccatgaaggaacctggtgcttttagtcccttctgacataaccaatagccctgtttctgtcgatgtgcgctttagtgtagtcagcatagtactctcttgctttagatatcagtttgtaacaagatttnnctatgnctgtgctttctgtcagacccntttgcatantgcangaatatctgttatgtttttagagtacatgctttggagcagggcaaactttagatagtgcaatgctcttatgcgaaatccgcc

SEQ ID NO: 45308 - protein, 115 aa, Zea mays
  misc_feature: Ceres CLONE 1448964-F
  misc_feature (111)..(111): Xaa is any aa, unknown, or other
MNVFDLAEWRRQNITEIYHSWQKLNEDRSLWKLGTLPPGLVTFWNKTFPLSRSWHVLGLGYNPHVNSRDIEHAAVIHYNGNMKPWLEIGLPKFRSYWSKYLDYDQSFLREXAHHP

SEQ ID NO: 45309 - DNA, 797 bp, Zea mays
  misc_feature: Ceres CLONE 1448967-F
  misc_feature: Encodes the peptide sequence at SEQ ID NO. 45310
aaactggagctccccgcggtggcggccgctctagaactagtggatcccccgggctgcaggaattcgcacgagaccattacctagaacatcctaatcgaaaaacgttgcccttctcttccccactcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagacaaaggggtcgttcctcgacaagggcgaggtcgctgaccgtgtcgtctccgtcgtcaagaacttccagaaggttgaaacctcaaaggtgacccctagtgcttcatttccaaaggaccttgcaccccacacactggaacccgtgggaaatcgtgatggcccttgaagaaaaatttttccctttgaaattccggacaaccattgcaaaaaaatttgccccctcaaaacaccggtggatttcctgggtttccccccccaaacaaaaaaaaagagatttttttttttttcaaatttcaaagggggtttttgcgctttttgcccccaaaatttttgccccccggggcaattttttttttctctttggccccccaaaaaaagaaaactattctttttcctttttaaaacccccgggtcaaaaaaaattgtgggggctttttgacccccttgtgggcacctaacccacaaacacctttgtgcgttaataaagaaaaaaaaaccctttcc

SEQ ID NO: 45310 - protein, 94 aa, Zea mays
  misc_feature: Ceres CLONE 1448967-F
MAMAAARRALLAHLRVPVVHPAAAAATIPAAGRLLSSTTETKGSFLDKGEVADRVVSVVKNFQKVETSKVTPSASFPKDLAPHTLEPVGNRDGP

SEQ ID NO: 45311 - DNA, 773 bp, Zea mays
  misc_feature: Ceres CLONE 1448969-F
  misc_feature: Encodes the peptide sequence at SEQ ID NO. 45312
  misc_feature (701)..(701): n is a, c, t, g, unknown, or other
  misc_feature (722)..(722): n is a, c, t, g, unknown, or other
  misc_feature (754)..(754): n is a, c, t, g, unknown, or other
ctggagctccccgcggtggcggccgctctagaactagtggatcccccgggctgcaggaattcgcacgagaccattacctagaacatcctaatcgaaaaaaaaaccactcggggagtttgcagttgcagagaactgtatcggccgaagtggttgcacggtgtgttggccttggccatgcgccacggcagggaacagagacgagcagcagggaggcagcaatggaggcgctcattgaccctgctctcgctgtaaagatagtcccgcggtgccctccgaattccacttgatccaactctcgacatgaagcggccacgcggcgctactccctccctgtctgcgatgcccaatcatcaggaagatgacggctacggcgtgctcgggatggaggcggacgtggacgtggacgtggacgaggagatgatggcgttcggcggcggcggggagaagaagcggcgcctgagcgccgagcaggtgcgcgcgctggagcggagcttcgaggtggagaacaagctggagccggagcgcaaggcgcggctggcgcgcgacctctgcctgcagccccgccagtcgccgtctggttccagaaccgccgcgccgctggaagaccagcagctggagcgcgactacgccgcgctgcgccgctcctacgacgcgctacggctcgaccacgacgcgctccgccgcgacaaggacgccctccntcgcgagatcagggagctcanggcgaagctgggggacgacgaagacgcagcgncgagcttcacgtcggtcaa

SEQ ID NO: 45312 - protein, 144 aa, Zea mays
  misc_feature: Ceres CLONE 1448969-F
  misc_feature (91)..(134): Pfam Name: HALZ Pfam Description: Homeobox associated leucine zipper
  misc_feature: The sequence is a functional homolog of SEQ ID NO 1075 in the 11/479,226 US patent application
  misc_feature: The sequence is a functional homolog of SEQ ID NO 470 in the 10/412,699 US patent application
  misc_feature: The sequence is a functional homolog of SEQ ID NO 218 in the 10/225,068 US patent application
  misc_feature: The sequence is a functional homolog of SEQ ID NO 262 in the 10/412,699 US patent application
  misc_feature: The sequence is a functional homolog of SEQ ID NO 574 in the 11/479,226 US patent application
  misc_feature: The sequence is a functional homolog of SEQ ID NO 74 in the 10/374,780 US patent application
  misc_feature (121)..(121): Xaa is any aa, unknown, or other
  misc_feature (128)..(128): Xaa is any aa, unknown, or other
  misc_feature (139)..(139): Xaa is any aa, unknown, or other
MPNHQEDDGYGVLGMEADVDVDVDEEMMAFGGGGEKKRRLSAEQVRALERSFEVENKLEPERKARLARDLCLQPRQSPSGSRTAAPLEDQQLERDYAALRRSYDALRLDHDALRRDKDALXREIRELXAKLGDDEDAAXSFTSV

SEQ ID NO: 45313 - DNA, 763 bp, Zea mays
  misc_feature: Ceres CLONE 1448971-F
  misc_feature: Encodes the peptide sequence at SEQ ID NO. 45314
  misc_feature (452)..(452): n is a, c, t, g, unknown, or other
  misc_feature (564)..(564): n is a, c, t, g, unknown, or other
  misc_feature (708)..(708): n is a, c, t, g, unknown, or other
tggagctccccgcggtggcggccgctctagaactagtggatcccccgggctgcaggaattcgcacgagaccattacctagaacatcctaatcgaaaaacccagaaagatcgcactacccggcgctcgcgcggctttctttcccaactccgacgaaggctagctacaccacctggtgcgggctcgtctccatcgcccgccacccgctccgtcgtcgtcgtccccgccgcgccgatcccgaatcgaatggggagcctggcgtccgagaggaaggtggtcgggtgggccgccagggacgccaccggacacctctccccctactcctacaccctcaggaacacaggccctgaagatgtggtggtgaaggtgctctactgcgggatctgccacacggacatccaccaggccaagaaccacctcggggcttcaaagtatcctatggtccctgggcacnaggtggtcggcaagggtgtggaggtccggcccgaagtggccaagtacggcgtcggcgacgtggtaggcgtcggggtgatcgttgggtgctgccgcgagtgcagcccctgcanggccaacgttgagcagtactgcaacaagaagatctggtcatacaacgacgtctacactgatggacggcccacgcagggtggaattccctccaccatggtcgtcgaccagaagttgtggtgaagatccccgcggttctggctccngaagcagcggcccccctgctgtgcgctggcgtgaccgtgtacagcccgctgaagc

SEQ ID NO: 45314 - protein, 146 aa, Zea mays
  misc_feature: Ceres CLONE 1448971-F
  misc_feature (34)..(145): Pfam Name: ADH_N Pfam Description: Alcohol dehydrogenase GroES-like domain
  misc_feature: SWISSPROT Homolog: EC 1.1.1.195 Cinnamyl-alcohol dehydrogenase
  misc_feature (70)..(70): Xaa is any aa, unknown, or other
  misc_feature (107)..(107): Xaa is any aa, unknown, or other
MGSLASERKVVGWAARDATGHLSPYSYTLRNTGPEDVVVKVLYCGICHTDIHQAKNHLGASKYPMVPGHXVVGKGVEVRPEVAKYGVGDVVGVGVIVGCCRECSPCXANVEQYCNKKIWSYNDVYTDGRPTQGGIPSTMVVDQKLW

SEQ ID NO: 45315 - DNA, 761 bp, Zea mays
  misc_feature: Ceres CLONE 1448972-F
  misc_feature: Encodes the peptide sequence at SEQ ID NO. 45316
  misc_feature (588)..(588): n is a, c, t, g, unknown, or other
  misc_feature (711)..(711): n is a, c, t, g, unknown, or other
aagctggagctccccgcggtggcggccgctctagaactagtggatcccccgggctgcaggaattcgcacgagaccattacctagaacatcctaatcgaaaactgaagaaactccgaccggtggcggcaggatctgtgccgcgatggcgacgtcgaacaccgcgcggatggaggacggcggcggcgacctgagaagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacgaagaagcagctgatgatccaagtagcagagctagttcccaagcatcacggaaggacaaagaagcaggagccagcgcccaatcccggtggcagttcaaagaacacaaaaggcgggaaaaagaaaagtgatgcagnatcattgggtgtgttttttatctggtcgtcatcatacactaagcttctgtgaaaaaggaaaagtcttggacgtttgtgttatgttgccattatgccattttttcatgtataagaacttactangaaatctccattgactcgggtaaatgcaacctaaaaaaaaaaaaaaaggc

SEQ ID NO: 45316 - protein, 165 aa, Zea mays
  misc_feature: Ceres CLONE 1448972-F
  misc_feature (24)..(120): Pfam Name: SRP19 Pfam Description: SRP19 protein
  misc_feature (149)..(149): Xaa is any aa, unknown, or other
MATSNTARMEDGGGDLRSTIKKWNIIYPVYLNSKKTVAEGRRIAAAKACPDPTCIEIADCCSHLKIPHAIELDKAYPRDFFQVGRVRVQLKKDDGSPVNPAIKTKKQLMIQVAELVPKHHGRTKKQEPAPNPGGSSKNTKGGKKKSDAXSLGVFFIWSSSYTKLL

SEQ ID NO: 45317 - DNA, 755 bp, Zea mays
  misc_feature: Ceres CLONE 1448973-F
  misc_feature: Translation starting site: 353
  misc_feature: Pfam Name: Dynein_light Pfam Description: Dynein light chain type 1
  misc_feature (292)..(292): n is a, c, t, g, unknown, or other
  misc_feature (310)..(310): n is a, c, t, g, unknown, or other
  misc_feature (311)..(311): n is a, c, t, g, unknown, or other
  misc_feature (316)..(316): n is a, c, t, g, unknown, or other
  misc_feature (326)..(326): n is a, c, t, g, unknown, or other
  misc_feature (327)..(327): n is a, c, t, g, unknown, or other
  misc_feature (333)..(333): n is a, c, t, g, unknown, or other
  misc_feature (483)..(483): n is a, c, t, g, unknown, or other
  misc_feature (489)..(489): n is a, c, t, g, unknown, or other
aagctggagctccccgcggtggcggccgctctagaactagtggatcccccgggctgcaggaattcgcacgagaccattacctagaacatcctaatcgaaaaaaaaacttacggcgcgctgcgaagggagtcgggcgcggtggggtgtagcatgagggagcagcagggttccggcgacgtggcggggcgccggggcggggtcatcaggtccctgctgggcgtcgagcgccggctcgcggagggcgacgccgagggggcggtcggggtctcctcaggcaagcagccggcaaccngagggcgtgggcgtggcnngtgcnaagaaagaanngcgtgntgagggtgggtgcgccgacatgccgcccgcgctgcagcgccgcgcgttccgctgcgcccgcgacgagctcgccgcgatgccgcacttcccgcgccggctcgagcccaagcgcctcgcgctcgcgctcaagaagctcatttggaaggtccnggcttnccgggagttgctggaccccaccactggcagttcaagtatcagtttctgagcacccagcgatggggtcaggagttcgatgctgcttacgggccagcttggcactgcatcgtggggaccaagtttcggtcatatgtcacgcacgcccggggtggattctttgatttttcctccataaggctacatcctgctctcagggaagccgtggacccttaccgcattgacggccacagcctaccaggatggacaatggtcataaaaatgccagt

SEQ ID NO: 45318 - DNA, 752 bp, Zea mays
  misc_feature: Ceres CLONE 1448974-F
  misc_feature: Encodes the peptide sequence at SEQ ID NO. 45319
  misc_feature (371)..(371): n is a, c, t, g, unknown, or other
  misc_feature (390)..(390): n is a, c, t, g, unknown, or other
  misc_feature (461)..(461): n is a, c, t, g, unknown, or other
  misc_feature (522)..(522): n is a, c, t, g, unknown, or other
tggagctccccgcggtggcggccgctctagaactagtggatcccccgggctgcaggaattcgcacgagaccattacctagaacatcctaatcgaaaaataatactagcagcgggtggactcggcaccggccgttgggaccgcgacgatggccgccgcctggcctctctccgccatcgccggcatcctcccggcctccctctcgctggccctcctcctcgccaccctcgtgtccatcctggtgctgggcgcagcggcggtcttcttcgagcacatccgcaagatcggatgcatgcactcgctggagaggtccgccgtctcggacgccttcttcgaggacccccactcattcaagaaagtgccctgcccgtcngttttggatcctcctgagnaatatatttcgttgatagttcctgcctacaatgaagagtatcgactccccgaggctcttacagaaacactncactacttgaagcggcgatcaactgctgacaagtccttttcatatgaggtattgattgtcnatgatgggagcactgatgggacctctaaagtcgctttcagttttgtaaagcaacataagattgataatggtagagtcctcctacttggagaaatcatgggaaaaggtgaagcaatccgaaaaagaatgcttccttcccgtggtgaactattactcatgcttgaggctgatggggcaactaaaggcccgatttggaaagcttgagctcaaattctgcttggcctagaaagc

SEQ ID NO: 45319 - protein, 192 aa, Zea mays
  misc_feature: Ceres CLONE 1448974-F
  misc_feature: SWISSPROT Homolog: EC 2.4.1.117 Dolichyl-phosphate beta-glucosyltransferase
  misc_feature (82)..(82): Xaa is any aa, unknown, or other
  misc_feature (126)..(126): Xaa is any aa, unknown, or other
MAAAWPLSAIAGILPASLSLALLLATLVSILVLGAAAVFFEHIRKIGCMHSLERSAVSDAFFEDPHSFKKVPCPSVLDPPEXYISLIVPAYNEEYRLPEALTETLHYLKRRSTADKSFSYEVLIVXDGSTDGTSKVAFSFVKQHKIDNGRVLLLGEIMGKGEAIRKRMLPSRGELLLMLEADGATKGPIWKA

SEQ ID NO: 45320 - DNA, 740 bp, Zea mays
  misc_feature: Ceres CLONE 1448979-F
  misc_feature: Encodes the peptide sequence at SEQ ID NO. 45321
  misc_feature (378)..(378): n is a, c, t, g, unknown, or other
aagctggagctccccgcggtggcggccgctctagaactagtggatcccccgggctgcaggaattcgcacgagaccattacctagaacatcctaatcggaaaactgaaaaaaggctcctgtatctcccatatcttcttgcagccgaagcaaagtgagggcggcgagatgaacggcggcggggaggacgggaagcagcagccgcacctggtactggcgcacaagctgttcctcctgtcgcaccccgacgtcgacgacctcgccaaggtcgacctacgcgctgacgtgttcgcagcagtcaaatccgatgacatggcagctctgtacgagtcgttgggcggcgacggcgtactggagacggacgcggcgctgctggccaanatgcccccaggatcgacgaggagatccggagctcgacgaagagattgctgatgcaaaggagaacttgggtgagagtgaagtgcgtgaggcccatctcgcaaatccttattttcataaggttggggagaagagaaagcctttgaccacctaaagttactggaggaaaaactgttcttggtggccaaaaaatggacttggttttcacccccctacaatttggattggtctatatggactttgatcccctctcccagatccatggcacaagcaaaaaattgttttaggaagggggggtttggaaaaggcaaacccatttgaaggtttttgaggggttttccttgtttggacccttaaacctctaa

SEQ ID NO: 45321 - protein, 87 aa, Zea mays
  misc_feature: Ceres CLONE 1448979-F
  misc_feature (71)..(71): Xaa is any aa, unknown, or other
MNGGGEDGKQQPHLVLAHKLFLLSHPDVDDLAKVDLRADVFAAVKSDDMAALYESLGGDGVLETDAALLAXMPPGSTRRSGARRRDC

SEQ ID NO: 45322 - DNA, 804 bp, Zea mays
  misc_feature: Ceres CLONE 1448980-F
  misc_feature: Encodes the peptide sequence at SEQ ID NO. 45323
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (407)..(407): n is a, c, t, g, unknown, or other
  misc_feature (428)..(428): n is a, c, t, g, unknown, or other
  misc_feature (473)..(473): n is a, c, t, g, unknown, or other
atagctggagctccccgcggtggcggccgctctatactagtggatcccccgggctgcaggaattcgcacgagaccattacctagaacatcctaatcgaaaactctgaccttatccccttgcggcaaaaccttgcgcgcaacaatggccgcctccctcccgaccaccgccgcgcgcctcgcggccccggccttcgcctaccggtcgcccaacgctccctccgccaccgccctcccgcgtgccgccgccttccctgcaatcgccgtcgcggcggcgcccctgcgcccgcgccgcgcgccgaggccggtggcggcccgggccgggggcgaggagagggagacgatactgctccccgggtgcgactacaagtgatgnnnaaaccccatgtagtttcccaaggacccggggnccacccccccgcaggagaacnacaacttaactcaacacacacccccaaccgtcctccccaccatgnaagaaaacccaaaaaaaaattgggaggcctttcagcaccaactcccttcccgcgggggttcacagtgcaccgtgggaacgaggaagattcccgaaaaacttcaaggggcctcgcagggggcgccggggggtggccccctggattcccacatcccacttgaaaacaaagggactccggaagggcaacagttccctcaacgcgcggaataacccccgcgccctacccccacttcccatctcaaagggtgggaggtagcccacgatactacaacttggggcgacgggaacgcgcaaaaaatggtcccaccctcgccccctggggaaccgtaact

SEQ ID NO: 45323 - protein, 75 aa, Zea mays
  misc_feature: Ceres CLONE 1448980-F
MAASLPTTAARLAAPAFAYRSPNAPSATALPRAAAFPAIAVAAAPLRPRRAPRPVAARAGGEERETILLPGCDYK

SEQ ID NO: 45324 - DNA, 778 bp, Zea mays
  misc_feature: Ceres CLONE 1448981-F
  misc_feature: Encodes the peptide sequence at SEQ ID NO. 45325
  misc_feature (346)..(346): n is a, c, t, g, unknown, or other
aaagctggagctccccgcggtggcggccgctctagaactagtggatcccccgggctgcaggaattcgcacgagaccattacctagaacatcctaatcgaaaagtgagccgcggcatcagagggaggatttcagccattcaggagggccaccgtacgcagcgagaccagccagcaggcggcgatgttcgcgacggcggtgcggtgggcggcgaaaaaggggaagcccaagatggcgccgatcgagctgacggcgccgccggagcaggcgcagtccatcacgcgcgccatcttcgacgccgtccgggagcacggcccgctcaccgtctccgacgtctgggaccacgtncaggatgtcgggcttcgaggtctgggcagcaagaggcagatgaagatcatgctgcggtggatgagggaacccccgaagctaaagctcatctgcgaccacgacggcccgcacaagcagttcctctaccccactgttttaccacccccaggacgccccgcaaaggcccattccaaacccaatggcaaggcgaaaaggtcccccccttcccttccctttaaaagaatttggaaagaagacttgtttctgggccctcgccattttttccgccgccccccaaaaattggtccccagggaaaaaaatggttatttttttccggcgaatttgggctggttggggttatttggtcttcaaacccccaaggtggggcacgccattaaacccctttttttaaaaaaaaaaaaaaaagatttttttccccggcgccccggggg

SEQ ID NO: 45325 - protein, 180 aa, Zea mays
  misc_feature: Ceres CLONE 1448981-F
MFATAVRWAAKKGKPKMAPIELTAPPEQAQSITRAIFDAVREHGPLTVSDVWDHVQDVGLRGLGSKRQMKIMLRWMREPPKLKLICDHDGPHKQFLYPTVLPPPGRPAKAHSKPNGKAKRSPPSLPFKRIWKEDLFLGPRHFFRRPPKIGPQGKKWLFFSGEFGLVGVIWSSNPQGGARH

SEQ ID NO: 45326 - DNA, 787 bp, Zea mays
  misc_feature: Ceres CLONE 1448985-F
  misc_feature: Encodes the peptide sequence at SEQ ID NO. 45327
  misc_feature (334)..(334): n is a, c, t, g, unknown, or other
aagctggagctccccgcggtggcggccgctctagaactagtggatcccccgggctgcaggaattcgcacgagaccattacctagaacatcctaatcgaaaaagaattcgtgtaccagaaaccccggccctaaccgcgcccgcaccctcgcccttggctcgccggagattaacgctacagccgtaatcacgtaaattccttttcatggagggtgtgggcgcgcggctagggcgcacttcggcgcgctacgggccggcgacgacgttcacgggccatgtcaggaagtggcgcaaggagtgggtaccagtggtcgccgccgccgccgccgccgccgnccaacgcaacacaggcgccacggtgggacgacgtcctccacgggaatggatctggcggaagatcccccgggaataatcctctcctgttaaatgggccccggagacgggggcttaacggggaggaggggaaggggaacaacaccccccgggttaaaaccccccaaaaaccccgggggatttccccgttttcttttggggaaaacaaggggaaaaatcccccaactcttatattgaaaccgggcataggggggaacccccttctcaaggaagaccgccccccgggggagagaggggtctccgggaaccccccggtgggaaacccccccccaaaaaaggggggggcaaatttttttaaaaaagcggggagaacaacactttttttttttttttttaaaacaccccgggggtgttttttttttttaaaaaaaaaaagatggggcacacaccacccaa

SEQ ID NO: 45327 - protein, 68 aa, Zea mays
  misc_feature: Ceres CLONE 1448985-F
  misc_feature (44)..(44): Xaa is any aa, unknown, or other
MEGVGARLGRTSARYGPATTFTGHVRKWRKEWVPVVAAAAAAAXQRNTGATVGRRPPREWIWRKIPRE

SEQ ID NO: 45328 - DNA, 755 bp, Zea mays
  misc_feature: Ceres CLONE 1448987-F
  misc_feature: Translation starting site: 321
  misc_feature (409)..(409): n is a, c, t, g, unknown, or other
  misc_feature (410)..(410): n is a, c, t, g, unknown, or other
ggagctccccgcggtggcggccgctctagaactagtggatcccccgggctgcaggaattcgcacgagaccattacctagaacatcctaatcgaaaacacaaccccccgccggcgcggctcccggtgtcccttccactctccaccctctccttcccttcggcgccaagtccatccgcccctccgaatctccgattgccgccgtccaggtttggcaggtgccggccgacagttgagaatgggactgaggcgtctgatgagatgctgctgctgcattgcaaagcacgcggacgacgggcgacagatcgatttcggaggtgggcatgttcatgttgtcacaagcaaagaggactgggaccaaagaattgcggaggcaaacaaggatggggaaaaccgtggttgcaaacttcanncgcttccctggtgtggggccgtgccgtgtcatcgcacctgtctacgccgaaatgtcgcagacgtaccctcagctcatgttcctgacgatcgatgttgatgactttgatggagttccctcgtcgtgggaatccgcgcgaccccgacgttcttcttccttaagaacaagcagcaggtggacaagctgggtcggcccccacaagcctgagttggaaaaagaaagtggccgccttccccgaaccgggccgggaaaagaaagtgtaatggaattgaattttaagggaagaacccccgcccttgttaacctggcttttaacacaaccgttatacccggttgcgggggcgtt

SEQ ID NO: 45329 - DNA, 762 bp, Zea mays
  misc_feature: Ceres CLONE 1448990-F
  misc_feature: Encodes the peptide sequence at SEQ ID NO. 45330
tggagctccccgcggtggcggccgctctagaactagtggatcccccgggctgcaggaattcgcacgagaccattacctagaacatcctaatcgaaaaatcatcgagtcatccatctaaacatccgatccgaccatggcggcagacgcacttcggggccttctccccggcgtttacgccgtgctgatggtaatcgccgtcgcaagcgctgcctccagcgacgtgtcctcggtggtcgtcgggctcgccaaatgcgccgactgcaccaggaagaacttgaagaccgaggcggcattcaagggtcttgaggtggcgatcaagtgcaagaacagcaaaggcgagtacgagagcaaggccatgggcaagattgatggctctggcgccttcagcatcccacttagcacggacccccacggcgctgactgcgttgcacagctccacagcgctgcgggcaacccgtgcccccggtcaagaaccttccagaattgtgccacattcgtcaaagggcaacttcatcgtggctcccggaaagacagactacctatcgaaagaatgtgcgtccgcaaccctgtgcgggtcgatcaagaagcacctattggaccatttcacaagaaacttgtgccacaaagcccaaaccagagccaaagccagagccggagcccaagccagaacctaagcccaaccagagaaccccccccctcccccacatacggatcctcaacttccatcctacctccctccatccaggagttgttttgacagaa

SEQ ID NO: 45330 - protein, 207 aa, Zea mays
  misc_feature: Ceres CLONE 1448990-F
  misc_feature (34)..(201): Pfam Name: DUF1210 Pfam Description: Protein of unknown function (DUF1210)
MAADALRGLLPGVYAVLMVIAVASAASSDVSSVVVGLAKCADCTRKNLKTEAAFKGLEVAIKCKNSKGEYESKAMGKIDGSGAFSIPLSTDPHGADCVAQLHSAAGNPCPRSRTFQNCATFVKGQLHRGSRKDRLPIERMCVRNPVRVDQEAPIGPFHKKLVPQSPNQSQSQSRSPSQNLSPTREPPPSPTYGSSTSILPPSIQELF

SEQ ID NO: 45331 - DNA, 744 bp, Zea mays
  misc_feature: Ceres CLONE 1448991-F
  misc_feature: Encodes the peptide sequence at SEQ ID NO. 45332
  misc_feature (709)..(709): n is a, c, t, g, unknown, or other
tggagctccccgcggtggcggccgctctagaactagtggatcccccgggctgcaggaattcgcacgagaccattacctagaacatcctaatcgaaaatatctgggaagcagttatgaacgaacttgtagttaaggggctcaggaatgctaaacaggctttcctaacaggatgctctgctggtggactagccacttacattcactgtgattcttttcgtgcgctactaccaaaggattctagggttaagtgtctcgcggatggtggttttttccttgatgtagaagacatttctgggaggaggacaatgcactctttctacagtgatattgtgcgccttcagggtctaagggaaaggttttcgcattgtaactcaaacatggacgcaggccagtgtttctttccacgtgaagttgtgaagcacattgtcaacccagttttcgttcttaatcagcatatgatgcctggcaggtacaacatgcgttggctccagaagcatctgacccctcacattcatgggctggactgcagattggatattagcaagtgcagccctaaacaacttggaattctccaaggtttcaggaaagaactgcatgacgctataagtgaagctaagcagaaaaggggctggggatttatatcaactcgtgcttttgtcatggtcagtcgctgaaactcgtgacttggcactctccaacttccccagangtcacataagagcattgcaaaaccagttggagact

SEQ ID NO: 45332 - protein, 186 aa, Zea mays
  misc_feature: Ceres CLONE 1448991-F
  misc_feature (1)..(185): Pfam Name: PAE Pfam Description: Pectinacetylesterase
MNELVVKGLRNAKQAFLTGCSAGGLATYIHCDSFRALLPKDSRVKCLADGGFFLDVEDISGRRTMHSFYSDIVRLQGLRERFSHCNSNMDAGQCFFPREVVKHIVNPVFVLNQHMMPGRYNMRWLQKHLTPHIHGLDCRLDISKCSPKQLGILQGFRKELHDAISEAKQKRGWGFISTRAFVMVSR

SEQ ID NO: 45333 - DNA, 777 bp, Zea mays
  misc_feature: Ceres CLONE 1448992-F
  misc_feature: Encodes the peptide sequence at SEQ ID NO. 45334
  misc_feature (287)..(287): n is a, c, t, g, unknown, or other
  misc_feature (380)..(380): n is a, c, t, g, unknown, or other
  misc_feature (407)..(407): n is a, c, t, g, unknown, or other
  misc_feature (420)..(420): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaactacaagcctctctctcacacacacatcgttgtccaaacaagagcggcgctgctcacggcggcctaacgagctaggccggatattccttaacccgctgactagatagaccgatccatcagctggcagccatgaatatgatcagggcagtacggcgccggttcaccgtcggccacctggctacggncaaggaccccgccacgctgcgccacgcggccgccgaactcctcgccaccgccatcttcgtcttcgcccgccgagggcgccacgctctctctcnggaggatgcaccaccatgacaagggcngcggcggccctgntgggcgtggcgctcgcgcacgccctcgngcttcgggccgccgtggggtgcgccgccacatctcgggcggccacgtcaacccggccgtcaccttcggcgcgctgttccgcggccgggatttgcctcgtccgctccctcgtctactgggcccgggaggtgctcggggccctccccccgcgctcgggttagggttcccaccgggagggatcctccgcccgaatacccccctggcggggggggttacccaaaagaaaccccccgtggtttgaggccccattgggtttcggcctctggccccccaacttgcgacaggaatgaaaaaaccgcgaagggccccccccggcccccgaaaccttgg

SEQ ID NO: 45334 - protein, 100 aa, Zea mays
  misc_feature: Ceres CLONE 1448992-F
  misc_feature (8)..(8): Xaa is any aa, unknown, or other
  misc_feature (12)..(12): Xaa is any aa, unknown, or other
MHHHDKGXGGPXGRGARARPRASGRRGVRRHISGGHVNPAVTFGALFRGRDLPRPLPRLLGPGGARGPPPALGLGFPPGGILRPNTPLAGGVTQKKPPVV

SEQ ID NO: 45335 - DNA, 698 bp, Zea mays
  misc_feature: Ceres CLONE 1448993-F
  misc_feature: Encodes the peptide sequence at SEQ ID NO. 45336
  misc_feature (372)..(372): n is a, c, t, g, unknown, or other
  misc_feature (436)..(436): n is a, c, t, g, unknown, or other
  misc_feature (503)..(503): n is a, c, t, g, unknown, or other
tggagctccccgcggtggcggccgctctagaactagtggatcccccgggctgcaggaattcgcacgagaccattacctagaacatcctaatcgaaaactccgtgctttctcagaggcgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcancgccatcgagggcatgaacggcaaggagctcgacggccgcaacatcaccgttaacgaggcccantcccgcggcggccgcggaggcggcggtggcggatacggtggcgggcgccgtgatggaagcggctacngcggtggcggtggcggctactgaggtggtcgtggaagctacggcggcggcggtgggggatacggtggtggaaacggcggcggcggctacggcaacaacgacggtaactgggagaactgagccgttggggtccgctgaggcctagttatcttggtcgcttctgctaccgtgtcaccctattctagagggggtttat

SEQ ID NO: 45336 - protein, 114 aa, Zea mays
  misc_feature: Ceres CLONE 1448993-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (64)..(64): Xaa is any aa, unknown, or other
  misc_feature (85)..(85): Xaa is any aa, unknown, or other
  misc_feature (108)..(108): Xaa is any aa, unknown, or other
MAASDVEYRCFVGGLAWATDDHSLNNAFSTYGEVLESKIILDRETQRSRGFGFVTFSTEDAMRXAIEGMNGKELDGRNITVNEAXSRGGRGGGGGGYGGGRRDGSGYXGGGGGY

SEQ ID NO: 45337 - DNA, 756 bp, Zea mays
  misc_feature: Ceres CLONE 1448994-F
  misc_feature: Encodes the peptide sequence at SEQ ID NO. 45338
  misc_feature (375)..(375): n is a, c, t, g, unknown, or other
  misc_feature (388)..(388): n is a, c, t, g, unknown, or other
  misc_feature (409)..(409): n is a, c, t, g, unknown, or other
  misc_feature (416)..(416): n is a, c, t, g, unknown, or other
aagctggagctccccgcggtggcggccgctctagaactagtggatcccccgggctgcaggaattcgcacgagaccattacctagaacatcctaatcgaaaaaccagcatccacaaggcctctcttctcagtgccagccgccgtgcgctcgctctctctgtccctcaaggccttcgccggcgaagagcgcctagtcacccactaggatgaagtttgttgctgcttacctgcttgctgtccttgctgggaactccagcccctctgctgaggacttgacggccattctggagtcagttggctgtgaagttgacaatgaaaagatggagctcctgctgtcccaactgagcggtaaggacattaccgagctcattgctgncggcagggagaantttgcttcagtcccatgcggncgcggcngcggtatggctgtggcagcagctggccctgctgctggcggagctgctcctgcagctgaggcgaaaaaaaaaagaaggtggaggagaagaagagagcgaccatgacatgggcttcagcctcttcgactgagctgggtgggcagtcatcacatccgagaagttttgttttgttttgacttttgagccgtgaaaccagaggaaaaccgtagccgttgtttggactttacccccttttaaggtggaaactagtttgaaagcctcctactgcctttaaaatttgggaattccgccggagggcgactttgcccccaaaaaaaaaaaaaaaaaagcctttcggttcg

SEQ ID NO: 45338 - protein, 104 aa, Zea mays
  misc_feature: Ceres CLONE 1448994-F
  misc_feature (17)..(94): Pfam Name: Ribosomal_60s Pfam Description: 60s Acidic ribosomal protein
  misc_feature (57)..(57): Xaa is any aa, unknown, or other
  misc_feature (61)..(61): Xaa is any aa, unknown, or other
  misc_feature (71)..(71): Xaa is any aa, unknown, or other
MKFVAAYLLAVLAGNSSPSAEDLTAILESVGCEVDNEKMELLLSQLSGKDITELIAXGREXFASVPCGRGXGMAVAAAGPAAGGAAPAAEAKKKRRWRRRRERP

SEQ ID NO: 45339 - DNA, 730 bp, Zea mays
  misc_feature: Ceres CLONE 1448995-F
  misc_feature: Encodes the peptide sequence at SEQ ID NO. 45340
  misc_feature (409)..(409): n is a, c, t, g, unknown, or other
  misc_feature (523)..(523): n is a, c, t, g, unknown, or other
ggagctccccgcggtggcggccgctctagaactagtggatcccccgggctgcaggaattcgcacgagaccattacctagaacatcctaatcgaaaaggggtatacgctggttctacactggtgatattggccagttccatcctgacgggtgccttgagattattgacaggaaaaaagatatagtaaagcttcagcacggagaatatgtgtctcttggcaaggttgaatcggctctagcaacaagtagttatgtggagagcatcatggtctacgccgatccgttccataactactgtgttgccctggttgttccagtacgccaggccctggagaagtgggctcaaaattctgggataaactgtgaaggctttgaagagctttgccaaaaatgccaggcggttaaggaggnttcagcatcactatcgaaggccgcgaaagcagcgaggctggagagattcgaggtgccggcgaagatcgagctgctgcctgagccgtggacgccggagtccgggctggtgacggncgcgcttaagctgaagagggaacagataaaggcccaattcaaagacgatctggacaagctctaccactgaagaaaagcggggcttgcaccacgcggttcaggagcttgcgctgcccaaacgctgcctggatgccgaatgaaacctactgacctgcaccagaccacaatgggtgtgtgtgttttttttgaatgtgtttcgccttccga

SEQ ID NO: 45340 - protein, 109 aa, Zea mays
  misc_feature: Ceres CLONE 1448995-F
  misc_feature: SWISSPROT Homolog: EC 6.2.1.3 Long-chain-fatty-acid--CoA ligase
  misc_feature (49)..(49): Xaa is any aa, unknown, or other
  misc_feature (87)..(87): Xaa is any aa, unknown, or other
MVYADPFHNYCVALVVPVRQALEKWAQNSGINCEGFEELCQKCQAVKEXSASLSKAAKAARLERFEVPAKIELLPEPWTPESGLVTXALKLKREQIKAQFKDDLDKLYH

SEQ ID NO: 45341 - DNA, 743 bp, Zea mays
  misc_feature: Ceres CLONE 1448998-F
  misc_feature: Encodes the peptide sequence at SEQ ID NO. 45342
  misc_feature (416)..(416): n is a, c, t, g, unknown, or other
  misc_feature (475)..(475): n is a, c, t, g, unknown, or other
tggagctccccgcggtggcggccgctctagaactagtggatcccccgggctgcaggaattcgcacgagaccattacctagaacatcctaatcgaaaagactagggcgtctgagactctgagacacaggaacagaaccctctctgcgccgccgccgccgttgcagtcgcggccacatcgtcgcctatccatccccaccgctcccactgccacgattcacaagaggtgtcgagatgtctcagaacaacccctcccagctcctcccctcagagctgatcgatcggtgcatcgggtccaagatctgggtgatcatgaagggggacaaggagctcgttggcaccctctgcggctttgatgtctacgtcaatatggtgctggaggacgtcaccgagtatgaatacactgctgaagggcgccncattacaaaacttgaccagatcctcctaaacggcaacacatagccattttggttctggntgttcaccacccgatgtgtaatgagcttttgctccccagagtaaccattcgaggcgaaggcatctccatggactttgcacgttattttgggtaatcatgggatgtttcgtcatctcggaatgtgtcatcctggtcgggattatacaagtttattgttaactctctttcagcatgaagctgccttctgtatcaactactgacctgaagagggtgcttgcataactgtggttaataatggtatgcaattccgggatgtccgccgccacct

SEQ ID NO: 45342 - protein, 75 aa, Zea mays
  misc_feature: Ceres CLONE 1448998-F
  misc_feature (13)..(75): Pfam Name: LSM Pfam Description: LSM domain
  misc_feature (62)..(62): Xaa is any aa, unknown, or other
MSQNNPSQLLPSELIDRCIGSKIWVIMKGDKELVGTLCGFDVYVNMVLEDVTEYEYTAEGRXITKLDQILLNGNT

SEQ ID NO: 45343 - DNA, 840 bp, Zea mays
  misc_feature: Ceres CLONE 1449002-F
  misc_feature: Encodes the peptide sequence at SEQ ID NO. 45344
  misc_feature (315)..(315): n is a, c, t, g, unknown, or other
  misc_feature (401)..(401): n is a, c, t, g, unknown, or other
  misc_feature (446)..(446): n is a, c, t, g, unknown, or other
aagctggagctccccgcggtggcggccgctctagaactagtggatcccccgggctgcaggaattcgcacgagaccattacctagaacatcctaatcgaaaagcagatcacactagcctacacacaccgagcgccgtctaaactgacagcaggtcagcagcctagcgaagccaagacatccgccgatctcagatggccgggagaagggtgcgcggcaagagtgccgtggccgtggcggccgtcgcgctgctggcgctgctcttcgcggcgagcgaggccgacgggacgtgcaacgtcgacccgggcacggtgctgnagcagtgcgcgtcctgctcgagcggcgcgccgagccaggggtgctgcgacgcgctgaggaacgccgacttcggctgcctctgcagncactactggaacaagctcaaaaacacgccatacgccagctgcggnaaggccatccctttccgggtgaaacctcccaaacgccaagtgccattaaatggaaaaccttggagggggtgccccggaacagcgaaaggggcaacttggaaccaaaacaaaaaaaaaccccttttcttaacccgggttctttccccccccgggaggggggaaagtcctttggtttgaaacccttttcccaaaaaaaaagggggccccccgtaaccccggggggaagtttttataatattgtctttacaaccccggggtttccccctttttgattggggcgcccccaaaaaaaaaaaaaaaaaaaatttttttccccccccccccccccggggggggggggcgcgcccacaattctcccaaaagggggggaataaaacccccccccccccgcgct

SEQ ID NO: 45344 - protein, 143 aa, Zea mays
  misc_feature: Ceres CLONE 1449002-F
  misc_feature (42)..(42): Xaa is any aa, unknown, or other
  misc_feature (70)..(70): Xaa is any aa, unknown, or other
MAGRRVRGKSAVAVAAVALLALLFAASEADGTCNVDPGTVLXQCASCSSGAPSQGCCDALRNADFGCLCXHYWNKLKNTPYASCGKAIPFRVKPPKRQVPLNGKPWRGCPGTAKGATWNQNKKKPLFLTRVLSPPGRGESPLV

SEQ ID NO: 45345 - DNA, 761 bp, Zea mays
  misc_feature: Ceres CLONE 1449003-F
  misc_feature: Encodes the peptide sequence at SEQ ID NO. 45346
  misc_feature (591)..(591): n is a, c, t, g, unknown, or other
  misc_feature (657)..(657): n is a, c, t, g, unknown, or other
  misc_feature (674)..(674): n is a, c, t, g, unknown, or other
  misc_feature (725)..(725): n is a, c, t, g, unknown, or other
ggagctccccgcggtggcggccgctctagaactagtggatcccccgggctgcaggaattcgcacgagaccattacctagaacatcctaatcgaaaaaaaacgcagatccctgcctgcacacggcatccggagttccggactcccctcctcttctcgggcagccgggcgccgcttcgcctcctcctcgcaggcaagaagagcagccagccgcttcgcgatcggggacgcggagaggggaaaggcgagtcgtcgtccgtccacggcagcttccctccctctcctctccgcccccgcttacctagcccggcccctcctacgccccccctcccgccgccgcacgatgagcacctctccggccgcgtccgccgccgcgtcgcctccgccgcctattgcctccgccgccgaggcctcgcgggcgacggagacgttggtggtcgacgagagggtcgcctcacacgtggacccgttcctcgtagaggcgctcgacaaccctcgccaccgcctcatggttctacggatggaactggatatacgaaactttatgcagaaccctcagctgcaggagttcgaattccagaactttccgacttnctacctacgctgtgctgctcatcgtgttgcacaacattatggcttagagactatagtggcagatangttagtagaaggctcangtaggcaggatcgttgcagaaaaacaccagagagcaggtgtcccgcatttncattagcagaagttcctagcaaaccagcaaggaatg

SEQ ID NO: 45346 - protein, 140 aa, Zea mays
  misc_feature: Ceres CLONE 1449003-F
  misc_feature (84)..(84): Xaa is any aa, unknown, or other
  misc_feature (106)..(106): Xaa is any aa, unknown, or other
  misc_feature (112)..(112): Xaa is any aa, unknown, or other
  misc_feature (129)..(129): Xaa is any aa, unknown, or other
MSTSPAASAAASPPPPIASAAEASRATETLVVDERVASHVDPFLVEALDNPRHRLMVLRMELDIRNFMQNPQLQEFEFQNFPTXYLRCAAHRVAQHYGLETIVADXLVEGSXRQDRCRKTPESRCPAFXLAEVPSKPARN

SEQ ID NO: 45347 - DNA, 731 bp, Zea mays
  misc_feature: Ceres CLONE 1449004-F
  misc_feature: Encodes the peptide sequence at SEQ ID NO. 45348
  misc_feature (300)..(300): n is a, c, t, g, unknown, or other
tggagctccccgcggtggcggccgctctagaatagtggatcccccgggctgcaggaattcgcacgagaccattacctagaacatcctaatcgaaaaaccttcctccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagangttcgagaaggaggctgctgaaatgaacaggcggtcctttcagtacgcgtggggtgctcgacaagctcaaggctgaccgtgagaaaagtatcaccattgatatcgctctgtggaagtttgagaccaccaagtactactgcacggtcattgatgccccctggacaccgtgactttcttcaagaacatgatcactggtacctcccaggctgactgtgctggcctttatcatgaccccacccctggtgggtttttaagggtggtttccccaaggatggcccgaacccggaaacatgctctccttggcgttccccccttgaagtgaaacaaaattaatttgctgcttcaacaaggatggatgccaccccttccacaataccccaagggcccttttttaaaaaaatttgtgaaaggaatttctcattctcacccta

SEQ ID NO: 45348 - protein, 65 aa, Zea mays
  misc_feature: Ceres CLONE 1449004-F
  misc_feature (41)..(41): Xaa is any aa, unknown, or other
MGKEKSHINIVVIGHVDSGKSTTTGHLIYKLGGIDKRVIEXFEKEAAEMNRRSFQYAWGARQAQG

SEQ ID NO: 45349 - DNA, 724 bp, Zea mays
  misc_feature: Ceres CLONE 1449009-F
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
aagctggagctccccgcggtggcggccgctctagaactagtggatcccccgggctgcaggaattcgcacgagaccattacctagaacatcctaatcgaaaaaaaagcccaatgaactagacgaattgctcactgctgtgccgtctgtggactgcgcaaggcggcaagccggcagtagagcagactcggcgctcgacgctcgggggcggcagaaacggagagacgagcggatttctatacgtcagctcgtttcggcccccgcttgggggcttctcctcggcgtcgtcgctccctccgccgcctcttcctcttcgtgccgagcgctacagagaaagcttgtggacgggcaacgaaccagcggtgtttccatacgcggaaattgcagtacgtgctacaacctacaatatcacatatctcgggtttatccgaagagctcacccatcgacctcatcagtggtgtgattgatttcacgtacacatcttctgattacctcatcagtggtgtcattacgtcgaataatttgattatatggacgcctcatatatatttttatttctgaatatcccaacatttaccaggagctgagctacccctaatcatttccaggcttccgactggattggccacctctctccctggaccggnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45350 - DNA, 726 bp, Zea mays
  misc_feature: Ceres CLONE 1449010-F
  misc_feature: Encodes the peptide sequence at SEQ ID NO. 45351
  misc_feature (295)..(295): n is a, c, t, g, unknown, or other
aagctggagctcaccgcggtggcggccgctctagaactagtggatcccccgggctgcaggaattcgcacgagaccattacctagaacatcctaatcgaaaagaggatcccaagttcccttcacaaactgcagggggaggcgaacctcgtgcagcgcgtccatggcgaagcaggcggcgaataagatgaaggacgagaacaagaagcgcttggacttactcctgcgcatcatcctcgtatccaacgttatttacatagtggtgaagatggctataatgcattcatccttcacctgncaagcatggattggccttatggtacatcggccggatattgtctacctataagcactcgcagtatgtcaaggcacgttctctgatacgaagactactggatgttgctccactcagcctgggggggtggcaggtttaaagatggatcaaccccctgctgggcaatgaggcatcgttcgaaaatttggggcaatttagggtccccttggcggccaaaatcccggttgggaaggactttttccggggggccccggggggggggaagataaccccccaaaaatgggaaaaatggaaaaaacctcggggaaaaaatacaaaaagccccctggaaaactctcgcgcccgtacaaaaaaaaatgggtggtttttacaaatctggggccccccccacaaggggtcaccataatgtaagaatttttcttcctcccgccccc

SEQ ID NO: 45351 - protein, 61 aa, Zea mays
  misc_feature: Ceres CLONE 1449010-F
  misc_feature (45)..(45): Xaa is any aa, unknown, or other
MAKQAANKMKDENKKRLDLLLRIILVSNVIYIVVKMAIMHSSFTXQAWIGLMVHRPDIVYL

SEQ ID NO: 45352 - DNA, 814 bp, Zea mays
  misc_feature: Ceres CLONE 1449013-F
  misc_feature: Encodes the peptide sequence at SEQ ID NO. 45353
aagctggagctccccgcggtggcggccgctctataactagtggatcccccgggctgcaggaattcgcacgagaccattacctagaacatcctaatcgaaaaagtccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgcctctccgagctcggcgtccgccagtgggcccagtgggggtgcgagaagagcaagttcccgtggacctactccgccaaggagacgtgctacctgctgcaggggaaggtgaaggtgtaccccgaaggccacggggaggagttcgtggagatcggggttttacacccccccctcttccccaaggggcatgagctgccccctggaacgtcccccaaggcccgtcaaaaagccattaaacttttaagtagcccgccgcccgccaaataggccctgtgggcgctcaagtgaaaaattggctggggctttggacctccgaaccccccggggaaaaaaacccccgggaaaaggggaacaaaaaaacggggcatatcgggtttcacaaacccgtccgggtaggcggggaataaaaacccagaacatttccccccaaaaaaaaaaaaaaaaaaaagttttttattcccccgccccccggggggggggggggcggggccacatatccccgcaaaagggaggggataaaacaccgccctcccggggggggtttttttaacccggggggcggggt

SEQ ID NO: 45353 - protein, 105 aa, Zea mays
  misc_feature: Ceres CLONE 1449013-F
  misc_feature (19)..(95): Pfam Name: Cupin_3 Pfam Description: Protein of unknown function (DUF861)
MATEKLGIKVERNPPESRLSELGVRQWAQWGCEKSKFPWTYSAKETCYLLQGKVKVYPEGHGEEFVEIGVLHPPLFPKGHELPPGTSPKARQKAIKLLSSPPPAK

SEQ ID NO: 45354 - DNA, 777 bp, Zea mays
  misc_feature: Ceres CLONE 1449016-F
  misc_feature: Translation starting site: 186
  misc_feature: SWISSPROT Homolog: EC 1.4.1.2 Glutamate dehydrogenase
  misc_feature (455)..(455): n is a, c, t, g, unknown, or other
aagctggagctccccgcggtggcggccgctctataactagtggatcccccgggctgcaggaattcgcacgagaccattacctagaacatcctaatcgaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaacccagtcgccatgaaacccatcaacaccgtctttgatgccaagcgtctcatccgcaggagggtcagtgatgcgtctgtccagagtgatatncagttgtggcccttcaagtcatttctgggcctggtgagaacccatgattggtgccaccccagggtgaggagagcattttgcacctaaaaaatccctccaggggtctaacaaaggcgggaaattggtgagctttccctgggaacccgatcaaaatgggtggggcccaggcccccgccatttaagggcccccaaagggcgggcccaaagggaaccggggggaatccccggccttaaagggcgggggtataaaaaaaaaacaacaggggggagtttttccccttgggtttttaaaaaaggccccccttttgggagaaaaaaaatc

SEQ ID NO: 45355 - DNA, 749 bp, Zea mays
  misc_feature: Ceres CLONE 1449019-F
  misc_feature: Encodes the peptide sequence at SEQ ID NO. 45356
  misc_feature (537)..(537): n is a, c, t, g, unknown, or other
  misc_feature (601)..(601): n is a, c, t, g, unknown, or other
  misc_feature (624)..(624): n is a, c, t, g, unknown, or other
  misc_feature (654)..(654): n is a, c, t, g, unknown, or other
  misc_feature (718)..(718): n is a, c, t, g, unknown, or other
  misc_feature (726)..(726): n is a, c, t, g, unknown, or other
aaccgctggagctcaccgcggtggcggccgctctagaactagtggatcccccgggctgcaggaattccgcacgagaccattacctagaacatcctaatcgaaaaaagagatgggtgggtcttgtgtccagtcggggtgggagttgggctcgtgcagtgcagtgcagtgcactgcaggtgcagtcttgctcgcctgtcttccctcggcaccgggacagcggacctccaccgcaactgggccatctgttctccttcctcctccttcctccgccaccgcgcttctgaggaggctagggcgatgcaaccgcttccgctttgttattagcaaagggtaataacagggcccgttatcatcatgcaaatccaaatccaattccctcccaacatctcttgcgttgattttgcaggaaccgtccgagaacgggcagccaattctccgatgccgtccgctatggccaaatccctcctcctccctcaccctttcttctccgtctcaccccgcccacaccctcatccgcgcgccggattccctgttctncagccccgccgcgccgcgctgctcgcggccacgcccgcgccggaacgcaacaccagctccaacnaacaccccctcgcgcgctctggnggcgcaccctgcagcccctcggcgactacngcttcggcaagcgcagcgtctgggagggcggcgtcggccctctcatggtctccgggggcgcccntctcgccntcggcctcccatggctcagggga

SEQ ID NO: 45356 - protein, 103 aa, Zea mays
  misc_feature: Ceres CLONE 1449019-F
  misc_feature (55)..(55): Xaa is any aa, unknown, or other
  misc_feature (94)..(94): Xaa is any aa, unknown, or other
MPSAMAKSLLLPHPFFSVSPRPHPHPRAGFPVLQPRRAALLAATPAPERNTSSNXHPLARSGGAPCSPSATTASASAASGRAASALSWSPGAPXSPSASHGSG

SEQ ID NO: 45357 - DNA, 767 bp, Zea mays
  misc_feature: Ceres CLONE 1449024-F
  misc_feature: Translation starting site: 90
  misc_feature (364)..(364): n is a, c, t, g, unknown, or other
  misc_feature (407)..(407): n is a, c, t, g, unknown, or other
  misc_feature (409)..(409): n is a, c, t, g, unknown, or other
  misc_feature (411)..(411): n is a, c, t, g, unknown, or other
  misc_feature (413)..(413): n is a, c, t, g, unknown, or other
  misc_feature (414)..(414): n is a, c, t, g, unknown, or other
  misc_feature (416)..(416): n is a, c, t, g, unknown, or other
  misc_feature (448)..(448): n is a, c, t, g, unknown, or other
  misc_feature (478)..(478): n is a, c, t, g, unknown, or other
  misc_feature (563)..(563): n is a, c, t, g, unknown, or other
gcggtggcggccgctctattatcaatggatcccccgggctgcaggaattctcacgagaccattacctagaacatcctaatcgaaaaaaaatggccctcgagctcaccaccaccccactcgcgcatctcgcccttgccacgccctcgatcttcagctcccaatcctcgcggctgctgctcccgcggcgcgcgtcgcccgcccccgtctccctctcccaccgccgcatcatcgcgggcgtcgcgaccaaggaacccgagctcggcggcggcggatcctgggccggctacggtgccggagggagcggcggcggcagcgaccccaggggaggacggcaggaaggagacgggtagtaagagaagatggnatagggtctgttcatgacccataaactcttggccccccccccncncncnncngagctggtggtggaatgggatatatgaacagnggacgccagaaacccatgactgccggaagnatatcacccctagtcctgtacgacgtccagactcaactcccagtgaagactgtcctcggatcatcaatcggtttacgaatatcgnacgccctactgtcagtacaaggggatcccccttcaagaagtctaggaaagtattccctggccggaatcaaggtccccttgtatccctggcttattgccggaaggctaccttcaaagggaaaatttgccctagctccacacctcgatgaaaacaaccggggagacctcttactagacgctcaaatagcattattgcgatcactcc

SEQ ID NO: 45358 - DNA, 753 bp, Zea mays
  misc_feature: Ceres CLONE 1449026-F
  misc_feature: Encodes the peptide sequence at SEQ ID NO. 45359
ggagctccccgcggtggcggccgctctagaactagtggatcccccgggctgcaggaattcgcacgagaccattacctagaacatcctaatcgaaaaaaaaaaattctcgtgttcttcgaccggtggtggtggtgcgaacgcaaggcgaccaaggggaggcgagatgaggggggcgaagcggccgctcagcgtggtgacgtcgtgggtgcggcggcagccgcccaaggtgaaggctttcttggccgttgtcaccggcatggccgcgctcgtcttcatccgcttcatcgtccacgaccatgacaacctcttcgtcgctgccgaggctgcgcacgcgctcggcataggcgtcctcatctacaagctcaccaaagagaagacctgcgccggactatccttcaagtctcaggatttaactgcgttatttctagctgttagactgtactgcagctttgtcatggagtatgacatccatacaattctggacagtgctacacttgtagcgacactgtttgttatttatatgatacggttcaaactgaggtcaacttatatggtggacaaggataactttgcattgtactatgtggtgctaccatgtgctggactggcactacttgttcatccttcacatctcataacattgtgaaccggatctcctgggcgttctgtgtttatttggaagctgtttcagtgctgcccacattacgcttgatgcaaaatactagatagttgaaccgttacagctcactatgt

SEQ ID NO: 45359 - protein, 160 aa, Zea mays
  misc_feature: Ceres CLONE 1449026-F
  misc_feature (47)..(161): Pfam Name: ER_lumen_recept Pfam Description: ER lumen protein retaining receptor
MRGAKRPLSVVTSWVRRQPPKVKAFLAVVTGMAALVFIRFIVHDHDNLFVAAEAAHALGIGVLIYKLTKEKTCAGLSFKSQDLTALFLAVRLYCSFVMEYDIHTILDSATLVATLFVIYMIRFKLRSTYMVDKDNFALYYVVLPCAGLALLVHPSHLITL

SEQ ID NO: 45360 - DNA, 673 bp, Zea mays
  misc_feature: Ceres CLONE 1449027-F
  misc_feature: Encodes the peptide sequence at SEQ ID NO. 45361
  misc_feature (370)..(370): n is a, c, t, g, unknown, or other
  misc_feature (398)..(398): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
ctggagctccccgcggtggcggccgctctagaactagtggatcccccgggctgcaggaattcgcacgagaccattacctagaacatcctaatcgaaaagagagccgtgccggggaagagaacgcgccgcaccggacagcgaacgcgaccaaaccaagccatggcagccaaccccaaccactgcctccgccgcctcgcctcagctctctcccacggtccccggcctccgactcctcccctatccctcctcttcccccgcctcgcgctctccagctccggcccctccacgggcccgccgccgccgccgccgaatgcccgtaaggaagggggagggagaggaaagcgcggaagctagggccgccgaagcgacnccgaagcggggaaggaggagagcatgangccgacggcgtgcgcacgtgaacaaggcaccgcgaagtcggcggccgcgggggcccgacccacaagtacgggactggaagcgcgccgccgctgctccatttctgacccgccctggccccagggaggccctcaacttcgcccgaaccggggatgggtcccacaaccaggggatattccgcgcggggaaaaaggcccgtgcccccaaaaaaaaannnnccttaaatggtttgttccccgggaaaacatgaaaaccggtaaaattcccccaaaaaaaa

SEQ ID NO: 45361 - protein, 64 aa, Zea mays
  misc_feature: Ceres CLONE 1449027-F
MAANPNHCLRRLASALSHGPRPPTPPLSLLFPRLALSSSGPSTGPPPPPPNARKEGGGRGKRGS

SEQ ID NO: 45362 - DNA, 750 bp, Zea mays
  misc_feature: Ceres CLONE 1449028-F
aagctggagctccccgcggtggcggccgctctagaactagtggatcccccgggctgcaggaattcgcacgagaccattacctagaacatcctaatcgaaaaaagagaatagagattagggttcgtcccgcacagccgcacaggcgcgtcccgacgtcccgcactcctgccggcgctcgttccttcaggcctccagcctccggccgctcgcccgctcgaccgcagaccgctcctggcggcgctccagcctccagccgctcggagcctcggcacgctccgcgctccagccgtccgctccgacgctccgctgatctgcttgtctggttgtcttgtcccgcccggcggccggctgcttgccgcttggtcccgccgaggcgtcgacccacaccgcacggctgccacctgccgctgcttcctgcttggtcgcacgtctgcttgtctagttgtctgcttggctgcttgcttagtgcttctagttgtctgcttgcttcgtgcttctgtgcttctagttgtctgatggtgtgacttgtgagacttgtgagcatataaaggtcaaaggtagcgcgtgagtatttgattatgcgtgtctaatctattagatttttcgatgtgcagatttttcaatttctaaatagcagtcttggatacaaacaaaaacaagacaaagaatatggcccaaaaagtatctctatattatgtgaacactccctgttgcctgttgtaacgtcttctaattctctaatacatgcta

SEQ ID NO: 45363 - DNA, 712 bp, Zea mays
  misc_feature: Ceres CLONE 1449047-F
  misc_feature: Encodes the peptide sequence at SEQ ID NO. 45364
ctccccgcggtggcggccgctctagaactagtggatcccccgggctgcaggaattcgcacgagaccattacctagaacatcctaatcgaaaaatgcctctatggctctatctcatggcgacggcgacgtcgtcggcgccgctgctcccgaagcccgcactccgagctgcgtcctcttcttctctacacaccccaaatccaaggtccaagatacagcgagccaccccagaacagcaggaccaacatgtcgacaccaagtggaggaggcagccgagggccccgccccggcgcggcgagggagccaagagacgcctgcgcagcctcgtccagcgcggggaaatcgacgaagcgctcgtgctcttcgattccatggcctccggcggcggcaggaactgcccgcccgttgtcccctgcaacatcctcatcaagcggctgtgctcggacggccgcgtctccgacgcggagcgcgtgttcgcggcgctcggcccctccgccaccgtcgtcacctacaacaccatggtaaacgggtactgccgcgccggccggatcgaggacgcgcgccgcctcatcaacggcatgccgttcccgccggacacgttcacgttcaacccgctcatccgcgcgctctgcgtccgcgggcgcatccctgacgccctggcggtgttcgacgacatgctccaccggggatgctccccgagcgtcgtcacctacag

SEQ ID NO: 45364 - protein, 199 aa, Zea mays
  misc_feature: Ceres CLONE 1449047-F
  misc_feature (162)..(196): Pfam Name: PPR Pfam Description: PPR repeat
MATATSSAPLLPKPALRAASSSSLHTPNPRSKIQRATPEQQDQHVDTKWRRQPRAPPRRGEGAKRRLRSLVQRGEIDEALVLFDSMASGGGRNCPPVVPCNILIKRLCSDGRVSDAERVFAALGPSATVVTYNTMVNGYCRAGRIEDARRLINGMPFPPDTFTFNPLIRALCVRGRIPDALAVFDDMLHRGCSPSVVTY

SEQ ID NO: 45365 - DNA, 743 bp, Zea mays
  misc_feature: Ceres CLONE 1449053-F
  misc_feature: Encodes the peptide sequence at SEQ ID NO. 45366
  misc_feature (485)..(485): n is a, c, t, g, unknown, or other
  misc_feature (544)..(544): n is a, c, t, g, unknown, or other
  misc_feature (582)..(582): n is a, c, t, g, unknown, or other
ggagctccccgcggtggcggccgctctagaactagtggatcccccgggctgcaggaattcgcacgagaccattacctagaacatcctaatcgaaaaggaaaaccctaaccccctttctcggcgacgatccgacccctaccccatctcccggccgaccccacggcgctctccgccatgccggacgtgcaacctctcgtcagcgacttcgtcctcaagctcaagcgccggaaggtggaggggtcgcacgcggtggcccggcagacggcggagctgctacggtcggttgtgtcgcagcatcggatgggtagcagcgccaaccaggcggccacacttgccgatgccgtacgggctgtgggggagcagctcattgccgccaatcccattgagcttgctgttggaaacattgtgagacgtgttttgcatataataaaggaggaagatatatcttccacagcagttggtatcgaaggtcttttctgtactgntgacagtgatgatgaatatgacagcgaacatgatgatcgcccctgcatatctgctgctngtcctgctgcacatgctagaaatgcccttcgtgcaccntcattgcagactctgctagaagaacttccctgtgagtcttggcaatttcccgactgcatcattcactggtggactcaacggaaaaagtaaatcgcctggaaataaagctcacctaaaaactgaacctggttgcctcccacccttgggggatcttatggaaa

SEQ ID NO: 45366 - protein, 165 aa, Zea mays
  misc_feature: Ceres CLONE 1449053-F
  misc_feature (104)..(104): Xaa is any aa, unknown, or other
  misc_feature (124)..(124): Xaa is any aa, unknown, or other
MPDVQPLVSDFVLKLKRRKVEGSHAVARQTAELLRSVVSQHRMGSSANQAATLADAVRAVGEQLIAANPIELAVGNIVRRVLHIIKEEDISSTAVGIEGLFCTXDSDDEYDSEHDDRPCISAAXPAAHARNALRAPSLQTLLEELPCESWQFPDCIIHWWTQRKK

SEQ ID NO: 45367 - DNA, 747 bp, Zea mays
  misc_feature: Ceres CLONE 1449066-F
  misc_feature: Encodes the peptide sequence at SEQ ID NO. 45368
aagctggagctccccgcggtggcggccgctctagaactagtggatcccccgggctgcaggaattcgcacgagaccattacctagaacatcctaatcgaaaaatcctagactacgcggtctctttcttccttctctctactttcttcctcaccaaattcggatcaaacaaattcgttaaataatctcagaaaacacaaggttaacgggatcgaagggattaaaacgaaaacgttccgatcctgtggccaggtctcggtgctaatcgtgtgttttttttggggggtgggattttgtgatctgttgttagggtttcggatctggaggattagttatcccaagttccgagtcagaccatgaatgagcagctgatgcgaccaccggcgccgctgccgttccaccagatgtgggcggcggtgccggcgatggagcctcctttcaagccggtgcgggcggcgtggaagcgggcggcgcggacgccctggaagcgcaaggcccagcctccggcgtcaggcggcgcgaggtggggcggtgcggcggccccgcgcaacacgacgtcgttcctgatccgcgcgaagcatgcgggtggcgtggcgtccctggtgtccccgtgccccgtgacgccggcggtgctcccgacgcccgtgctgtcaccagcgcgagaggtgctggtggagatggccaatgatgcgtggagcgtggacgggtacgggtccatgaatggcctcatccgactgcgcgtcgacgccc

SEQ ID NO: 45368 - protein, 131 aa, Zea mays
  misc_feature: Ceres CLONE 1449066-F
MNEQLMRPPAPLPFHQMWAAVPAMEPPFKPVRAAWKRAARTPWKRKAQPPASGGARWGGAAAPRNTTSFLIRAKHAGGVASLVSPCPVTPAVLPTPVLSPAREVLVEMANDAWSVDGYGSMNGLIRLRVDA

SEQ ID NO: 45369 - DNA, 707 bp, Zea mays
  misc_feature: Ceres CLONE 1449074-F
  misc_feature: Encodes the peptide sequence at SEQ ID NO. 45370
ggagctccccgcggtggcggccgctctagaactagtggatcccccgggctgcaggaattcgcacgagaccattacctagaacatcctaatcgaaaaacagcagcaagcaaagcaagcaagagatagacaagcagctccagtccaaccaagaacaaacaacaaccgcagcaagaggagaggaggctcaccggtcgcgaccaaattctcccagagacggtcggaaatgaggagccaagcgctgttcttcctcacgatcgcccttctcaccgtgctcgcgcgatccagcaacaggcaccaccaccaccactcccacgttcaaagcagaggtatgtaggaaagcttaactagttcaagatttgtcctttcggttattcagtctggctggctcacggggttccgaatcggtctgcggcttcagggcaggagcagcatcaggaggaggaggaggaagaggggagctggcgagccgggtgaacgcaccggcggcggcgccgacgcacgcgtcgccgcgctgctagcgctgcgctggctgcacatgtaagatgcgcagcagtgacgatgcccggacgaggcttcatcattgagccacctagtacgacagggatgattaaagctgagtcttggcccacatccacttggcgaccacagccagaaccgtgttccccacttctgtaggtaccgatgagcctggcaccccttcttcgcag

SEQ ID NO: 45370 - protein, 36 aa, Zea mays
  misc_feature: Ceres CLONE 1449074-F
MRSQALFFLTIALLTVLARSSNRHHHHHSHVQSRGM

SEQ ID NO: 45371 - DNA, 773 bp, Zea mays
  misc_feature: Ceres CLONE 1449079-F
  misc_feature: Encodes the peptide sequence at SEQ ID NO. 45372
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (20)..(20): n is a, c, t, g, unknown, or other
  misc_feature (424)..(424): n is a, c, t, g, unknown, or other
aagcgccgagnnnncgcggncgcgcctctaaccctcaataagaaaaaagaaactattaatgcggtgctccccggcggaggcggccgctctagaactagagcatcccccgggctgcaggtattcgcacgagaccattacctagaacatcctaatctaaaaacgttttaccccgtccggccgtccccctcgttctttcactcccccttctctctcgctgcgacgactgggtaggctgccgccgccgccctacgccaggtcccgaggaccaaagcattcctattcgtcagtctcttcgccgggcgacgccaggtttcggaatgatttgtgcaacaattgtaagcgtcctgggatttttgctagagagtgtcctagcgtggctgtctgtcatacctgcaggcttcctgggcacatagcaacaaaatgnacatccaaaggtaccatgctggaactttttaaacccctggccacctccccccaaatatgcctaaattaatggattagtcccttaactggcggcaagtcccggacatattgcaaagagattggtcttggtccatccaggccctgccaggatgaagtgagtcctttagaagcaactagctacaatatctgaggttatttttcagtgagaaatagcacccaatggagaaaaggcttgctaacaattactcccggcagtaggaggcgcgttatttggtccgggatagtgtcaccaaagggaatccgggaatcgccctacctcggggcaatagttagtctaggcccaccctgaa

SEQ ID NO: 45372 - protein, 31 aa, Zea mays
  misc_feature: Ceres CLONE 1449079-F
MICATIVSVLGFLLESVLAWLSVIPAGFLGT

SEQ ID NO: 45373 - DNA, 792 bp, Zea mays
  misc_feature: Ceres CLONE 1449087-F
  misc_feature (332)..(332): n is a, c, t, g, unknown, or other
  misc_feature (772)..(772): n is a, c, t, g, unknown, or other
ggatcccccgggctgcaggaattcgcacgagaccattacctagaacatcctaatcgaaaacgctgaggccgccgcgcgcgcgtacgaccgcgccgcgaggcgcatcaggggagccaaagccaaggtgaacttccccagcgacacctcctccagcgtcaccgtgccgacggcggtgtcgaggtctgctgctgctgctgctgcacaggccccggccgttctcccgctgcccaaggtggaggcacagactcaggtgtccgacgaggtcaaggagttgtccgaggagctgatggcctacgagaactacatgaacttcctcggcatcccttagatgnaagaaggaactagagctgcaagtggcactacagttgcccccaaccccgccccccggcgtcccccaaagaatcccaggggcccggctccggccggggctgtgaagctttcgaaaaataatactaccccggcggctcctggccgcccttttaatggaaatgagaaaagggggtttttaaccgtgccctgtttgtggggaaaccccttttgtggaaaaaaaatttcccgcgccctccctaaagccggggggcagtgttgtgggctatcaaactaaaccccccgcctctgtaatttttcgtgaaccccccccctagtttttggagaaaaatggtgggtcccccggtctcccccaaaggtggaggctccacgttcttcttttttctctcctaacaaaaacaaaaaaccttttctttcccgctcgcgctctggggggggcggtggnccccctcaccgccatttggg

SEQ ID NO: 45374 - DNA, 708 bp, Zea mays
  misc_feature: Ceres CLONE 1449092-F
  misc_feature: Encodes the peptide sequence at SEQ ID NO. 45375
  misc_feature (560)..(560): n is a, c, t, g, unknown, or other
  misc_feature (572)..(572): n is a, c, t, g, unknown, or other
ggagctccccgcggtggcggccgctctagaactagtggatcccccgggctgcaggaattcgcacgagaccattacctagaacatcctaatcgaaaaatcggatgtgtcgccgcatcagcagcgtggctatccattccatccacacccacaatattattccatcccatccacatctacctcctgcattatttattatatatggatcggattgcttgctttcagcagccacacagtattgctcatggctactgcttgtgttccgacggtggatgcggaggaagcatgcgccctcctcagctcttccacacaccactatctggatgtcaggatgtgggaggattttgacaagggccatgtcgccggtgctcggaatgttccctactacctctccgtcactccgcatgggaaggagaagaatccccagtttgtggaacaggtttccgcgctctacgccaaggaacaaaacttgatttgtggttgccgctctggcatccggtccaaactcgccactgcagaactcatcaaacgcggcttcaccaaacgtgagaaacctacaggcngatacctttccnttgctcgaagcgcaaactagctagcttcctgcttatttgttcgcatgcttgtataaatgagtcaactatgcttgaaagactgttcatgaagaagcgcatccactcatcatgaaaaaaaaaaaaaaagctatcgatc

SEQ ID NO: 45375 - protein, 116 aa, Zea mays
  misc_feature: Ceres CLONE 1449092-F
  misc_feature: SWISSPROT Homolog: EC 2.8.1.1 Thiosulfate sulfurtransferase
  misc_feature (107)..(107): Xaa is any aa, unknown, or other
  misc_feature (111)..(111): Xaa is any aa, unknown, or other
MATACVPTVDAEEACALLSSSTHHYLDVRMWEDFDKGHVAGARNVPYYLSVTPHGKEKNPQFVEQVSALYAKEQNLICGCRSGIRSKLATAELIKRGFTKREKPTGXYLSXARSAN

SEQ ID NO: 45376 - DNA, 768 bp, Zea mays
  misc_feature: Ceres CLONE 1449101-F
  misc_feature: Encodes the peptide sequence at SEQ ID NO. 45377
aagctggagctccccgcggtggcggccgctctagaactagtggatcccccgggctgcaggaattcgcacgagaccattacctagaacatcctaatctaaaaagaggaggagacgtcacgcctgcgcggctgcgcccaccatggacgaggatgagtttcggcgcatgctcgacctcttcccggtcgtccgctcccgagactactgctgctccgatcttggaacatcccgcacaggaacctcacagcgatcacgagttcaagaggcaactaagggcgataataacgactcgtccggtggacgagatatgtttatgctgaaattgaagatggctgcggagaataagattggagcgacaaaggcagagttcttctgctagacattcaaaaaaattcatgagaaacttgttcacagagagctgacccaggatgctgctaacaagttcctgagcgcatatgagagctgatgatgaacaataagtcacatgctgcttaagggtgcggtagttgccactgatctggaaagttgttgatgctgttgagattttgatcacaggcaaacttttaacaacaggtacatgctgttgagcgcatactgataccgcctgattggttcaccgatcgcccgtagccagctcgtatgcagccaggctgtccagagactgttatttgggccgtagaagtggatgcactctaaataaatgttgcgtttgataaagaaaaaatacagcttatcgataccgtcgacctcgagggggggcccggtacccac

SEQ ID NO: 45377 - protein, 78 aa, Zea mays
  misc_feature: Ceres CLONE 1449101-F
MDEDEFRRMLDLFPVVRSRDYCCSDLGTSRTGTSQRSRVQEATKGDNNDSSGGRDMFMLKLKMAAENKIGATKAEFFC

SEQ ID NO: 45378 - DNA, 714 bp, Zea mays
  misc_feature: Ceres CLONE 1449102-F
  misc_feature: Encodes the peptide sequence at SEQ ID NO. 45379
  misc_feature (714)..(714): n is a, c, t, g, unknown, or other
tggagctccccgcggtggcggccgctctagaactagtggatcccccgggctgcaggaattcgcacgagaccattacctagaacatcctaatcgaaaaattctcgaagtcgctgcggcacgcgtcccgcttctggtttgcttgcctgttgcctcccagatcttgccaactaattggaggcagccgagctgatctcccattctcccatcccgcaacgcgccgtctcgacggcggatcggtttcttctgcttctactgcgtgatctttgggcaagaagataagacacgtccaagcgtcgccacagtcaaggtgagaagaaaagttccccctctcctgcagtcctgttactccagttggttcgccgcatgcagtgcttgcctttgctcagtaacgtgcgtgctccattcatccatggcgcagcaaacccattcggtatcggtagtgagttagtgaccgaattttgtaaccgcatcatgcagggcggcttggttgcaggcaagatggggaaggacggagaatctgccaagctgaaggaggagaaggagtccaaggaagagatccatgtgaaggtcaagagcaagggcgagcggtccggcgaggaagacggcaaggaggaggtcgaggtagagattgaggccaagtttgttgagaaggaagaggtcaaagactcgggtgacggtgcgggaggaaagggtaccaagaagaaggatacaaan

SEQ ID NO: 45379 - protein, 116 aa, Zea mays
  misc_feature: Ceres CLONE 1449102-F
MQCLPLLSNVRAPFIHGAANPFGIGSELVTEFCNRIMQGGLVAGKMGKDGESAKLKEEKESKEEIHVKVKSKGERSGEEDGKEEVEVEIEAKFVEKEEVKDSGDGAGGKGTKKKDT

SEQ ID NO: 45380 - DNA, 729 bp, Zea mays
  misc_feature: Ceres CLONE 1449109-F
  misc_feature: Encodes the peptide sequence at SEQ ID NO. 45381
ggagctccccgcggtggcggccgctctagaactagtggatcccccgggctgcaggaattcgcacgagaccattacctagaacatcctaatcgaaaaatcaaccctaaaccacccactatacccgcccgcccggctagggttttgccaccatggccgccgccgcggccgccgcccggaggctcctctcccgccgcgcctcctcgaactcgctctccgcgttcctccgccgcggcgctgccccggagcagtcgctgctgcgcccggccgtcgtcgcggcggcctcccgcctcggcttcccgcgcgggatggcgcggcgacctggcggggacggctacggcgcgggccgggaccgcgcgcccacggagatggcgcccgctgtccccggctgcgactacgagcactggctcatcgtgatggacaagcccgcggggagggcgccaccagcagcaatgatcgactgctacatccaacccctcgcaaggccctcggaatggaggagaggcaaaaaaaaaatttcaacgtcccgtgcacccttattcgggttcgggggcaaaacataaaggaaactctaaaaggccggggggccccggggggtcctttgggcccccaattccatttttcccccggtataaaggaacccggtttttaattgttttcaaggggaaatttttcaaagccccccaaaaaagaaaaaaaggggcaccccccccacaaaaggtgggtaaaaac

SEQ ID NO: 45381 - protein, 136 aa, Zea mays
  misc_feature: Ceres CLONE 1449109-F
MAAAAAAARRLLSRRASSNSLSAFLRRGAAPEQSLLRPAVVAAASRLGFPRGMARRPGGDGYGAGRDRAPTEMAPAVPGCDYEHWLIVMDKPAGRAPPAAMIDCYIQPLARPSEWRRGKKKISTSRAPLFGFGGKT

SEQ ID NO: 45382 - DNA, 669 bp, Zea mays
  misc_feature: Ceres CLONE 1449111-F
  misc_feature: Encodes the peptide sequence at SEQ ID NO. 45383
ctggagctccccgcggtggcggccgctctagaactagtggatcccccgggctgcaggaattcgcacgagaccattacctagaacatcctaatcgaaaaatcaactgatcaaacagagacaaacctatactgctacatgcataatggttggtacatggtaaaactatagcaagctaaggtcgatcgctcgtctatagctagaccactaccacctccatggtttcttgactgatagatagacggacgagaatgaagaagctagctagctactagatatatcatcagtagagtgttcagttgttgatgatggcctcctccttgcccctggtcaccactgggctgcgccatcctcctcctccgcagcagtcgccgagggtggtcctgcagagcgaggacccgaccgagtggtgcgcgtgggcgcaccaggggcaccgcctgtgggtggccatgccggactccttctgggtgtacacgtacaaggtggaccggtgcccgttccggggcaaccacgtgtggacgacgtgcccgtacgcgcactggggggagcgcgcgcgccgccgcgaccccagccgctacgcgtacgccgccgcgacgtgcccggactacgccgactccaagcgccggaaccgcctggccgggtccaccgcgccccccacctgcgcgcgcggcc

SEQ ID NO: 45383 - protein, 122 aa, Zea mays
  misc_feature: Ceres CLONE 1449111-F
MMASSLPLVTTGLRHPPPPQQSPRVVLQSEDPTEWCAWAHQGHRLWVAMPDSFWVYTYKVDRCPFRGNHVWTTCPYAHWGERARRRDPSRYAYAAATCPDYADSKRRNRLAGSTAPPTCARG

SEQ ID NO: 45384 - DNA, 759 bp, Zea mays
  misc_feature: Ceres CLONE 1449112-F
  misc_feature: Encodes the peptide sequence at SEQ ID NO. 45385
  misc_feature (525)..(525): n is a, c, t, g, unknown, or other
  misc_feature (537)..(537): n is a, c, t, g, unknown, or other
ggagctccccgcggtggcggccgctctagaactagtggatcccccgggctgcaggaattcgcacgagaccattacctagaacatcctaatcgaaaaaaactatgccttacgcaccagctcagagctatccacctaatgcaatccctccaccttatatgcaaccacctagtggacctgctcctccttactatgggcagcaaaaccctagcatgtatgaacatcctgcaggccgggctaaccctgggccaccatcatcctacggttctggtgggtacgggccacagggtggaggtagtttctctgaatcttatggttacagtggatctccttcccaccgtggcaatgctggaatgaagcagtcttcaccttttgctcaatcctctggaggaagcggcagctatggcagtggcaagctccctactgcccagatgcttccacaagcagtgacgatcagctcctccagcacccagcggtctttctggcatagagtgccacttgacgatgtagtggaagaaagtgctacgnatggattctcangagagcaggtgaaagcaacccgtgcgaagctgactgaaaacgggcagaacgtggacctgaatgttgtgctcgacagctgatgacggatgaatagttgagcaaaactgtcattccacgacccgaacaatattatgaaactggaaaagggcccctcatcccctgaaacaattttctgtcggcaccgtgcaacccgaatttggcctggaaaaaaaatggccaaaa

SEQ ID NO: 45385 - protein, 171 aa, Zea mays
  misc_feature: Ceres CLONE 1449112-F
  misc_feature (142)..(142): Xaa is any aa, unknown, or other
  misc_feature (146)..(146): Xaa is any aa, unknown, or other
MPYAPAQSYPPNAIPPPYMQPPSGPAPPYYGQQNPSMYEHPAGRANPGPPSSYGSGGYGPQGGGSFSESYGYSGSPSHRGNAGMKQSSPFAQSSGGSGSYGSGKLPTAQMLPQAVTISSSSTQRSFWHRVPLDDVVEESATXGFSXEQVKATRAKLTENGQNVDLNVVLDS

SEQ ID NO: 45386 - DNA, 669 bp, Zea mays
  misc_feature: Ceres CLONE 1449113-F
  misc_feature: Encodes the peptide sequence at SEQ ID NO. 45387
ctggagctccccgcggtggcggccgctctagaactagtggatcccccgggctgcaggaattcgcacgagaccattacctagaacatcctaatcgaaaaatttcccactcgatcgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtggggccggggacgcctacggccacagcggccaaggctacgcgcccccgccggcctacggcgccgggggcgggtacggcaacgtcgtccacgtcgcgcacgaggtcggcgacgagaggccttactacggcggcggcggcggcggtcttggtggcgcctacggaggcggtggctccgagtacggccacgagggccgaccgcaccacggcggcggcggatcccagtacggccacgagacacgcccgcaccacggcggcgccccgcctgtgaggcagcagatatcgataccgtcgacctcgagggggggcccggtacccaattcgccctatagtgagtcgtattacgcgcgctcactggccgtcgtttta

SEQ ID NO: 45387 - protein, 183 aa, Zea mays
  misc_feature: Ceres CLONE 1449113-F
MEFPHHHHHHGHRRDDDEDDRRGPPPPVYGGYGQPPPPDPYGRAPVDPDPYGRPPPQSAYGGAGDAYGHSGQGYAPPPAYGAGGGYGNVVHVAHEVGDERPYYGGGGGGLGGAYGGGGSEYGHEGRPHHGGGGSQYGHETRPHHGGAPPVRQQISIPSTSRGGPVPNSPYSESYYARSLAVVL

SEQ ID NO: 45388 - DNA, 759 bp, Zea mays
  misc_feature: Ceres CLONE 1449115-F
  misc_feature: Encodes the peptide sequence at SEQ ID NO. 45389
  misc_feature (500)..(500): n is a, c, t, g, unknown, or other
  misc_feature (534)..(534): n is a, c, t, g, unknown, or other
  misc_feature (545)..(545): n is a, c, t, g, unknown, or other
  misc_feature (546)..(546): n is a, c, t, g, unknown, or other
ctggagctccccgcggtggcggccgctctagaactagtggatcccccgggctgcaggaattcgcacgagaccattacctagaacatcctaatcgaaaagtcccgcacagccgccgccgtcgccgtcgccgtgaggtcggcggtccgctccgcacctctcactggccgcgtcctcggagcgccactgccttcccttgcctcgccttccgctgcccggtccgcccgaatcctccgcaggacggcggccgcggcgtcggcggggctggagactctaatgccgctgcacagcgcggtggcggccgcgcggcttaggtcctgcatcgccgtcgactcctcgtgctggagctcgctctcgcaaggtttaaacaagcgcatctgatcatggctaggagctgagcacagaagagaagtgaggacaacgagttagaacgaagtcatctcttttgcagatatttgtaacatgtactactttggatgttgctctatgtgtttgctcatgtnctcaatggagcatgcaaaatagttccttggtacnttgctggctcnntatttcagtttggtcatgagctatgctgaaggaaaaacttgtacttgtataaaaaaaccccttcagttttttcaaaaaaaaaaaaaaaaagctatcgataccgtcgaacctcgaggggggcgccggacccaatcgcccaaaaggggccgaaataccggcgccccgggcccgcttttaaaaccgcgtgactgggaaaacccgggggtccccaat

SEQ ID NO: 45389 - protein, 34 aa, Zea mays
  misc_feature: Ceres CLONE 1449115-F
MPLHSAVAAARLRSCIAVDSSCWSSLSQGLNKRI

SEQ ID NO: 45390 - DNA, 702 bp, Zea mays
  misc_feature: Ceres CLONE 1449118-F
  misc_feature: Encodes the peptide sequence at SEQ ID NO. 45391
ctccccgcggtggcggccgctctataactagtggatcccccgggctgcaggaattcgcacgagaccattacctagaacatcctaatcgaaaaaacttccatttatgcacaggcggactcggggctcgtaccaagtaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaagtgaaaggtatggatctcgctcgccttactcgagaagcacaaggtaccgaagtcgctctaggagtgtcgactctagtgatgctgaaaaccctgggaacaacctgtatgtgactggtttgtcagctcgtgtaacgcatccacatctggacaaccacttctccactgagggtgaggggattgatgcaagcagtggtatatgatccttggacaagggaatcacggggttttgggttttgttacctcgtgtgcctgataaagatgcagatggctgcactaaatatgtggacccgttctgtgttgcaaggtactgggcttacctgttgcctaacggaaagagaagaagagggttgaacccccgaccccgggagaaagattcttgggaacaaaatcatccacgtggaacggagggctctcccacaagcttactccccctg

SEQ ID NO: 45391 - protein, 73 aa, Zea mays
  misc_feature: Ceres CLONE 1449118-F
MSYSRGSSERYGSRSPYSRSTRYRSRSRSVDSSDAENPGNNLYVTGLSARVTHPHLDNHFSTEGEGIDASSGI

SEQ ID NO: 45392 - DNA, 766 bp, Zea mays
  misc_feature: Ceres CLONE 1449122-F
  misc_feature: Encodes the peptide sequence at SEQ ID NO. 45393
aaactggaactccccgcggtggcggccgctctagaactagtggatcccccgggctgcaggaattcgcacgagaccattacctagaacatcctaatcgaaaaatccttggtctccagctccgcctcgcgtcttcctttccgctgcaggaaagtgcaaacccccactcaactaaaaaaagccgcaaggcaaagagaaaaagcaacgcgaagcaaaccaccatttcggcctccccacccccatcccatctcatcccctccgaggctccagggacggcgtgatgaggccagcggcgccggctgcggcggcggacgcgcaccagtcgcggctgctctacgagctctgcgcgctcctgctgaccgtcctcggagcgtcgccggacgacggggcgggggcgcggccgctgctgccgcggcaggtgacacctgccggggtggcgtccatgctgctgggcgcgtccatggcgctgatgctctgcggctcggtcaccttcatgctcggattcttcctcatgccctgggtcgtcgggctcggcttcctcttcctcttcgtcggcttcgtcaccaacctctccgggatctggagggccatcctcctctggccctccgccgcgtgctcgcccaaggaagcatcctccccatggcatatacttcccaagccttcattcatgtcgatgtgaatgaaggcaatcacaaagccgggctcccacggaggtgtatagaaacaggggaattcgagcagactgttttgtctttggcagcctatattt

SEQ ID NO: 45393 - protein, 132 aa, Zea mays
  misc_feature: Ceres CLONE 1449122-F
MRPAAPAAAADAHQSRLLYELCALLLTVLGASPDDGAGARPLLPRQVTPAGVASMLLGASMALMLCGSVTFMLGFFLMPWVVGLGFLFLFVGFVTNLSGIWRAILLWPSAACSPKEASSPWHILPKPSFMSM

SEQ ID NO: 45394 - DNA, 738 bp, Zea mays
  misc_feature: Ceres CLONE 1449123-F
  misc_feature (680)..(680): n is a, c, t, g, unknown, or other
  misc_feature (722)..(722): n is a, c, t, g, unknown, or other
  misc_feature (732)..(732): n is a, c, t, g, unknown, or other
aagctggagctccccgcggtggcggccgctctagaactagtggatcccccgggctgcaggaattcgcacgagaccattacctagaacatcctaatcgaaaatcaagaggtggcactcgtccagccgcatcgcccgcgcgccgccgtctcccggccccggtgaggacgaccgctgcgccgcgcgcggcgcgtcgttccacggcgcggacgaggtgcccgagggcctgcacccggtgtacgtcggcaagtcgcgccgccggtacctcgtcgccgaggagctggtgggccacccgctgttccagaccctcttcgaccgcatcggcggcggcggcaccggggcagcggcggcgggtaccgtcgtcggctgcgaggtcgtgctgttcgagcacctgctgtggatgctggagaacgcggacccgccgccggagtccctcgacgagctcgtcgagtactacgcgtgctgagacagagtcatagagcctcgccccacgccgccagctcggccgtgacgcagcgcggcccgacggtggtggaagtggaatggaagctagcttagcacggagctgctgtatcatttcgttcggcattcttgtgtgtatgtagggtagggtagatttgtgataaatggcaaatgcggggggctaaaacgcccgattgattcgcttcgctaatgtatcctcngtgtcgacgctaattttgctatggaaaatatttgcggctacnaagtcgtcgntcaaaa

SEQ ID NO: 45395 - DNA, 721 bp, Zea mays
  misc_feature: Ceres CLONE 1449127-F
  misc_feature: Encodes the peptide sequence at SEQ ID NO. 45396
ggagctccccgcggtggcggccgctctagaactagtggatcccccgggctgcaggaattcgcacgagaccattacctagaacatcctaatcgaaaaactcgagccagcctgccagccagcaagccgcttgggcgccatctctctagagcttcgtaccctcgaagagagatccggcgcggaccaataaacacccggcttactacagactcgcagatggccggcctcaggatgaagttcgtcgccgtcgccgccatggccgccgcgctcgtggcgaccgccgcaaccaccaaggcccccgccccggctcccgcgtccgacgccgcggccgccgtacccctcgccgcggcctccctcgacgccggcggcttcagctacctcttctgctatatccgcgctggatacatgattcctgctccaccatatgattcgtctggtctgacccgaggtgactccaactcgggtgcccggcgccgtctctgtgttacgttgcatcgggagcgtgtgactgccactagtcctgccaagctttgcaagaggaagaggagtgcgcatgtcggcagcaacaagttccgacgcccttggtgtgccgcaggggatcagcacctacctgcaagctcttcaggctctcaaggactcgaaacccagcttgctcatgtgaccagagtctctgattgaaggcttcacatctcattcttgtcttgcgactgcaaagcttggacca

SEQ ID NO: 45396 - protein, 153 aa, Zea mays
  misc_feature: Ceres CLONE 1449127-F
MAGLRMKFVAVAAMAAALVATAATTKAPAPAPASDAAAAVPLAAASLDAGGFSYLFCYIRAGYMIPAPPYDSSGLTRGDSNSGARRRLCVTLHRERVTATSPAKLCKRKRSAHVGSNKFRRPWCAAGDQHLPASSSGSQGLETQLAHVTRVSD

SEQ ID NO: 45397 - DNA, 761 bp, Zea mays
  misc_feature: Ceres CLONE 1449132-F
  misc_feature: Translation starting site: 548
  misc_feature: Pfam Name: Tub Pfam Description: Tub family
  misc_feature (761)..(761): n is a, c, t, g, unknown, or other
aaagctggagctccccgcggtggcggccgctctattaactagtggatcccccgggctgcaggaattcgcacgagaccattacctagaacatcctaatcgaaaagaagatcagaaaagaataatgggaggcccgcgactgtgctggggagatgcctcggcatactgcgcccgctgcgccaccatcggaccgcggcgagatgcacgaggtgggagaggcggatccggacactgaggcggaggatcaggaggagaggtgggcgacgctgctaccacacttgctctccgacgtgtagctgcgcgtcaaggcctccggcgcctagaagtggccggcgcgaaaagacctcgactctttcgcctgcttgtgacgttgggggacgaaggcctaaatgtccgctgagcgtccgtccggccccaccccccaagatctccttcccctcctcgctcaagcagccagggcctatggagaacccaatgcaatgccttatcactgcggaagaataactctacattctacctctaccttggctgcacgagatcacctgtgtagatgggcaagtttctcatggctgctagtagacttaggcgcggcccccatactgaggacattacatctcttgatgctgaggactcttcacaaagaagcaattcgtacatgcgaaaactgagatctgattcgtgggggaccacctgcaaatttatggtagctagccccgatatgacggcgctcactcatcagtagtcggatctatcatcgttgcaan

SEQ ID NO: 45398 - DNA, 773 bp, Zea mays
  misc_feature: Ceres CLONE 1449134-F
  misc_feature: Translation starting site: 211
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (427)..(427): n is a, c, t, g, unknown, or other
  misc_feature (514)..(514): n is a, c, t, g, unknown, or other
  misc_feature (515)..(515): n is a, c, t, g, unknown, or other
naagacccnnncaaaagatggagctcaccgcggtggcggccgctctagaactagtggatcccccgggctgcaggaattcgcacgagaccattacctagaacatcctaatcgaaaaatcaacaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctccatcgccaccaccgccgtcgcccaccagcacgccgtgccctccgccgccgtccagctccggcgggaagtgccccaagaacgcgctgaaactgggcgtgtgcnccaacgtgctgggcctcgtcaaggtgtccatcggtaaggtgcccaccgactcgtgctgcccactgctggacgggctcgccgacctgnnaggcgccgtctgcctctgcaccgcgctcaaggcaacgtgctccgcgtcaaactcgacgtccccgtcaagctcaccctgctcctcaactactgggggaagaacgtccctcaaggcttcctggccgcctaaaaataaaccaaggggcatagtcggccctagcttcagttgcccaaaaaaaaaaaaaaaaagctaatggtaccctccaaactccgggggggggcccggtacccatattcccccaataggggggcgtaaaac

SEQ ID NO: 45399 - DNA, 691 bp, Zea mays
  misc_feature: Ceres CLONE 1449150-F
  misc_feature: Encodes the peptide sequence at SEQ ID NO. 45400
  misc_feature (432)..(432): n is a, c, t, g, unknown, or other
  misc_feature (433)..(433): n is a, c, t, g, unknown, or other
  misc_feature (537)..(537): n is a, c, t, g, unknown, or other
acccgcggtggcggccgctctagaactagtggatcccccgggctgcaggaattcgcacgagaccattacctagaacatcctaatcgaaaagagcgagcagggagagacacggcaccgagtgaggccgccgcatcctcctcctctccgatccgtacgtttcctcctccctagcaatcgcaacccgttcagccaatcattgccgtctccaccaactccgttcccctattacctagttagtccagtccgcctgctgcctgcctcaacggatcgacgcgacaggagggagggaggaaggagacggtcgatcagagtctgagacggaggccgatccaccaccgcagcgacgagcgggaggagatgaagatcatcattgacacggatcccggcatcgatgacagcgtggccatcctgatggcattccagatggcgggnncgtcaggtcctagggctcaacaccatcttcgggaactgcaccacagaagcatgcacacgccacgccttgatcctgggcgagagggcagccacttaaagttccantacctgaaggcaaccatggaccccttaaggaagaaagccccagttggtaaatctttctaggaccgagggccccggaaacaaaatttcgggccccccttaaaaaagggaagaaaggggcccccctttgggggaaaaggccgccaattcgggaagg

SEQ ID NO: 45400 - protein, 79 aa, Zea mays
  misc_feature: Ceres CLONE 1449150-F
  misc_feature (26)..(26): Xaa is any aa, unknown, or other
  misc_feature (60)..(60): Xaa is any aa, unknown, or other
MKIIIDTDPGIDDSVAILMAFQMAGXSGPRAQHHLRELHHRSMHTPRLDPGREGSHLKFXYLKATMDPLRKKAPVGKSF

SEQ ID NO: 45401 - DNA, 799 bp, Zea mays
  misc_feature: Ceres CLONE 1449152-F
  misc_feature: Encodes the peptide sequence at SEQ ID NO. 45402
  misc_feature (264)..(264): n is a, c, t, g, unknown, or other
  misc_feature (289)..(289): n is a, c, t, g, unknown, or other
  misc_feature (381)..(381): n is a, c, t, g, unknown, or other
  misc_feature (706)..(706): n is a, c, t, g, unknown, or other
aagctggagctccccgcggtggcggccgctctagaactagtggatcccccgggctgcaggaattcgcacgagaccattacctagaacatcctaatcgaaaagtcctgtttcactctcgccagccaaagacgaccacgccctccgtgctccagccattccccatgatttcgccgacgaatctcctcccggcgcggaagatcacccctgtctcaaatggcggcgcagcgacggcgagcccctcttttctcctcgtgggcgcacggncacggcgactcccttcagggcctcnatctgtgactggtaaagggaaaggtttccttggccagcatcattctagatgattaccttcaatgcaaacccctggaagtgagaacccgaacnttaccggatggcttcccaggggttaaaccaaccccccggttttaaccccccttttttccaaagggggggtttcaatttgaaacttttgattttccttaaaaacatcaaaaaaggggggggcgccaaagggtaatttttggggaaaaccgggaagggggcccccttggggtgggggaaaaaattttttttttttgggacacagagaagtttgtttttttttaaaaaaggggggggggaccagggggaactcccttcaaaaagacccccccccaaaaaaaaaaaatttttttgggggggaggggggggcccccccccccccttttcnggggagaaacaccggggggggggggtttttttctttttttggggcgccccccccgggggttatatatattataggcggggggcgccaccccct

SEQ ID NO: 45402 - protein, 59 aa, Zea mays
  misc_feature: Ceres CLONE 1449152-F
  misc_feature: SWISSPROT Homolog: EC 4.2.1.52 Dihydrodipicolinate synthase
  misc_feature (35)..(35): Xaa is any aa, unknown, or other
  misc_feature (43)..(43): Xaa is any aa, unknown, or other
MISPTNLLPARKITPVSNGGAATASPSFLLVGARXRRLPSGPXSVTGKGKGFLGQHHSR

SEQ ID NO: 45403 - DNA, 823 bp, Zea mays
  misc_feature: Ceres CLONE 1449153-F
  misc_feature (50)..(50): n is a, c, t, g, unknown, or other
gggatgtgggtcatccaccaccgaataaatgaaaccccaccgggggggtngccatagctggagctccccgcggtggcggccgctcttgaatagtggatcccccgggctgcaggaattcgcacgagaccattacctagaacatcctaatcgaaaaaaccgacccgacctcgcctcacttcactcggggatatcccaacagttcgctgccgtcgcctgcgccagaccgccgccgcgacactagacaccagcgccgcggcagaaggagcaagggagaagaaggaaagcggcacccgccgcacatacgccgcgcggcggagccctggccgagctgcggcacgccacggggggggggggggcgacgcgcgccactggccccccttccaagcgggacgccgaggcccgcgccctcgccctgggtcgggtaaacacgcgtctgccgccggcggggaacgggctccgtccttgcccacaagatgggccgctccccgcccccccggtccgagccccgtcctcggcggggcgaaggcccccccagagggccccgcacccgggcttccggcgctcctgaggggggaccctcggttgcgcgggcccatttgtccttggctttgggcccccgcggctggggttcttgtccacggggggcctttcccctgctggggcgacgccctggaacggccgtccggtaacccgtggggccgcccagggaggggggctgttgggggctcccactggcgcccccgggggtcaggccatggccgcgaacccctcgggggggaggaggaagcccttggaggccgggggggcgagcctgccgggggag

SEQ ID NO: 45404 - DNA, 726 bp, Zea mays
  misc_feature: Ceres CLONE 1449155-F
  misc_feature (386)..(386): n is a, c, t, g, unknown, or other
  misc_feature (402)..(402): n is a, c, t, g, unknown, or other
ctggagctccccgcggtggcggccgctctagaactagtggatcccccgggctgcaggaattcgcacgagaccattacctagaacatcctaatcggaaactcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagttggagaacaactgtgaaattggtgttttctcctagctgacaaatgcttactgtctggtagcgattggagggtcagagacttctacagtgcctttgaggctgagcttgcagatgccatccctgtggntcagacctctattggntgcacctagaatataggccgactttgtgttgaaaacaaaatgaactcctattggcccctactacaacgaaccaaactttcacttctgaggaatggctggctgaccaaggggggttccgcgctttgggaaagggttttggcctttggaaatgtgaaacccggaaaacccggtggcttttccccccttccttttaaagggaatggaggagatttttcaaagggttttggggcaaagggttttcaaaaaaattgggaaaaaattttgtggggagaatcccgcccccctcaggggggggggggggcctcccccactcttgggaagaaa

SEQ ID NO: 45405 - DNA, 713 bp, Zea mays
  misc_feature: Ceres CLONE 1449158-F
  misc_feature: Encodes the peptide sequence at SEQ ID NO. 45406
acccgcggtggcggccgctctagaactagtggatcccccgggctgcaggaattcgcacgagaccattacctagaacatcctaatcgaaaaacatctctcccagccaaaggcaattaagcagaccattacgcagccacaacagcaacgcagcaagctaagctagagggagtagtgagtgggagagagagagagagagacaaatgaggccggaaagagttggaggtgtggcgccgacgacgacggtgctattggctggcggcgggcggccgagcctgtggaggacgccgacgccatatctcttcctggggttcgcgacgatgatggtcctcatcgcggtggcgctggtcgcgctcatgtgcgcgcgccgcaaggcctcttcgtcgtcgacgtcgtcggccaacggcggcgacgagaagccggcgtcggtgcgggtcctggtgccgctcgaccgggagccccccaaggtcgtggtcgtcatggtcggcgacgccctgccgtccttcatcgccgtcgccagcgcgaggaagccgctcgccttcgccgccacaccggccgcgccggccgagggcttgtaggcgcatatgcaggggcgggcgagaagagaacccgcgcatcgcgagttcgcgacacgcgcgggagccaattttgtcgagaggttgttggttggtcttttgcttaggagctcggaggcggaacgtaggagaacgagtact

SEQ ID NO: 45406 - protein, 124 aa, Zea mays
  misc_feature: Ceres CLONE 1449158-F
MRPERVGGVAPTTTVLLAGGGRPSLWRTPTPYLFLGFATMMVLIAVALVALMCARRKASSSSTSSANGGDEKPASVRVLVPLDREPPKVVVVMVGDALPSFIAVASARKPLAFAATPAAPAEGL

SEQ ID NO: 45407 - DNA, 664 bp, Zea mays
  misc_feature: Ceres CLONE 1449167-F
  misc_feature: Encodes the peptide sequence at SEQ ID NO. 45408
  misc_feature (664)..(664): n is a, c, t, g, unknown, or other
ctccccgcggtggcggccgctctagaactagtggatcccccgggctgcaggaattcgcacgagaccattacctagaacatcctaatcgaaaaagatcgcgtgattccgcatcccgttcgcgagcgcgacacacgctgacagctcacggctgaccttcccgacggcctccagctccatcttgattcttgaggcgaagccccggtgcgtaagagtctgccatggccagcgagaataaggtctttgggttcgaggaagtcgccaagcacaacgtcaccaaggactgctggatcatcatcgccggcaaggtgtatgacgtcactccgtttatggatgagcatcctggtggagacgaggttttgctagctgtaaccgggaaagatgctacagctgatttcgaagatattggccccactgattccgcaagggacatgatggagaagtaccacatcgggcagatagatgcttcaacaatcccagcaaagcgtgctcatgtgcaggcccagcaagcaccccgccatgcagacaaggataatgacctccccatcaagatcctacagttccctgggcccattatgatcctggggccttgcatttggtattacgcagtacaccaaatccgaagagtaactattcttagaaggcttgcttttggaagcctgccttn

SEQ ID NO: 45408 - protein, 148 aa, Zea mays
  misc_feature: Ceres CLONE 1449167-F
  misc_feature (7)..(81): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MASENKVFGFEEVAKHNVTKDCWIIIAGKVYDVTPFMDEHPGGDEVLLAVTGKDATADFEDIGPTDSARDMMEKYHIGQIDASTIPAKRAHVQAQQAPRHADKDNDLPIKILQFPGPIMILGPCIWYYAVHQIRRVTILRRLAFGSLP

SEQ ID NO: 45409 - DNA, 830 bp, Zea mays
  misc_feature: Ceres CLONE 1449172-F
  misc_feature: Encodes the peptide sequence at SEQ ID NO. 45410
  misc_feature (47)..(47): n is a, c, t, g, unknown, or other
  misc_feature (49)..(49): n is a, c, t, g, unknown, or other
  misc_feature (431)..(431): n is a, c, t, g, unknown, or other
  misc_feature (542)..(542): n is a, c, t, g, unknown, or other
aagtgaggggcccccccctcggtgtctggggggggttttcttgtctntntttccatactggtgctccccgcggtggcggccgctctagatctagtggatcccccgggctgcaggaattcgcacgagaccattacctagaacatcctaatcgaaaaaaacgcagagaaaagaaaaccgctccaatccggaagctgaaaatagcagaagaatccagaggcgactccaggtttgttggcgatgctgcgagcgggaggcaggcggctcctcgccccggggctccgtcggctcggcctgggcacaggcgcctccggcgaggcgggccctgcggccgcggcggcgggggtgagggcgtaccacgagcgggtggtggaccactacaacaacccggcggaacgtaggttccttcgacaaggaagacccccacggcgagnactgggtatggactggccgccccggcccgggggggacgtccatgtagagtggaagatcccggcggggacggagaaatcccgggaaagaatcgttcgaaggcccggcttccnaaaactttttgggtcggcgtgattccgccctttagccggtccatggtcccggttgcctcccgggaatggggtgagaaggggaaaaacttaatggggctaaaaggtttttgcatcaacgaacaaacgcggggaaaaaccccccttaacgtacattgggtccctgtccccaccgagcgaaaaggcacctatttggatgatatgagcctaggcccataggatccccgcatataaggcgccgccggggaaaaggaactattaaaacatcctagaaaagtctctcaataaggg

SEQ ID NO: 45410 - protein, 108 aa, Zea mays
  misc_feature: Ceres CLONE 1449172-F
  misc_feature (65)..(65): Xaa is any aa, unknown, or other
  misc_feature (102)..(102): Xaa is any aa, unknown, or other
MLRAGGRRLLAPGLRRLGLGTGASGEAGPAAAAAGVRAYHERVVDHYNNPAERRFLRQGRPPRRXLGMDWPPRPGGDVHVEWKIPAGTEKSRERIVRRPGFXKLFGSA

SEQ ID NO: 45411 - DNA, 668 bp, Zea mays
  misc_feature: Ceres CLONE 1449185-F
  misc_feature (392)..(392): n is a, c, t, g, unknown, or other
ggagctccccgcggtggcggccgctctataactagtggatcccccgggctgcaggaattcgcacgagaccattacctagaacatcctaatcgaaaaattggatctggtggactcgtcattggtggaccgagtgctggatctgttctcgtccatgtcaagcagactagagccctcttcttcattgtgcaccctgttcctcttgttgccagtgccaccggctcctgcggaagcatgctctgttctggagcccgttcggcttggtaccaccatcccctgctcccaccacgtagtcctcgtcgacatcatcggcctcctccaccagttttttcatctctgcctcaatggacttctcagcggctacacgcttctggggccgccccctcatcttcttngcaggtgcggagacctcatcgccgctgatcatcttgtccgcgagagtcctgcccgttggtgagctagttcctccctctgcctctacccctacccattgttggctcaattcaacgaaagaagctgcagatgtatgcagaactaggcaatgcaacgaaagaagctgcaaaatggtcaattcggacgttgcttccctttttgaacccgcagaaatatcttccttgggaaagaaacttgcctctaggaaagtgcacccaagaaaatctacaaaacttgag

SEQ ID NO: 45412 - DNA, 906 bp, Zea mays
  misc_feature: Ceres CLONE 1449201-F
  misc_feature: Encodes the peptide sequence at SEQ ID NO. 45413
  misc_feature (21)..(21): n is a, c, t, g, unknown, or other
  misc_feature (813)..(813): n is a, c, t, g, unknown, or other
aatttcaccccccccagatcnccaaccaccaacccccgcgcatcacccccagccaaagctggggctccccgcggtggcggccgctctagaactagtggatcccccgggctgcaagaattcgcacgagaccattacctagaacatcctaatcgaaaaagtaagtaagaacagatgtcacacaacacttcccatgttcctcccatgcccctctctcatcacttcagcgactatggcttcgatccccagatcgactactttcaggttacggaagaagcgaggaagcacaagaaagaaactccctccattgacggtatgcgtcaattcaggcttccttaaacctatatctaaggatgatctggatcctaaccgcctccccacaagaagaagaagcgcttggtgcttggaaaaaagaaatagatcttaatacaaccgcgtagaaaatgggcgaaaagcttatgccaagtcatctcacctcataaagaaagtgtgcccccccccaccacccagaactaccgacggttctcaccttgggtccctggggagtctggaaaccctctacgccggtatttcaaactaggagctgttcaaatagtcgcccaccattcgtacaacacaccgggcttcacgggctccctgcctccgaagcccaaaccaaatcggcggagccttatatccgacagccatatccatctggacgacggaagaggatgcagagagacctctacgtttcattgtcaatggcgtgcgaatactcgcgggcagggcaagcactcccggcacccgtacataagtcctgaagtgcgcgacataccnactaattcctcagagcctagcgcacagacatgggacagcacatcacggcttcttttcccccctcttcatacagcaggccgtactatcatctag

SEQ ID NO: 45413 - protein, 54 aa, Zea mays
  misc_feature: Ceres CLONE 1449201-F
MSHNTSHVPPMPLSHHFSDYGFDPQIDYFQVTEEARKHKKETPSIDGMRQFRLP

SEQ ID NO: 45414 - DNA, 660 bp, Zea mays
  misc_feature: Ceres CLONE 1449202-F
  misc_feature: Encodes the peptide sequence at SEQ ID NO. 45415
tgtggatcccccgggctgcaggaattcgcacgagaccattacctagaacatcctaatcgaaaacacatagaccaccacgacacccttccccacaccagcagtcgagctgagcacgacacaaagccggctggggccgcctcgccatggcgatccggatgagcaacaacgtgatcggcgcgctgaacctggtgacactcctgctctcggtccccatcctcgtctcgggaatctggctgcggtcgcgcgccgacggcaccgagtgcgaccacctcctgtccaccccggccatcgcgctgggcgcggtgctcatggccgtcgctgtcgcgggcctcaccggcacctgcttccgcgccacctggctgctatggctctacctcccccccatgctcgtgttcatcgtcgcgctgctctgcttcaccgtcttcgccttcgccgtcaccaacaggggcgccggggaggccgtgtcgggggtaggctacggggagtaccgcctcggggactactccacctggctgcggcgccaccgtcaaaagccgcaaggacttggccccggatccggaagctgcctcgccgaacgcgcaactctggcaagccccctggaggaaaagggagaagggagagccaaggacccgggcggggtcttgggttcggctccggccc

SEQ ID NO: 45415 - protein, 172 aa, Zea mays
  misc_feature: Ceres CLONE 1449202-F
  misc_feature (5)..(152): Pfam Name: Tetraspannin Pfam Description: Tetraspanin family
MAIRMSNNVIGALNLVTLLLSVPILVSGIWLRSRADGTECDHLLSTPAIALGAVLMAVAVAGLTGTCFRATWLLWLYLPPMLVFIVALLCFTVFAFAVTNRGAGEAVSGVGYGEYRLGDYSTWLRRHRQKPQGLGPGSGSCLAERATLASPLEEKGEGRAKDPGGVLGSAPA

SEQ ID NO: 45416 - DNA, 645 bp, Zea mays
  misc_feature: Ceres CLONE 1449212-F
  misc_feature: Encodes the peptide sequence at SEQ ID NO. 45417
ctggagctccccgcggtggcggccgctctagaactagtggatcccccgggctgcaggaattcgcacgagaccattacctagaacatcctaatcgaaaaccgttcctcacgccgcctccacgcctccaacagaagaaccctaagctgccctcgctccggcgccgccacctcgtcgtccgtccgcatcgattcgatggcccgcgtctccgccttcgtcgccgccgtgatcaccgccgccgttgtcgttgacgcgctgttcacagccgcctccgccaccgaggcaccggcccccgccccgatgtccggcgcgggcgccctctcagcgcagctctccgtcggctgcctcgcggcgctcctcgccgctttcctccgccactgagcggtggggccgccccgtctgcgtgcgcgtcttcagatctagtggtacagtggtagtgagagttgcagtctaatgttagtcgcaggtatcgtagcggtggtgatagtgttatgaagatgaggcatttggttttgttccacgtggtggatggatggatggatgaatctgggcgtttggagagtttttctttttgatgctggatttgatttagcatgattggtgttagtttattactattattatttattatttgcgtttctgtaccta

SEQ ID NO: 45417 - protein, 61 aa, Zea mays; identical to SEQ ID NO: 44668
  misc_feature: Ceres CLONE 1449212-F

SEQ ID NO: 45418 - DNA, 836 bp, Zea mays
  misc_feature: Ceres CLONE 1449213-F
  misc_feature: Encodes the peptide sequence at SEQ ID NO. 45419
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ttttttttctccccctcctgtgtttgaagtattaaaggaagggnnnnnnnnnaaaaactggaactccccgcggtggcggccgctctagatctagtggatcccccgggctgcaggaattcgcacgagaccattacctagaacatcctaatcgaaaaatttcttcatctggtggtcttcttgttcaatccccatctcgatcggggaggccaccaaccaccatatggcgggagggaaggtttactcgttcgaggaggtgaggaagcacagcgaccgcaaggactgctggctcatcatcgccggcaaggtgtacgacgtcacgccgttcatggaggagcaccccggcggcgacgaggtcctgctggcgtccgtcggcatggacgcctctcgcggacttcgaggacatggatcaaagagcctccgccaacgagctcatgccccattactgaatcgtgaaggtccgaaacggatacccccccccccacaacccggccttatttctttaccaaggtactactcccaggtttgttcccaaaaatggccgcgaatagagacccctagactcttgagaccacttcttccttgatgttttcggccggcggccccattccatgttttgcatttccgtctggtccttctcatcgctggaagccttgatacctcggcccggggggtccataggtcctccaagctatgatcactctattgcaccgctaaggagttaccacctcgtgtggaagtttgcgagggggagtcgcgtggggtactatttaccgccaccctcctgtcttgggatgggacattatggtatatttacctccttattgcttatcatcggg

SEQ ID NO: 45419 - protein, 120 aa, Zea mays
  misc_feature: Ceres CLONE 1449213-F
  misc_feature (6)..(71): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MAGGKVYSFEEVRKHSDRKDCWLIIAGKVYDVTPFMEEHPGGDEVLLASVGMDASRGLRGHGSKSLRQRAHAPLLNREGPKRIPPPPQPGLISLPRYYSQVCSQKWPRIETPRLLRPLLP

SEQ ID NO: 45420 - DNA, 731 bp, Zea mays
  misc_feature: Ceres CLONE 1449222-F
  misc_feature: Translation starting site: 209
  misc_feature (369)..(369): n is a, c, t, g, unknown, or other
  misc_feature (370)..(370): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (377)..(377): n is a, c, t, g, unknown, or other
aaagctggagctccccgcggtggcggccgctctataatagtggatcccccgggctgcaggaattcgcacgagaccattacctagaacatcctaatcgaaaaagaatcgtggcgtctccctggggataaagtacttctccagctcctctgcgtcttccgccgctcttgctgtcctctgtgctatccgctagggtttatctgctcgaggaatggcgtcggtgcaggtctccggcgcgggggtcggtgccgcggccttctctgtgaaggggaaggcctccaccggtgcgctccggcttcgctctacgttgaccttcggcgaggtctgcccggcgcggcgggcgttccgcggcctcgtcgtcagggccgctanngnnnncncccccaagtatacaacacttaagcccttggctgatagagtgcttgtaaagatttaactcttccgaggagaagacaactggtggaatcttgctccctacgactgctcagtccagacctcaaggtggccaggtagttgctgttggagaacgaaggataattggggataagacaagttgatgtcagcattcacgttggagctcaggttgtgtattctaagtaggctggaaccgaagtctgcgttgaacgatcacaggcatctggttctcaaagaggatgacgttttacgcatcttacaaactgatgacctgaaagacatgaaccctttgaacgaccgtgttcctatcaagggtggcg

SEQ ID NO: 45421 - DNA, 744 bp, Zea mays
  misc_feature: Ceres CLONE 1449228-F
  misc_feature (377)..(377): n is a, c, t, g, unknown, or other
  misc_feature (401)..(401): n is a, c, t, g, unknown, or other
aaagctggagctccccgcggtggcggccgctctagaactagtggatcccccgggctgcaggaattcgcacgagaccattacctagaacatcctaatcaaaaaacaacacctcgctttttgtactcttccgtctttgccctcgcgttatcgcgctcgtctcgcctggcctagctagctgcctgcctgccttggcttgcttgctacgtcgtgtacacagcgagaggaaggacaggagcaagaaaagaaagaagagagagagagagagagtcgtttcctttcctcgaacttattccatggagacctcttctcacaagcgggcgcgggaggcggtcgatctcgccgcccgcgcccgccgctgcggagaagccgtgtggccngagtccgacgcaaagagctgcggncgcaggacctgctccacatgctcaaggacaacacgaacgcggcggccgcggcaactggcgtccgtcatgcggagctgaaggaggaaaagccgcttcaacaagcccggaagggggccctcccaaaaccggatttgggttcctgtcaaagcccaaaaaaaaatgggcttgcccccgcgaaacccccccccccttttgaaaaagcggggttcccggcccccgaaaaacccccccccccccgccggggtttaaagaaaaattgggcctcaaaaaaaaaaaaaaggatttttggggttccccccaaggggcccccccccccccccccccccggggaaaaaaaaccctc

SEQ ID NO: 45422 - DNA, 509 bp, Zea mays
  misc_feature: Ceres CLONE 1449239-F
  misc_feature: Encodes the peptide sequence at SEQ ID NO. 45423
  misc_feature (239)..(239): n is a, c, t, g, unknown, or other
tggagctccccgcggtggcggccgctctagaactagtggatcccccgggctgcaggaattcgcacgagaccattacctagaacatcctaatcgaaaaactactctctctctctctgcctgcaaagctgcttgatccatcatcgatcacatcactccaccagccgcagcgcacgaacgtacgactcatggcagatcgcgaccgcagcggcatctacgggcgcggccgctacgggcagcancaggggggggccggccgccccaaaggggggaccagggggaaagggccatgatccccccaacaggggggcccaaaaggggtccccccagggcctttaaaagggggggaaaacccttttttcccctcgtgggggggggggtctcccccccccggggggttttctcggggccccctgggggttttggggggccccccccccccagggggggggggggggggtggcccctttttaaaccaccccccccccggggttttttttcttctctttttt

SEQ ID NO: 45423 - protein, 34 aa, Zea mays
  misc_feature: Ceres CLONE 1449239-F
  misc_feature (18)..(18): Xaa is any aa, unknown, or other
MADRDRSGIYGRGRYGQXQGGAGRPKGGTRGKGP

SEQ ID NO: 45424 - DNA, 726 bp, Zea mays
  misc_feature: Ceres CLONE 1449249-F
  misc_feature: Translation starting site: 185
  misc_feature (273)..(273): n is a, c, t, g, unknown, or other
  misc_feature (296)..(296): n is a, c, t, g, unknown, or other
  misc_feature (305)..(305): n is a, c, t, g, unknown, or other
  misc_feature (319)..(319): n is a, c, t, g, unknown, or other
  misc_feature (444)..(444): n is a, c, t, g, unknown, or other
ggagctccccgcggtggcggccgctctagaactagtggatcccccgggctgcaggaattcgcacgagaccattacctagaacatcctaatcgaaaaagaggctgcttggcgagtcaaaaatactttggtcatcttccctgcttggagttgagacgccgacgcggcgcccgagaagaatttgcggatggatttgctgcgcagcgtgttggagtcgattcaggcgatgcagatccgccccgtggtcgcccaaatcatcaccctagggatgatccntacttcggcattgatcctatggnaaggattgntcgtcgtaacaggnagtgagtcgccggttgtggtggttctatctggaagcatggagcctgggtttcgaaaggtgatgtcctgtttctgacatgaataaggaccctgcccgcacaggagacatatttgttttcaatgtcnaaggccgggatattccaatggcccttcggggaacaaggttcctgaccccttggaacggtggattccgaatttctcccaaaaggggaaataaatcccggggatgaacagaatcttggaaccacatggggcacttttgggttggcccgacaccccctctttgggaggggcggggggttatctcgcctaaggggggggggttaaaacccgccggggggaaaaaccctctcccaaatttttttaatttgccccccggcgctcttgggaaaacccccgaggagaaaa

SEQ ID NO: 45425 - DNA, 768 bp, Zea mays
  misc_feature: Ceres CLONE 1449251-F
  misc_feature (371)..(371): n is a, c, t, g, unknown, or other
  misc_feature (372)..(372): n is a, c, t, g, unknown, or other
  misc_feature (383)..(383): n is a, c, t, g, unknown, or other
aagctggagctccccgcggtggcggccgctctagaactagtggatcccccgggctgcaggaattcgcacgagaccattacctagaacatcctaatcgaaaaacaatgtgactggcggaggcatgggaggtgctcctcaaccaggaatggatcccatgaacatgggaatgtgatgtgcattctagttgttgcaattcactgcaataacacatcacctctcagtgaattacaactagagaagatctggccactgtccagatgaaacttagtatggtgtagtctgactttctgccggggtaaaaataggaatgttgtttggtattgccataagctaagctgtagaaacaagatcggcaggttttctgtattgtnngtctgcaccgnagctcttgtgcgttgacccttcaaacctgaaaaacaaaggaggaaacccccgtcccgtgagctttgtcgcattgcccatcgatcaggatcttgaatcgcttcaaatgaggctataagaaacttactgaaaaaagtgtatgccgggggctaaatttacaaagtaagggttgctttttgccttcctaggggggccgggaaaaaatccgggttcttaatttgtcggggaacataaataaccccccaattttttttccccggtaaaaaaaaaaaaaaaattttttctttccccccccccgggggggggggccggacccatttcccccatagggggggaaaaaccgcgccccccggggccgtttttaaaacgccggggggaaacaccggt

SEQ ID NO: 45426 - DNA, 742 bp, Zea mays
  misc_feature: Ceres CLONE 1449254-F
  misc_feature: Encodes the peptide sequence at SEQ ID NO. 45427
  misc_feature (365)..(365): n is a, c, t, g, unknown, or other
aagctggagctccccgcggtggcggccgctctagaactagtggatcccccgggctgcaggaattcgcacgagaccattacctagaacatcctaatcgaaaaaaaacattttctttttgccctgcgtggcgttctccactctcctctccctctcccgagcacctctccttcctccactttctccccaactccggtgagcgagagtgtggtcacgacacaatcatggcgctgcccgtggggccaatcgtcggtgcgcgagctccccttcggggtgagcatgtcaccgtcgagcgacctcttggcggtgccctagtgtcctgtgcgtggcgttatgtaccggtggctgcgttgtttctacccaccccnccccaaacaagattagcaggaatggacgaaatggtttgagttggttctctgagcaggttgacaagtgaggacctctatgaagctgatgctaacatttacagagcaaaggatctatattagagcagtatagaagggtggatgtgaggcctaacattggttgtgagctttgaagaggattttgttgtttggcttggggaggttcttttgacctctggggcacccagcgaagctgaataacatcttcttcatgtcctattatgcggagcttgaaaatactcaattataagtttataggttttctgttgagcatcttgtcatggagccagtaggtgctaaaaagccctggatatgagcatgtctagaaaccctgtcttttt

SEQ ID NO: 45427 - protein, 60 aa, Zea mays
  misc_feature: Ceres CLONE 1449254-F
MALPVGPIVGARAPLRGEHVTVERPLGGALVSCAWRYVPVAALFLPTPPQTRLAGMDEMV

SEQ ID NO: 45428 - DNA, 778 bp, Zea mays
  misc_feature: Ceres CLONE 1449257-F
  misc_feature (1)..(1): n is a, c, t, g, unknown, or other
  misc_feature (210)..(210): n is a, c, t, g, unknown, or other
  misc_feature (398)..(398): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (415)..(415): n is a, c, t, g, unknown, or other
  misc_feature (416)..(416): n is a, c, t, g, unknown, or other
  misc_feature (488)..(488): n is a, c, t, g, unknown, or other
  misc_feature (489)..(489): n is a, c, t, g, unknown, or other
  misc_feature (530)..(530): n is a, c, t, g, unknown, or other
  misc_feature (531)..(531): n is a, c, t, g, unknown, or other
  misc_feature (546)..(546): n is a, c, t, g, unknown, or other
  misc_feature (572)..(572): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (686)..(686): n is a, c, t, g, unknown, or other
nactgctggagctccccgcggtggcggccgctctagaactagtggatcccccgggctgcaggaattcgcacgagaccattacctagaacatcctaatcgaaaactcacacctcgacgcctctctctctttccccgagctctcgaaaccctaggtgcgtgccgaccggcggcggcggcgaggtgatggcaatggacccggacgcggtggcnaaagccttcttggagcactactaccggacgttcgacaccaaccgcgcggggcttgtggggctgtatccggagaccttcaggcccccggcgagggccaaaatttccagggtcctttcgccattgccggcaggctcgagatccctccttttttttttggcggcccccggggaaagaagggggacccccanccncnnnnncccccccnntgggggccccccccccaccaccaccgtcccttgggggggggcgggcggggaacaacctcaacaagatggcgnngcgcctcaccacgtgcacgcgcgccgcaggcccccccttgnnggcacacgcccaccntcccccccacccctgccatcaacganggcaacacctccgtccctccacacctcccacacccccgccgccgaccgcaggaacgccgtaggacagccgcacccnnnccgcgtgtccccgccttcccccctccctcgtagggntgtgtcgcgcccccacccccccccctcggtatcgccccagctcgggcacacccgccccgcacctgccaccctcctgcctcctgccggggggg

SEQ ID NO: 45429 - DNA, 665 bp, Zea mays
  misc_feature: Ceres CLONE 1449259-F
  misc_feature: Encodes the peptide sequence at SEQ ID NO. 45430
  misc_feature (466)..(466): n is a, c, t, g, unknown, or other
  misc_feature (509)..(509): n is a, c, t, g, unknown, or other
aagctggagctccccgcggtggcggccgctctagaactagtggatcccccgggctgcaggaattcgcacgagaccattacatagaacatcctaatcgaaaaagaggaggaaaaaatatcaccttctcttcctgcattcccctgctcgatccccggcgaggaattcgcccccgaatccatcgatttgctcagtccagtccgccgatccgtggatcgattcgtgcgtgggctctgtcctccccggggttccgatctggtcctcgcctcgccggaggaggagctggaggagatgaacggcaccgggggcagccaccaccagcagcagcacaggctccggcagcagcagcagcagcaggcgctcctgatgcagcaggcgctgcagcagcagcagcagcaacatcagtaccagtccggcgtcctcgccgccgcggcagccgcggccatgacccagatggaacctatttccnatggcaatctttcacctggctttgatccttccacttgtcgcantgtgtatgttggaaacgttgaccctaatgtcacggaaagcctttttgattgagttttcagaagtgctgcccttgtgaaagatgccagctcatacgaaagaaaagcattcttttgggtttggggacactatgatagaggtctgctgctctagcaatc

SEQ ID NO: 45430 - protein, 90 aa, Zea mays
  misc_feature: Ceres CLONE 1449259-F
  misc_feature (60)..(60): Xaa is any aa, unknown, or other
  misc_feature (74)..(74): Xaa is any aa, unknown, or other
MNGTGGSHHQQQHRLRQQQQQQALLMQQALQQQQQQHQYQSGVLAAAAAAAMTQMEPISXGNLSPGFDPSTCRXVYVGNVDPNVTESLFD

SEQ ID NO: 45431 - DNA, 820 bp, Zea mays
  misc_feature: Ceres CLONE 1449262-R
ggaaccttttctcagatcgttcaaaagatacgacggagatagattgacaagaaaccgacttcttatcattaaaggctgggctctcatcaaacagtttttatagtgtgcgaatgctacatggagacgatggatcacgcatttagcattacacagtaacgtgttttgttttatagctttacttggcacccgtgaaaacataatccaaggatgatctacctccaacgaactgcctggacttgggtccaaggacgactcatcgaggcaagtatccagtgttttgcccttcacctgaagcatagttgttaacaggatttttgataccaccgggtatctgcttgttgacctcggcatgctcaaccctggcaccaccggtggtgagatcagatagattcacacctactggtgcttgcgctggtggatcaaatagacccgcaccgtgcttaggacgaggaccatcaacaccaccttccaaaaaataattgaggggagtttttgaccacaaacacatggtgtttccgcgagcccacaaaataaggaaaccttctagcagccaaaaatttggggttaaaaaacttccaggaaaaaaaaatttccggggagggaaccatcccctttgtaaaaacccggaccttttttaccaataaaaagaggttttttaggggttaaaagggttcttcaagggccaaaatgtgcgggggcaaatccccagggggggcaattacccagttatttttttttttggagagggggtccccccccaccgcggggggggggaagagggtcctcaagagcttatttggtttgttcccaggtaaagggg

SEQ ID NO: 45432 - DNA, 614 bp, Zea mays
  misc_feature: Ceres CLONE 1449269-F
  misc_feature (291)..(291): n is a, c, t, g, unknown, or other
  misc_feature (301)..(301): n is a, c, t, g, unknown, or other
  misc_feature (335)..(335): n is a, c, t, g, unknown, or other
  misc_feature (341)..(341): n is a, c, t, g, unknown, or other
  misc_feature (398)..(398): n is a, c, t, g, unknown, or other
ggagctccccgcggtggcggccgctctagaactagtggatcccccgggctgcaggaattcgcacgagaccattacctagaacatcctaatcgaaaaatcccttgtccgttcgctgcattgctcccctaaccgttcggccaggagacagcggagagggcagagatggcggccgcgtccttcaccgccgccagttcctggcgccggtggccgcgagatcggcggaagaggcgccccgctcccgcggcgctcgtctcctcttcgcaggacctgcgcgcgcgcgtgcacaccgcngctgcgacgngctcgcgtctctccgactgctcgctggaacaggncgccanggcgccgcgcgcatccgcggttacccgggaagagcactggacctgatgaggactggntcctggccgtggattcgaggacatggggccaaatgtactaccctggcaaaattttgggttccccccctttcaatggccaggaggttgtcccccgggtttctaaaattttaaacaaggtgaaggggttgttaaccaaaccggaatttgtcctggctttcaaagggggccccgcgccttttgggggggggaaccttttaaaaaacaagaggtgcttgt

SEQ ID NO: 45433 - DNA, 729 bp, Zea mays
  misc_feature: Ceres CLONE 1449275-F
  misc_feature: Encodes the peptide sequence at SEQ ID NO. 45434
  misc_feature (239)..(239): n is a, c, t, g, unknown, or other
  misc_feature (313)..(313): n is a, c, t, g, unknown, or other
gcggtggcggccgctctagaactagtggatcccccgggctgcaggaattcgcacgagaccattacctagaacatcctaatcgaaaaagatcagaccacactcgtagagagaaggaaaaaatatccccaaaccctagctcccgatctcgatggcgaaccctcgcgtcttcttcgacatgaccgtcggcggcgccccggcgggccggatcgtgatggagctgtacgccaacgaggtgcctnagacctgcgagaacttccgcgcgctgtgcacgggcgagaagggcgtgggctagtcggggaagccgcttcactancaagggctccactttccacgcgtcatccccgaagtcatgtgccagggcggcgacttcaccgcgggaacggacccgcggccattccttctacgggaaaaagtcccctaaaaaatttcggggcaagcacccgccctcgggggggtttccctggccaaaccggggccaaacccaagggttccagtttttttttggcccggtcggacccctgggtctaaggaaaaacctcctctttcgccaagtctcaaaggggtgggccccccccagggcctccaaaaggggggccccccaagggtttcccttcagggggggaagggtttaaaaggaaaccccctccaaatttcgaaggggggggggggcgcccccctcccccaaaaaaaaccccccgggggggttttttttaaaaaaaaaaaaggggg

SEQ ID NO: 45434 - protein, 47 aa, Zea mays
  misc_feature: Ceres CLONE 1449275-F
  misc_feature: SWISSPROT Homolog: EC 5.2.1.8 Peptidylprolyl isomerase
  misc_feature (31)..(31): Xaa is any aa, unknown, or other
MANPRVFFDMTVGGAPAGRIVMELYANEVPXTCENFRALCTGEKGVG

SEQ ID NO: 45435 - DNA, 711 bp, Zea mays
  misc_feature: Ceres CLONE 1449277-F
  misc_feature: Encodes the peptide sequence at SEQ ID NO. 45436
  misc_feature (674)..(674): n is a, c, t, g, unknown, or other
  misc_feature (691)..(691): n is a, c, t, g, unknown, or other
  misc_feature (711)..(711): n is a, c, t, g, unknown, or other
aagctggagctccccgcggtggcggccgctctagaactagtggatcccccgggctgcaggaattcgcacgagaccattacctagaacatcctaatcgaaaaaaaccaaaatcatttcatccccggaaccggacgccgaacggcagtgctgcaaaagtccggacaaagctcgcgccgcccaccgcacccgatccgcctcgcccaggcgtgctgccgtccgctcccttctcccgcgccgtcgcctccgcctacgcccgggccgacccgctggacccagcgtgcgccgctccactcggacgcgccgccgccctctcgggttgaggcggaggtgcttggggacccgcctccatggcgagcgccggcaacagcggcagcggggacgacgatgcaggagggaagctcctggcggatcgctaccagaagggcgaggtcctcggcgagggcacgtatggagtcgtcttcaaggccatcgacaccaaggtccccttaccacaccgatctccctaagacctaaaccctcccttcctgatctgcgggcggccaccactcgagagttagagcttggctagtccgatcaatccagcttcgaccgtagacagatgcttgcggggtttagcttttcggggtagagggttttgcacggcgtagctctgtgaattggggtcattgagtggntggagcttcgctctggnatgactctgactgtggtagn

SEQ ID NO: 45436 - protein, 52 aa, Zea mays
  misc_feature: Ceres CLONE 1449277-F
  misc_feature: SWISSPROT Homolog: EC 2.7.11.22 Cyclin-dependent kinase
MASAGNSGSGDDDAGGKLLADRYQKGEVLGEGTYGVVFKAIDTKVPLPHRSP

SEQ ID NO: 45437 - DNA, 678 bp, Zea mays
  misc_feature: Ceres CLONE 1449278-F
  misc_feature: Encodes the peptide sequence at SEQ ID NO. 45438
  misc_feature (508)..(508): n is a, c, t, g, unknown, or other
tggagctccccgcggtggcggccgctctagaactagtggatcccccgggctgcaggaattcgcacgagaccattacctagaacatcctaatcgaaaaaccacactccactgctctcctccactccactgcctcccatccctgctgctccctctcccatcccggttccatcatgggcggcctctcggtgatcgcaccgcccgcgcgggactcggcttccccgcagcaccggcgcgcgcgccgcgcgttcctcgtgtccaactatctcatcctgggctgcgcctccgggtgcggcttcctcacgctctcgctccgcctggccccctccgtcgacggcttcctcctcatcctgctgcacgcgctcacggtggccgccgccgtggccgggtgcgccgtcatcgcggcgccggaccctccgcgcggccgctgctacaccgtccacatgtccgccaccgtcgtcgtctccatcctgcagggcgccccgcgcgtgctcgccttctcccgcacgtncgagttcctcttcgacggcctcaagtcgtacgtccgccaaggaggacgtgccggcatccttcgcatgggccgggggccttcgggtttggatctttctgcctcaaaggggtccgcgtccgccttgccttttggggttagggaactacctttaacccacaaaggggaagggg

SEQ ID NO: 45438 - protein, 169 aa, Zea mays
  misc_feature: Ceres CLONE 1449278-F
  misc_feature (113)..(113): Xaa is any aa, unknown, or other
MGGLSVIAPPARDSASPQHRRARRAFLVSNYLILGCASGCGFLTLSLRLAPSVDGFLLILLHALTVAAAVAGCAVIAAPDPPRGRCYTVHMSATVVVSILQGAPRVLAFSRTXEFLFDGLKSYVRQGGRAGILRMGRGPSGLDLSASKGSASALPFGVRELPLTHKGEG

SEQ ID NO: 45439 - DNA, 774 bp, Zea mays
  misc_feature: Ceres CLONE 1449283-F
  misc_feature: Encodes the peptide sequence at SEQ ID NO. 45440
  misc_feature (318)..(318): n is a, c, t, g, unknown, or other
  misc_feature (369)..(369): n is a, c, t, g, unknown, or other
  misc_feature (391)..(391): n is a, c, t, g, unknown, or other
aagctggagctccccgcggtggcggccgctctagaactagtggatcccccgggctgcaggaattcgcacgagaccattacctagaacatcctaatcgaaaaatagcctgcagccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacaaggacgccaagctcttncactgcgtgcagagggggcaccagaactctctagagtggatgcccgttttnctcgtcatactgctgctgggcngtctgcagcacccgaccatcgcccgccggtctggggcggaatctacatcgttcgcgaggtccttctacttcaaagaaatacgcccccggggttccggaaaaccgtcccaagaatgggggggcccaaccaacttggcgtgccttgggctgaaattttggaaaaaattttttttggaatcaactgggctatagggaagggcccaaaatttgggttaataggagacccccgggtgggtaacccacaaatttaccgggtgtaaagaaaaaaaatttggaacaacccttgggggttaaaagggaaatcccccccctcccttcggcgggggagaaaaaaaaaaaaagggccggcccccttaccggggggaaaaaaaaaaaaaaacgggg

SEQ ID NO: 45440 - protein, 146 aa, Zea mays
  misc_feature: Ceres CLONE 1449283-F
  misc_feature (9)..(142): Pfam Name: MAPEG Pfam Description: MAPEG family
  misc_feature: SWISSPROT Homolog: EC 2.5.1.18 Glutathione transferase
  misc_feature (59)..(59): Xaa is any aa, unknown, or other
  misc_feature (76)..(76): Xaa is any aa, unknown, or other
  misc_feature (84)..(84): Xaa is any aa, unknown, or other
MAVSIELTKEYGYVVLVLVAYVFLNLWMGFQVGKARRNYKVFYPTMYAIESENKDAKLXHCVQRGHQNSLEWMPVXLVILLLGXLQHPTIARRSGAESTSFARSFYFKEIRPRGSGKPSQEWGGPTNLACLGLKFWKKFFLESTGL

SEQ ID NO: 45441 - DNA, 757 bp, Zea mays
  misc_feature: Ceres CLONE 1449288-F
  misc_feature: Encodes the peptide sequence at SEQ ID NO. 45442
  misc_feature (367)..(367): n is a, c, t, g, unknown, or other
  misc_feature (390)..(390): n is a, c, t, g, unknown, or other
acagctggagctccccgcggtggcggccgctctagaactagtggatcccccgggctgcaggtattcgcacgagaccattacctagaacatcctaatcgaaaaatacggactacacaggaccaggaccgcaaaatactctcgcgatgacgtcagccctagccgttctctcgagtccccgaccgaacaaaggcttggcagccgttcgatcgtgcgccatgtcaccgatccgtgtgcttgttcttgtcacggacggccaggatcgtatgtagccaatctgccgaaacccagtccctccaccgccccctgttcgtccccgccgcttacaaattcgcccaaaatttcccccccaatttccctccaccgaagnatcacccaatcagatccgatttnccacagatgaagccggcaccccacgcggaggctgacgagcgagcggcggaggagatggcacctaagaaggcagcggctgccaagaaagcggccgaggaagttgacgtggaggaggtggtggacggggacaaggcggtcgatggggagggcgacggtgacgaggacgacgatggggaaggcggtgaccaggaggatgatgatgaggaggtggatggggaggagaaggaggcggcaggggttgtggagatctccgacgaaaacgacaaccacggtgactggggaggggaccaacaccacgaccatgacggggatgacgaccaccacgacgacaaggactcgacaaccaagaagaggtcaacggtgaaac

SEQ ID NO: 45442 - protein, 120 aa, Zea mays
  misc_feature: Ceres CLONE 1449288-F
MKPAPHAEADERAAEEMAPKKAAAAKKAAEEVDVEEVVDGDKAVDGEGDGDEDDDGEGGDQEDDDEEVDGEEKEAAGVVEISDENDNHGDWGGDQHHDHDGDDDHHDDKDSTTKKRSTVK

SEQ ID NO: 45443 - DNA, 744 bp, Zea mays
  misc_feature: Ceres CLONE 1449293-F
  misc_feature: Encodes the peptide sequence at SEQ ID NO. 45444
  misc_feature (484)..(484): n is a, c, t, g, unknown, or other
  misc_feature (496)..(496): n is a, c, t, g, unknown, or other
ctggagctccccgcggtggcggccgctctagaactagtggatcccccgggctgcaggaattcgcacgagaccattacctagaacatcctaatcgaaaaacaacaccagaatccgcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgcccgtcgtccagatgggcggggccatgccgccccagccgtgctgcggcggcatccgcagcctgctgcagcaggccacaacacccccgaccgccgcacatctggcggtggctcaagaacgtcgccaacggggccacgggagcngcacttaattanccgggcccccgctttcccaaaaagtgcgggtctccccttgcctaaaaaatcccccccacgtaacttgcaacccattaattaatgagggccccctgtccccccccggccaaaaatccttcctgtgcaaaaaaaaaaaagaaaggccccgggttttaaaccaaaacggggggggcccccccccccttttgggggttaaaaaacccccccactttaaaaagggttttggggtattttcccccaaaaaaaaa

SEQ ID NO: 45444 - protein, 92 aa, Zea mays
  misc_feature: Ceres CLONE 1449293-F
  misc_feature (91)..(91): Xaa is any aa, unknown, or other
MAAPKLATLALAVLLAATVVAPPAAVRAAMSCSTVYSTLMPCLPVVQMGGAMPPQPCCGGIRSLLQQATTPPTAAHLAVAQERRQRGHGSXT

SEQ ID NO: 45445 - DNA, 699 bp, Zea mays
  misc_feature: Ceres CLONE 1449299-F
  misc_feature: Encodes the peptide sequence at SEQ ID NO. 45446
  misc_feature (611)..(611): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcataatcgaaaaaaaaataccgtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccggcgcccgacacgggcgcggcagcgggggccgcggcgtcggtcctggccgtggcttgctctgccgtcttcttcatcctcgtcgccggtggcctcgtgcagtaggcgctgccgtcgacgtggtggctagctgctggttcggggtcaggcggagccctgttcgatcgttttcgccttagttagtagtagaagtagcagtcatgggctgtgttgattgtgtccctgtctccccctgtggggcgtgtgatctttgtgctatgcttattctttttgaccatactgcattgttcgacgtataccttgnntgtgagcgtgtgttgtatgaataagacgatggatctcgttcgttcatcgtcaaaaaaaaaaaaaaaagcttatcgatacggtcgacc

SEQ ID NO: 45446 - protein, 66 aa, Zea mays
  misc_feature: Ceres CLONE 1449299-F
MASRVAVLLVAVAAVLFAAASAQEMDLGVPPAPAPDTGAAAGAAASVLAVACSAVFFILVAGGLVQ

SEQ ID NO: 45447 - DNA, 724 bp, Zea mays
  misc_feature: Ceres CLONE 1449300-F
  misc_feature: Encodes the peptide sequence at SEQ ID NO. 45448
  misc_feature (410)..(410): n is a, c, t, g, unknown, or other
  misc_feature (420)..(420): n is a, c, t, g, unknown, or other
  misc_feature (507)..(507): n is a, c, t, g, unknown, or other
aaactggagctccccgcggtggcggccgctctataactagtggatcccccgggctgcaggaattcgcacgagaccattacctagaacatcctaatcgaaaagttattccatcaccagttcaccaccgtcttcctcaactcttcctctcctctctcttctgcaccatctggtgtgtgtgcgcgttactcgccgcgtcgatcgaagaaagaggcgcacgggagcgagctacgcgaagcaaggcaatggcgaagggcgggctgtccaagcttcggtgcatgatcaagaggtggcactcgtccagccgcatcgcccgcgcgccgccgtctcccggcctcggtgaagacgaacgctgcgccgcgcgcggcgcgtcgttccacggcgcggacgaagtgcctgagggcctgcactcngtgtacgtcngcaagtcgcgcccgcggtacctcgtcgccgaggagctggtgggtcacccgttggtccagaacctttttcgaccgcatcggcgggggngggaccggggagcgggcggggggaccgtcttcggtttgcaagtcttggtttttcaaaccccttggtttggatgctggaaaaccgggaccctcccccggaaacccccaagaaaactttcaaaaaaaaaaggcggggtgaaaaaaaaatttaaaaaccccccccccaaccccccattttttggggaaaaaaaaaggggcccccacagggggggaaaaaa

SEQ ID NO: 45448 - protein, 160 aa, Zea mays
  misc_feature: Ceres CLONE 1449300-F
  misc_feature (60)..(60): Xaa is any aa, unknown, or other
  misc_feature (89)..(89): Xaa is any aa, unknown, or other
MAKGGLSKLRCMIKRWHSSSRIARAPPSPGLGEDERCAARGASFHGADEVPEGLHSVYVXKSRPRYLVAEELVGHPLVQNLFRPHRRGXDRGAGGGTVFGLQVLVFQTPWFGCWKTGTLPRKPPRKLSKKKGGVKKKFKNPPPNPPFFGEKKRGPHRGGK

SEQ ID NO: 45449 - DNA, 735 bp, Zea mays
  misc_feature: Ceres CLONE 1449301-F
  misc_feature: Encodes the peptide sequence at SEQ ID NO. 45450
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
tggcggccgctctataactagtggatcccccgggctgcaggaattcgcacgagaccattacctagaacatcctaatcgaaaatacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcattgagactggcgctgggaagcacgtcccccgtgctgtttttgttgaccttgagcccactgtcatcgatgaggtgaggactggcacctatcgccagctcttccatcctgagcagctcatcatggaaggagatgcaccacacttctcgggcactaccattggcagaatgtactggctgcgtcgatgaatgcgctcgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 45450 - protein, 114 aa, Zea mays
  misc_feature: Ceres CLONE 1449301-F
MRECISIHIGQAGIQVGNACWELYCLEHGIQADGQMPGDKTIGGGDDAFNTFFIETGAGKHVPRAVFVDLEPTVIDEVRTGTYRQLFHPEQLIMEGDAPHFSGTTIGRMYWLRR

SEQ ID NO: 45451 - DNA, 703 bp, Zea mays
  misc_feature: Ceres CLONE 1449302-F
  misc_feature: Translation starting site: 397
aagctggagctccccgcggtggcggccgctctagaactagtggatcccccgggctgcaggaattcgcacgagaccattacctagaacatcctaatcgaaaaatagctatcgtccagctcttggtggtgctgcgggggtgactgcgggggcgactgcggctggtggctgtcgtcctcatcgaccatctcggcgacgtccaactagagcgagatctcgctaaagtccctcgagatctggaggagattgacaaggagattgaggacaagaagacagagctggagcccaaggtcgtggaggcctacgaagcatctcctcctgaggtcaaggctctgttcaaggataagaagccagtcaaggtcatcaagaagaactcggctgcagtcaccaagttcctcgatgagctggctaagattggccgcacttgaagaaatcttatatcagtttgaggaaaaactccaagctgaaagagaggaagctgctaggaagcaggaagagttgcaatctgtttgatgcctttgctagaacatatctgtggttagaactttgtcagaactacgtgcaatttgtttgaatgcttcacacctttgtggtggaacctttgtatgtttgaacctctgttgtggaagaactagtgtgccggaaaaaaaaaaaaaaaaaagcttatcgataccgtcgacctcgagggggggcccgctaccctatt

SEQ ID NO: 45452 - DNA, 744 bp, Zea mays
  misc_feature: Ceres CLONE 1449305-F
  misc_feature: Encodes the peptide sequence at SEQ ID NO. 45453
  misc_feature (235)..(235): n is a, c, t, g, unknown, or other
  misc_feature (262)..(262): n is a, c, t, g, unknown, or other
  misc_feature (263)..(263): n is a, c, t, g, unknown, or other
  misc_feature (397)..(397): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
tggagctccccgcggtggcggccgctctagaactagtggatcccccgggctgcaggaattcgcacgagaccattacctagaacatcctaatcgaaaaatcagaaccgatccttacagagagacacacccagcgcgcgagatatctacatcgatcatcatcaccagcgagcgagccggccgagcagcaccgatggcggcgtacatgcgcgtgacgcaccgcgacgaggaaggcaangaagtgactggagagatgccggttctnngagacgcgcgcccggacacggcaagcacttcaagcgcagctggagagcagggtcttccacgcttcgagcggcacccggcgaccgcgcccggggccgtgggcatcgccgccctgccgcccagtccgggccggggnaaatacccctgggagggccccggaaggttttaaaagacaaatttgaccgggccccccccgcttaccccaaacccnnnatttaaagggggggggggggggggaaaaagaaaaaaaaggcccccagggggggcgcccccgggaggggggggttcttaaggcccaaaaaaggggagggggccccccgggagatttttccgggggggttttttaaaaaaaaaaaaaaaaagggggctttttttgggaacaaaaaaaaaaaaaaaagggggggggggggatatttttttccccggaaagaaaccccccccctcttttttttttttgtttttgttttttttaaaaaaaaaaaa

SEQ ID NO: 45453 - protein, 79 aa, Zea mays
  misc_feature: Ceres CLONE 1449305-F
  misc_feature (15)..(15): Xaa is any aa, unknown, or other
  misc_feature (25)..(25): Xaa is any aa, unknown, or other
MAAYMRVTHRDEEGXEVTGEMPVLXDARPDTASTSSAAGEQGLPRFERHPATAPGAVGIAALPPSPGRGKYPWEGPGRF

SEQ ID NO: 45454 - DNA, 717 bp, Zea mays
  misc_feature: Ceres CLONE 1449309-F
  misc_feature: Translation starting site: 229
  misc_feature (322)..(322): n is a, c, t, g, unknown, or other
  misc_feature (703)..(703): n is a, c, t, g, unknown, or other
tagctggagctccccgcggtggcggccgctctagaactagtggatcccccgggctgcaggaattcgcacgagaccattacctagaacatcctaatcgaaaaaaaaaaaaaaaaaacaacaacaacagtcccctcccctcccctcctccctgctcctctaccccttcctctcccggcgaccagctggcctctcctttgttgaggcgagagacccccacccgatccggcgatggacgccgcgtccaggccgcctccgccccacggaacaggggtccgcgtccgcgccccgctggtggagtctgtctcctgctactgcaaattanatacaggccttaaaactgttgttgaggccaggaagtttgttcctggcccgaaaattggggtgggactgaaatcaaacaaaacaagcccaattcagggggttcaaaaaaggaaaggtgcaggactcagccaccatttttccctggccttcctgaagatcttggctattgctggccttatacaaattccctcaatttgaaaaccccaaactcagggaggtttgcaaaaaaggaaaccgtttttttttggaaaattatttttcttccttgggaaaaaaatttggggggcaaaaaatggggggttgtctttttaagaggacgggaggggaaataactggggtagcttttttttcctccaccagaaagggaagatctccccccagngccccgaaaatttg

SEQ ID NO: 45455 - DNA, 705 bp, Zea mays
  misc_feature: Ceres CLONE 1449310-F
  misc_feature: Encodes the peptide sequence at SEQ ID NO. 45456
tggagctccccgcggtggcggccgctctagaactagtggatcccccgggctgcaggaattcgcacgagaccattacctagaacatcctaatcgaaaaatattccgctcataattcctcaccggcctgcctcagagagagaaaaagcggagattagcggcggcgatggcactcccggcgtcgagctccggcctcttccgcttcgtctccccgcgcagccgcccccagtccaccgacatcgtggctgccgcctcctggggagtcttcgccggcaccgccggcctctacctcgtccagccatttgactggattaagaaaactttcttcgagaaaccccaaccagaggcataaaaggcttgcaagtctgcaactttggtacttcacttttatccgggatggttcctgactgaagagaacttggataactcagcaaataatacgagaccccctcgtgtttccttgtttgttttttattattcagatgtaggcaatccccacgagggagacagggaacagagaaactgcttggttcacctgtgtctatataatactcctgtgttatccaacatgcatgttttaaaacctgtggcaaatatatcttgctgattaatattggactatgatgtcatgttcgaatggtcccatcactaaaagggagaaaaaacatgatggcaagcttatcgataccgtcgacctcgagggggggc

SEQ ID NO: 45456 - protein, 61 aa, Zea mays
  misc_feature: Ceres CLONE 1449310-F
MALPASSSGLFRFVSPRSRPQSTDIVAAASWGVFAGTAGLYLVQPFDWIKKTFFEKPQPEA

SEQ ID NO: 45457 - DNA, 723 bp, Zea mays
  misc_feature: Ceres CLONE 1449316-F
  misc_feature: Encodes the peptide sequence at SEQ ID NO. 45458
  misc_feature (366)..(366): n is a, c, t, g, unknown, or other
  misc_feature (414)..(414): n is a, c, t, g, unknown, or other
  misc_feature (417)..(417): n is a, c, t, g, unknown, or other
  misc_feature (456)..(456): n is a, c, t, g, unknown, or other
aagctggagctccccgcggtggcggccgctctagaactagtggatcccccgggctgcaggaattcgcacgagaccattacctagaacatcctaatcgaaaaacgtcacgcgccgcgcgcagtgtcccaggccccggtcctccacactccactgcctcacactcacacagtctcacacaacacaggctcgtggcctggcctctagccctctataaacccccgcccagccggtcacccccacaccatcgcaaatcctcgctcgggcaagaagagccaactgaaaagtattcatccaagaacaccaccccacccgctccaagcacaagtttcgtcttgaagagagccgccaccaccaatggcttgttancacactgcatctttagcggcgactctgctggcgttcgcgctgacgttncangcctgccctcgccgggaggaagctcccgcgcttgtgcangaccccgccataacatggagtaccaaagggcccgctcctggtgggccccatcccgttaaatttatttgggaagggaaatttttcggccccaaggggggggaaacccccatttttggtccccctaaaaagggggggggccccgggcccggaaaaccaaaaaccccttgggcccctgggttaaaaaaggccacaaaaaaaccccccctccaaggggtttttccggggggttccccctctctcccccacccaaaaaaaaaaattcttccc

SEQ ID NO: 45458 - protein, 123 aa, Zea mays
  misc_feature: Ceres CLONE 1449316-F
  misc_feature (4)..(4): Xaa is any aa, unknown, or other
  misc_feature (20)..(20): Xaa is any aa, unknown, or other
  misc_feature (21)..(21): Xaa is any aa, unknown, or other
  misc_feature (34)..(34): Xaa is any aa, unknown, or other
MACXHTASLAATLLAFALTXXACPRREEAPALVXDPAITWSTKGPAPGGPHPVKFIWEGKFFGPKGGETPIFGPPKKGGGPGPGKPKTPWAPGLKKATKKPPLQGVFPGGSPSLPHPKKKILP

SEQ ID NO: 45459 - DNA, 682 bp, Zea mays
  misc_feature: Ceres CLONE 1449319-F
  misc_feature: Translation starting site: 155
  misc_feature (11)..(11): n is a, c, t, g, unknown, or other
  misc_feature (513)..(513): n is a, c, t, g, unknown, or other
ctcccctcggnggcggtcgctcattcaacaagaggatttcccgggctgcaggattccacacgaggggattacctagaacatcctaatcgaaaaatctatcatagtgagtttgaggacattggaccgcaccctgcagaggccaagcgtcgaacacatggcgtgcaccttcctccgccgcgcgttctccctcatcgccgccggcacccacgcgaccccccgagttgccgccgccttcgcttccacttcctcctcatcctccgtcgtcgtgcctctgcgctccccactagaccaccgtcttctccgccacctccgctccgagatcacctacctcgcggagcgccgccctccccacgtggtaaggcggtattccttccctccgccttccccgctgcgcctcacgttctcagcaaaaccctcatggtttcctcctcttcgtgcagccgccgagtagcttcaagtcgttcgccgtggaggaccgcccgggggagcagtgggtgcgcctccgcgccagcncgggagggggaggcgaggaggtgaaggtcgaggccaccatgttcgacggcgctgcggagcctgtcccggacgacgcgcccctcttccgccgcgtggagtcgctcgagcgcgggccccgcctccacctcagcctcatcgtcgaggtcgcccggggcgaccgcgtcctcgg

SEQ ID NO: 45460 - DNA, 699 bp, Zea mays
  misc_feature: Ceres CLONE 1449323-F
  misc_feature: Encodes the peptide sequence at SEQ ID NO. 45461
  misc_feature (374)..(374): n is a, c, t, g, unknown, or other
agagctggagctcaccgcggtggcggccgctctagaactagtggatcccccgggctgcaggaattcgcacgagaccattacctagaacatcctaatcgaaaagtgtgtctcgtggaagctccgcggctggaccatggacccggacctggacctcgacctagacatggatatggagacgctcgccggcgacagcggcggcgaggccgagcgcaacgaagccgccgaggccgaggctgaggtggagcggtacgaggccgccgaagccgaggccgacatcctccgcgaccgattccgcctcgccgtcatcagcatcgccaccgccgaaggaaagaaggccggaatgactgtcgccgaccccgttgtttcctgcatcnccgacttggcgttcaagagcgcagagcagctagcaaacccaccacagttgtttgcacagcatgccggtcgcaaatccgtcaggatggatgatgtcatactcacagctcacaggaacgagcatcttatgggcctgctgcggaccttctctcacgagctgaatggaaacgagcctgccagtgagaggaagagaaagaaatcgcccaagaaggatgagacggtgatccaagtctggattcaaaaactgtcccccttttctctttagagagggaagccatcccctttttacctcgcgagggccctcccggctttgaacacctttccttg

SEQ ID NO: 45461 - protein, 167 aa, Zea mays
  misc_feature: Ceres CLONE 1449323-F
  misc_feature (81)..(81): Xaa is any aa, unknown, or other
MDPDLDLDLDMDMETLAGDSGGEAERNEAAEAEAEVERYEAAEAEADILRDRFRLAVISIATAEGKKAGMTVADPVVSCIXDLAFKSAEQLANPPQLFAQHAGRKSVRMDDVILTAHRNEHLMGLLRTFSHELNGNEPASERKRKKSPKKDETVIQVWIQKLSPFSL

SEQ ID NO: 45462 - DNA, 447 bp, Zea mays
  misc_feature: Ceres CLONE 1449325-F
  misc_feature (196)..(196): n is a, c, t, g, unknown, or other
  misc_feature (287)..(287): n is a, c, t, g, unknown, or other
aaagctggagctccccgcggtggcggccgctctagaactagtggatcccccgggctgcaggaattcgcacgagaccattacctagaacatcctaatcgaaaaactcacgattggagtttcacctcggcagcccagccagccagtggttcctcggctcggaggaacagggcgaacagcaagagcttctgaagatgangcgatccccgtggctctctgctcccgtcctggttgctgccgcctctcgtcagctctcgcgaagcacaaacgcgccgtgccgacgcgtggcnacgcagtgcgcaccggtgtcgctaaaaagccggcgggcatggcctttcataatgctccgaagtgcagggtggctgcctcgggccctaacccccagaaaatgcccctgctaggaacttaatccccaaaaaccggccccttggccctaggcctcccgttaag

SEQ ID NO: 45463 - DNA, 715 bp, Zea mays
  misc_feature: Ceres CLONE 1449339-F
  misc_feature: Encodes the peptide sequence at SEQ ID NO. 45464
cagaagctggagctcaccgcggtggcggccgctctagaactagtggatcccccgggctgcaggaattcgcacgagaccattacctagaacatcctaatcgaaaaaactctgaaggcgctacagcaacgtcgccacttcactcacgattggagtttcacctcggcagcccagccagccagtggttcctcggctcggaggaacaggcgaacagcaagagcttctgaagatgaaggctatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaagggcggggggggcatgctcccctccataatgtgctaccccccccgggggggctgagtgcagacggggtcgtacggcaggaagggaggagcggcccctgccaagggtactgaattcccccaataaccgacccgcccaagcgctcctgggccctgcttttttagcgcacggaggaagatctcgctattttttgtccggattcgggggcggtacgtaccttttcctggtagggttgcagccaccagccggggacatgactccactcgctcctgcgagccttggatgttgtcgcacccccccgggtatactataggaacgacatacgagcccgtgcgcggctattgt

SEQ ID NO: 45464 - protein, 66 aa, Zea mays
  misc_feature: Ceres CLONE 1449339-F
MKAIPVALLLLVLVAAASSFKHLAEAADGGAVPDGVCDGKCRSRCSLKKGGGGMLPSIMCYPPRGG

SEQ ID NO: 45465 - DNA, 711 bp, Zea mays
  misc_feature: Ceres CLONE 1449352-F
  misc_feature: Encodes the peptide sequence at SEQ ID NO. 45466
  misc_feature (413)..(413): n is a, c, t, g, unknown, or other
  misc_feature (414)..(414): n is a, c, t, g, unknown, or other
aaagctggagctccccgcggtggcggccgctctagaactagtggatcccccgggctgcaggaattcgcacgagaccattacctagaacatcctaatcgaaaactccaccgttcttggattcttgtcattgccacacctctcctcttctcaagaagggccaccaacaaaatgcctgcccacggccaccatcgctggctcttcctcccgatctgctgcccaagcttcgcggccggcgccgagccgtcgtcgtcccagtctgctgcatgctccacggggcgcctctgctggatagccaggaagaagaggaagcggctgaagcctcgtcgtcgtgctagtagcgtcggctgcgaggagcgcctaggtgctgctctctgattgattgacgctatcctcgtcgagcttatttctcaccnncgtcgttgtgtttaataaatacatatatatctcttcactcttcttcttgaccttgccagactttctagtttaggataaacctacacccattatcctcccttttccatatacctatacctcttcctcccacgtctaatcagttctatatcttttccggtccccgtttatccctttggaacttggaaacttgggaaaaactgcctggaaaccctaaaaaattttttttaagacctttgggccctttgccccgcgccccctggcatttttttcctcccctttttcaccacactttaaggg

SEQ ID NO: 45466 - protein, 68 aa, Zea mays; identical to SEQ ID NO: 10710
  misc_feature: Ceres CLONE 1449352-F

SEQ ID NO: 45467 - DNA, 685 bp, Zea mays
  misc_feature: Ceres CLONE 1449354-F
  misc_feature: Encodes the peptide sequence at SEQ ID NO. 45468
  misc_feature (323)..(323): n is a, c, t, g, unknown, or other
  misc_feature (324)..(324): n is a, c, t, g, unknown, or other
tccccgcggtggcggccgctctagaactagtggatcccccgggctgcaggaattcgcacgagaccattacctagaacatcctaatcgaaaagtgtgtctggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcnngcaggctgggcacctcggcgactccgtcaccatctctcgcgagaagaccaggtcaccgtcacctctgacggaccttcctcaagaagtacctgaagtactggccaaaaaatcctttaaaaagcccacctgcggggattgcctccccgggtttgctgccaaaaaggcccaaaacgtctttaggccccccaccttccaatttggtaaaaaacggggcgaaaaaaaaattaaatcgccccccccttttttttttattttgaccccctggttttttaaccccccccccttttttcccaaaaaccccctttttggggggggggtggtaattaaaaaactcttttgtgtaacccctccaaaaaatttt

SEQ ID NO: 45468 - protein, 174 aa, Zea mays
  misc_feature: Ceres CLONE 1449354-F
  misc_feature (16)..(127): Pfam Name: Ribosomal_L22e Pfam Description: Ribosomal L22e protein family
  misc_feature (54)..(54): Xaa is any aa, unknown, or other
MARGVVSAKGGAVAGKKKGSVSFTIDCTKPVEDKIMEVASLEKFLQERIKVAGXQAGHLGDSVTISREKTRSPSPLTDLPQEVPEVLAKKSFKKPTCGDCLPGFAAKKAQNVFRPPTFQFGKKRGEKKIKSPPPFFFILTPWFFNPPPFFPKNPLFGGGVVIKKLFCVTPPKNF

SEQ ID NO: 45469 - DNA, 684 bp, Zea mays
  misc_feature: Ceres CLONE 1449360-F
  misc_feature: Translation starting site: 311
  misc_feature (490)..(490): n is a, c, t, g, unknown, or other
  misc_feature (506)..(506): n is a, c, t, g, unknown, or other
ggagctccccgcggtggcggccgctctagaactagtggatcccccgggctgcaggaattcgcacgagaccattacctagaacatcctaatcgaaaaaccattccgagttttctccccaccctcctccgtggctgccagtcccgcgggagcgcagcgcgcgctgctctacggtcgccgcgcgccgttcgcgggagcgctcctgtttttcagcatcggcgccgtcagcgctgcggtcgcgttcaggacagggtgcgccatctcacaccgacgtccccccttcctcggggcaagaggtctcagttccactagaatggagtcagcttcgaccacagtgccatccattgtcgtgtatgtgacagttccaaatagggaagcagggaagaagctgtcacagagcatcatcagcgagaagcttgctgcttgtgtcaatatagtacctggcattgaatccgtgtactggtgggagggaaaggtacatctgatgctgaangattactcatcatcangaccaggaaatcacctctggatgccttgactgcccatgtcaaagccaatcctggatttgatggtcctgaatttattgccctcgccctaactggggggtaacccccaattttttgaatgtgatcaaaacccccccccggacaaaggattcccttttttttttggaaccccaacaatggg

SEQ ID NO: 45470 - DNA, 798 bp, Zea mays
  misc_feature: Ceres CLONE 1449379-F
  misc_feature: Encodes the peptide sequence at SEQ ID NO. 45471
  misc_feature (14)..(14): n is a, c, t, g, unknown, or other
  misc_feature (15)..(15): n is a, c, t, g, unknown, or other
  misc_feature (20)..(20): n is a, c, t, g, unknown, or other
  misc_feature (428)..(428): n is a, c, t, g, unknown, or other
  misc_feature (798)..(798): n is a, c, t, g, unknown, or other
tttgcccccccgcnntgggngtacgttccaacgatacccccgtttaaaatatttaatctggagctccccgcggaggcggccgctctagaactagaggatcccccgggctgcagagaattcgcacgagagcattacctagagactcctaatcgaaaaaacattaccaaggcgatagataacaggaaggaaagaacataggcagccgaagagactgtagcgaggcaaggccatcgtctgccaggaggctgtccctctccaagtagttcctccccatccccgccgccgcgaggaccatcgccggcaccctacactccgtcgtcccctcccaggggatgcgctgctcgatgcccaagaaggggttgcacccggagatctacaaggacgcgaaggtgtactgcgacggcgagctggtgctggtgacggggganaccaaaccaaatacacagcggacgtgtggtccggaaacaagccctacaaagtcggcgagccctcgggcgctcgtggtcatggacaggcagaccgagaagttccgcaggacagtgcggccacctcaaggagtactgggcgcgaggaccagtgggagcgagatcgctcccaggacgaacaccccggagttctgaggccgagggggacaagctgattggatgggctcctcggtttgctctcagcccgggtggaggggttcacccgggtccaagttttacagtttgccccctcggtggaagtggtaagtccaggatctcctggtccaggttcgccattgggctccccccaacggtgattcccggcctatatagn

SEQ ID NO: 45471 - protein, 95 aa, Zea mays
  misc_feature: Ceres CLONE 1449379-F
  misc_feature (32)..(32): Xaa is any aa, unknown, or other
MRCSMPKKGLHPEIYKDAKVYCDGELVLVTGXTKPNTQRTCGPETSPTKSASPRALVVMDRQTEKFRRTVRPPQGVLGARTSGSEIAPRTNTPEF

SEQ ID NO: 45472 - DNA, 682 bp, Zea mays
  misc_feature: Ceres CLONE 1449384-F
  misc_feature: Encodes the peptide sequence at SEQ ID NO. 45473
  misc_feature (385)..(385): n is a, c, t, g, unknown, or other
atagctggagctccccgcggtggcggccgctctagaactagtggatcccccgggctgcaggaattcgcacgagaccattacctagaacatcctaatcgaaaaccccacctcgctcgcgcaagtcgtcgcacccttccccaggccccagccccagctagccatggcgaccgcgccgcggaggctgctccccgcgctcctcaaggccctagctccagccggcgcgcgcggcctctccaccgagaaggctgtcggcgccgccgccgtcgctgtcgtgggcagccacaccgctaagtggatgcaggacacgagcaagaagtcaccgatggaactgatcaacaaggtacctccgatcaaggttgatggccgcatcgccatttgtaaaagncctactaaaggtgttgggcttggccacccaatccagtatatctgccttgatctggaggcaccccaacgtgtgcaaatactgtgcgctcccgtatgtgcaaattcactatcactaaatagggaagatactggcgtttaccgctgccaaagtttggaactgaagagcttatgcatgcacccttggttcacttagttcctgtactggacttcccactatgcttggcgtccaaaaattaacctttgaggaacttccccttttcgggatgactacttaaaaaaaattgggttaactggacaa

SEQ ID NO: 45473 - protein, 138 aa, Zea mays
  misc_feature: Ceres CLONE 1449384-F
  misc_feature (75)..(75): Xaa is any aa, unknown, or other
MATAPRRLLPALLKALAPAGARGLSTEKAVGAAAVAVVGSHTAKWMQDTSKKSPMELINKVPPIKVDGRIAICKXPTKGVGLGHPIQYICLDLEAPQRVQILCAPVCANSLSLNREDTGVYRCQSLELKSLCMHPWFT

SEQ ID NO: 45474 - DNA, 673 bp, Zea mays
  misc_feature: Ceres CLONE 1449393-F
  misc_feature: Encodes the peptide sequence at SEQ ID NO. 45475
tccccgcggtggcggccgctctagaactagtggatcccccgggctgcaggaattcgcacgagaccattacctagaacatcctaatcgaaaagttcgttccggagcgccagagagagaaagaaaaggaaaagaagcgcctttgcccaccgcgcgatcaatcaatccggggtccggcggcctgccatggtgaagctggcgacggccagggaggcgcggctgtacgggccggcgctggcggcaaggcggtgggagtacatcaacgcgggaacatacgtgttcgcggcgctgctcctggtcctggcggcggcgctgtccatgtccgtgtccgcggccaggccggggctcgccgtaggcgccgtggcgctggcggccgtggcggccgtcaacgcgcacgacctcgccgcgcacctggctggcgtcgactgccgcgtgggactggcgaggtacgatgcccagctcgggctcgtggagttcctcgtgccggccgtgcacgcagccgggtgcgcgctcgccgccgccggcctggcgctgctggcctccccccactcccagtcccagcagcggcacgcggcgaccatgctgctcgtcgcggcgctgctgtgggtgctgggctccgtgctcaactcctgccaggtgtacgagcgcgccgacggccgcgcgcagctgctgcagt

SEQ ID NO: 45475 - protein, 163 aa, Zea mays
  misc_feature: Ceres CLONE 1449393-F
MVKLATAREARLYGPALAARRWEYINAGTYVFAALLLVLAAALSMSVSAARPGLAVGAVALAAVAAVNAHDLAAHLAGVDCRVGLARYDAQLGLVEFLVPAVHAAGCALAAAGLALLASPHSQSQQRHAATMLLVAALLWVLGSVLNSCQVYERADGRAQLLQ

SEQ ID NO: 45476 - DNA, 644 bp, Zea mays
  misc_feature: Ceres CLONE 1449395-F
  misc_feature: Encodes the peptide sequence at SEQ ID NO. 45477
ctccccgcggtggcggccgctctagaactagtggatcccccgggctgcaggaattcgcacgagaccattacctagaacatcctaatcgaaaagctgcacactgttcatcttcctcaaaccgccactccctcacgtcttgcgcgcagccgccgcaccacgtcctcgcctcgcggcatctcgcctcaccttgctgcatctcgcgctcgcctcgccctcgctgcgctcgtcatcctgcagagaagccccacgtgcacgtcctctggccgagctcccagcaccctccgcaaaagccccatggaggcgtgcgattagagcccctgcccatcccctacgtgttgctgtgcccggacgccgccgcagccgcgtagccatggccgccgtcatgccctgcgcacacgtcacttccgccatacgcccactgctccggcgatcttgttggcatgtgtggtcgctacatcccgcgttgccaagatcgcgattcgtttccgagcttcgaggaatcgacgatcaagccttggtgaccaagtgatcgaactcttcgagttctacgaggctgaagaccctgagcatctatttggtgaaggttgcctttggtgcaatctatgctcaggtaaacaaggcgtcgaggcggatctccaggagtc

SEQ ID NO: 45477 - protein, 52 aa, Zea mays
  misc_feature: Ceres CLONE 1449395-F
MAAVMPCAHVTSAIRPLLRRSCWHVWSLHPALPRSRFVSELRGIDDQALVTK

SEQ ID NO: 45478 - DNA, 695 bp, Zea mays
  misc_feature: Ceres CLONE 1449403-F
  misc_feature: Translation starting site: 252
  misc_feature: Pfam Name: DUF1001 Pfam Description: Protein of unknown function (DUF1001)
  misc_feature (384)..(384): n is a, c, t, g, unknown, or other
  misc_feature (396)..(396): n is a, c, t, g, unknown, or other
aagctggagctccccgcggtggcggccgctctagaactagtggatcccccgggctgcaggaattcgcacgagaccattacctagaacatcctaatcgaaaaacagaaaatacatcgccatttccccaatttaccgctgacaccctccacaaaccgcgaatttcctccccggctcctctccctcctccccagtcaatccccacacagtctcggccgggccctcgcgaggccgccgtggaaggacccccagcgatgggctccggcgaggaggacacaggaggcggaggaggggcggtgcggggcgcggtgctgaaggcgctcgtggttgtcggcggcgtcctgctgctccgccgcctgcgccgctccactacccgatgggaccacncgcgagccgtcnccgacgcgctctccggaaaaacccctccagggaccaggcaaggaaggatcctgacaacttcttcaatttgagaatgctcacatgtcctgcaaccgagatggtggatggttcaagggtgctttactttgagcaggcatttttggagatctccagaaaacgccttttaaaccaaagattctaccttggttaaagcccttgtcccgaacggagatgaaaatgccgatgtctgaagttgaaacttcatactggcaattataggattgctgaaaaaagtaacaagaaaattttctgttggaccg

SEQ ID NO: 45479 - DNA, 781 bp, Zea mays
  misc_feature: Ceres CLONE 1449408-F
  misc_feature: Translation starting site: 191
  misc_feature (417)..(417): n is a, c, t, g, unknown, or other
  misc_feature (623)..(623): n is a, c, t, g, unknown, or other
  misc_feature (624)..(624): n is a, c, t, g, unknown, or other
aaagctggagctccccgcggtggcggccgctctagaactagtggatcccccgggctgcaggaattcgcacgagaccattacctagaacatcctaatcgaaaaaattcccttccttcgcctggccgcgaccagtaccacccaccgctcgctctcgctcccaggcctcctgcctcccggcccgcgccgcgccatggaagagccgccgccggggagcagcaaggccgccgcggcgcgcgcgccccgggtggtgggcgtgctggcggggctgctggagcgcgcggcggagcgcggcgacacggcgacgccgacgctggcggactcggcgttccggggccgcgcgctgcccgggatccccgtgctggcgtacgcggaagcggatataccggtacgccgggtgcagcccggcctgccaccccntccgctacttctaacttcaaccgcatcaggcgggggaaaatgctaaccccggcccccggccaaagactaagaacaaagaccaaggcgggcggtgtccggaatcgactcttaaacccggcccacggcccccctctaaaccttcggttttgggccccccccaatttttggggggaaaaggggaccacaaaaacacctctttttttttnnggggggggccgcccgagagaagggcggaaaaaaacccccccggagatgacccccccccccttcccccgggggatcccccgacaaaaagccccccccgacacatataaacggggtatttggggcgccctcttttggtccctacacacccccccccccg

SEQ ID NO: 45480 - DNA, 691 bp, Zea mays
  misc_feature: Ceres CLONE 1449417-F
  misc_feature: Encodes the peptide sequence at SEQ ID NO. 45481
  misc_feature (434)..(434): n is a, c, t, g, unknown, or other
aaagctggagctccccgcggtggcggccgctctagaactagtggatcccccgggctgcaggaattcgcacgagaccattacctagaacatcctaatcgaaaattctagaaccttgcctccgaggtgccgccctccccgccccgcctgcgccgcttgctcatcgcttctctccccgcggcggcctcccagatccggttggatcgaggggcaaggtcaagagatggggcaggccttccgaaagctgtttgatgccttcttcggcaacaaggagatgcgggtggtgatgcttgggttggatgcagctgggaaaaccaccatactctataagcttcacattggtgaagttctctccactgtccctaccataggtttcaatgttgagaaggttcaatacaagaatgtagtgttcaccgcgtgggatgttggtggccagnagaagctcaggcccctgtggaggcactacttcacaacactgatgctctgatttacgtgggtgattcactggatagagagagaatcgggagagcagggcggaagttcaggctataatcatgaccctttatgcttaacgggtgttattggtgttgctacaagcaagacatgagggagcatgattccatgaattggtaaggcccttggctgtagacttgaaacccaatttggacatcagggccccgggcttaaaagggag

SEQ ID NO: 45481 - protein, 87 aa, Zea mays
  misc_feature: Ceres CLONE 1449417-F
  misc_feature (5)..(87): Pfam Name: Arf Pfam Description: ADP-ribosylation factor family
  misc_feature (72)..(72): Xaa is any aa, unknown, or other
MGQAFRKLFDAFFGNKEMRVVMLGLDAAGKTTILYKLHIGEVLSTVPTIGFNVEKVQYKNVVFTAWDVGGQXKLRPLWRHYFTTLML

SEQ ID NO: 45482 - DNA, 641 bp, Zea mays
  misc_feature: Ceres CLONE 1449425-F
  misc_feature (202)..(202): n is a, c, t, g, unknown, or other
  misc_feature (203)..(203): n is a, c, t, g, unknown, or other
  misc_feature (210)..(210): n is a, c, t, g, unknown, or other
  misc_feature (215)..(215): n is a, c, t, g, unknown, or other
  misc_feature (216)..(216): n is a, c, t, g, unknown, or other
  misc_feature (223)..(223): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (431)..(431): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (467)..(467): n is a, c, t, g, unknown, or other
  misc_feature (483)..(483): n is a, c, t, g, unknown, or other
  misc_feature (484)..(484): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (568)..(568): n is a, c, t, g, unknown, or other
  misc_feature (569)..(569): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (595)..(595): n is a, c, t, g, unknown, or other
tccccgcggtggcggccgctctagaactagtggatcccccgggctgcaggaattcgcacgagaccattacctagaacatcctaatcgaaaagcaccaccacaaccagtcctcacataatcatcttcattcactcactctcttcgatcactgtactgaagataccatggccaagtcgaccgcgatgtttgtagccgccctggnnccctggntgggnntggtggnatggccggacgaacgaagcacagggcggtggcaggggcggcagcggcgtgcgatcccaagccgcctgggggggggggggggaatccccggggggttttttgggggggggggagaaaaacccccccggggggannnttgtttgtcccccccccccggggggggggcgcnnnnnnnnnnncggggggggagggggagnnnnnnnnnnnangaggaggggggcgnnnnnnnnnnnnnnnnnnnncgncgcgccgggggtgggnntnnnnnnnnngnnnnnnnnnnnnnnnnnnnnnnnnnnnnnnnnnnnnnnnnnnnnnnnnntgnnnnnnnnnnntgggggcgggnntgggggnnnnggggggggttgggtgnggtgtggggggggcgcacgggacaaaaaaaccccacccgccggcgg

SEQ ID NO: 45483 - DNA, 793 bp, Zea mays
  misc_feature: Ceres CLONE 1449433-F
  misc_feature: Encodes the peptide sequence at SEQ ID NO. 45484
  misc_feature (430)..(430): n is a, c, t, g, unknown, or other
caaagctggagctcaccgcggtggcggccgctctagaactagtggatcccccgggctgcaggaattcgcacgagaccattacctagaacatcctaatcgaaaaatcgtctcccacacccctctgccccaactcagaaaaaccctcgaaaagcggcggcggcgcgacatggcggaggtcgaggctccagctgctgcggttgcggcggcgacccctgaggtgacgacggtgaccgagggcggagccgctccggaggcgaagggtccgcacaagctgtaccgccagtggaccttctggtactacatccagtccaagcccacacccggcgctgcgtggtgtaccttccctcgaaaaggtgtataccttcgaggccggtttaataattatggggcttgttatgatcctgtttgtccggtgccccacccccacatngggactgttcgattttgcaccctattctaaggtgtgggagcagcagccctttatgggtaagaccccagagttgagacataatggctggccaagttgcacctggtcccccagggcaacatgtacagcctaaccctgtttagtaccaagggggcgcttgtaaacgtttgaagggttttttttctagggaaggcgctgaggttgaaatctaaactgatctttcggcgcacccgttagctacccgtccccgtccccgctaggaaaccaactcggcccttgcttgcacgtaggtactagcccaggttcccgccccctgttccagggttacacttcggctacgaaatgcggagtgcggctccttcattt

SEQ ID NO: 45484 - protein, 97 aa, Zea mays
  misc_feature: Ceres CLONE 1449433-F
  misc_feature (88)..(88): Xaa is any aa, unknown, or other
MAEVEAPAAAVAAATPEVTTVTEGGAAPEAKGPHKLYRQWTFWYYIQSKPTPGAAWCTFPRKGVYLRGRFNNYGACYDPVCPVPHPHXGTVRFCTLF

SEQ ID NO: 45485 - DNA, 651 bp, Zea mays
  misc_feature: Ceres CLONE 1449440-F
  misc_feature: Encodes the peptide sequence at SEQ ID NO. 45486
ctccccgcggtggcggccgctctagaactagtggatcccccgggctgcaggaattcgcacgagaccattacctagaacatcctaatcgaaaacatgttgatgtatctataacatctatctctatgtctcctaatatggatgtgttggcaaccactcatgttgatcaaaatggtgtctacctctgggttaatcaatctttattctcggtctcaacaaatactgaaaattatgccagtggtaaacatgtacggaatgtgtgtttgccagctgtttcatcaacagagagatctgaggaagaacaagttcagaatttaggagagtcatataagtccagtattaaaccttttgtcataacggatcatcaaataccgaatctagttaccctctccttacttccaaagagtcaatggcaaagtttgactaatcttgacattataaaggttcgcaataaaccaattgagccacctaagaaacctgagaaggcaccattcttcttgccttcagttccatccctttctggggagatattgtttgagcctcctgccagctcaaaagatacagacatcagtaccacgaagaatacaaatcataagatgtctgaactctcctctcatttcagtcagcagttgcaattttgtggtgaaacaaaga

SEQ ID NO: 45486 - protein, 216 aa, Zea mays
  misc_feature: Ceres CLONE 1449440-F
  misc_feature (89)..(216): Pfam Name: Utp21 Pfam Description: Utp21 specific WD40 associated putative domain
PRGGGRSRTSGSPGLQEFARDHYLEHPNRKHVDVSITSISMSPNMDVLATTHVDQNGVYLWVNQSLFSVSTNTENYASGKHVRNVCLPAVSSTERSEEEQVQNLGESYKSSIKPFVITDHQIPNLVTLSLLPKSQWQSLTNLDIIKVRNKPIEPPKKPEKAPFFLPSVPSLSGEILFEPPASSKDTDISTTKNTNHKMSELSSHFSQQLQFCGETK

SEQ ID NO: 45487 - DNA, 763 bp, Zea mays
  misc_feature: Ceres CLONE 1449456-F
  misc_feature: Encodes the peptide sequence at SEQ ID NO. 45488
  misc_feature (728)..(728): n is a, c, t, g, unknown, or other
ccccgcggtggcggccgctctattctagtggatcccccgggctgcaggaattcgcacgagaccattacctagaacatcctaatcgaaaagcacctccctttccccaactcgatctcgcacctagggtttcgtctcgtcgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatgggacgcgccgcctctgccatatccggggaaagatggacaaacacgccctggattccggcctggggaaacatcgtccttggtgggcctccgggaaatacccggaacaaacaagggccaaattttttccctcaagatcatgtaacaaaaaaggggccccccggcttaaagggccttcgggggagagtttttctgaacacccttcagggctctaaaaggggggcttcccaccccctaatgggcccccaaagagaggggggaaggggggcgggttacctccccccgctttgggagagggagaaataaccgcacaatttataaaaataattttttcttcttgttggggcgcactctgtttttttcatcagggattttttttcttctggtgttggggtggggtctttattttttatnaaacacacaaccactatggtgtagtgtgtggtgtc

SEQ ID NO: 45488 - protein, 123 aa, Zea mays
  misc_feature: Ceres CLONE 1449456-F
  misc_feature (30)..(78): Pfam Name: eIF-1a Pfam Description: Translation initiation factor 1A / IF-1
MPKNKGKGGKNRKRGKNEADDDKRELVFKEDGQEYAQVTRMLGNGRCEAICVDGTRRLCHIRGKMDKHALDSGLGKHRPWWASGKYPEQTRAKFFPSRSCNKKGAPRLKGPSGESFSEHPSGL

SEQ ID NO: 45489 - DNA, 702 bp, Zea mays
  misc_feature: Ceres CLONE 1449458-F
  misc_feature: Encodes the peptide sequence at SEQ ID NO. 45490
aagctggagctccccgcggtggcggccgctctttaactagtggatcccccgggctgcaggaattcgcacgagaccattacctagaacatcctaatcgaaaagcacctccctttccccaactcgatctcgcacctagggtttcgtctcgtcgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctcccccaccaccaggacgacaaggccgacgttatcctcaagtacatgaacgacgaggcgcgcctgctcaaggcctacggggagcttcctgacacgctcaggctcaacgagggcgtcgaacgtctatgggccctaggaaggcgaagagggcagccgacttcatccagttccgaggacgaggaacttcgaccaggatctaaagaaatccctgttcctggctttacgggcttccctggtatttgtgtacggtggaccgtggtttctttcctgccttctctgccttgccagactat

SEQ ID NO: 45490 - protein, 177 aa, Zea mays
  misc_feature: Ceres CLONE 1449458-F
  misc_feature (30)..(94): Pfam Name: eIF-1a Pfam Description: Translation initiation factor 1A / IF-1
MPKNKGKGGKNRKRGKNEADDDKRELVFKEDGQEYAQVTRMLGNGRCEAICVDGTRRLCHIRGKMHKKVWIAAGDIVLVGLPHHQDDKADVILKYMNDEARLLKAYGELPDTLRLNEGVERLWALGRRRGQPTSSSSEDEELRPGSKEIPVPGFTGFPGICVRWTVVSFLPSLPCQT

SEQ ID NO: 45491 - DNA, 667 bp, Zea mays
  misc_feature: Ceres CLONE 1449466-F
  misc_feature: Encodes the peptide sequence at SEQ ID NO. 45492
  misc_feature (463)..(463): n is a, c, t, g, unknown, or other
ggagctccccgcggtggcggccgctctagaactagtggatcccccgggctgcaggaattcgcacgagaccattacctagaacatcctaatcgaaaaatcgcgtcaatggcggcgccgcctgtccagcctgtgccaaccgcggcggcggcggcggcggctgtgaacggggacgcgttccgtctgggcttcgtcggcgcgggcaacctggccgagagcatcgcccgcggcgtggcggcgtcgggcgtcctcccggcctccgccatccgcaccgcgccccaccgccgccccgagcgcggcgaggccttcgcgtccttcggcgcgtgcttgctccaaaccaatgcccatgttgtggacgacagcgatgtgatcgtcatctccgtgaagcctcagatcgtgaagcaagttctacttcagctgaggccacggctgtcagaaaaaaagcttctcgtgtccattgctgccnggcatcagatgcaagatttgcaggattggtctgggtcacgacgtattattaagagtatgccccacaccccctcagctgtttgacaagctgcatcattcatgggtttggaaaaaaatgctactcaggagatgaaaacccggaaaaaaaactgttccggccctgggaaaactctgaacgttaaaaaaaattttttgaggctgaacg

SEQ ID NO: 45492 - protein, 146 aa, Zea mays
  misc_feature: Ceres CLONE 1449466-F
  misc_feature (25)..(143): Pfam Name: F420_oxidored Pfam Description: NADP oxidoreductase coenzyme F420-dependent
  misc_feature: SWISSPROT Homolog: EC 1.5.1.2 Pyrroline-5-carboxylate reductase
  misc_feature (120)..(120): Xaa is any aa, unknown, or other
MAAPPVQPVPTAAAAAAAVNGDAFRLGFVGAGNLAESIARGVAASGVLPASAIRTAPHRRPERGEAFASFGACLLQTNAHVVDDSDVIVISVKPQIVKQVLLQLRPRLSEKKLLVSIAAXHQMQDLQDWSGSRRIIKSMPHTPSAV

SEQ ID NO: 45493 - DNA, 687 bp, Zea mays
  misc_feature: Ceres CLONE 1449471-F
  misc_feature: Encodes the peptide sequence at SEQ ID NO. 45494
  misc_feature (385)..(385): n is a, c, t, g, unknown, or other
  misc_feature (386)..(386): n is a, c, t, g, unknown, or other
  misc_feature (393)..(393): n is a, c, t, g, unknown, or other
ctggagctccccgcggtggcggccgctctagaactagtggatcccccgggctgcaggaattcgcacgagaccattacctagaacatcctaatcgaaaaacccattgatctcatctcatgccctgttgccgcgcctgctcctccttccccatccgcgcccaccgccgcccctccggcagccccgccacgagcccacccgcaagcttcccgcacggccaccgctgcctggtatcaatcaaaccagtcgtccgtcctcctttccttcaaatcaagtccatttccactccctgtctaccctctccctcgtctctggtgggcggtggcctcgcctccctttccccgtcgccctgatggctcccctcgcagctctcgctccggtggccttnncgctcgncttctcgactccgctcgcgtcgaaccctaccccgtatagaataaacatagaaggccctttctgtttggcgtggtccgccaggaaaaaaagctagtaaagatcttccccaaggtacagtttatttgggggaaaaaagttaaaatgaaaatgggcttaaaaccccctcaaaaccggaatttttggaaaacggaaaaccccctaaaaactttaaaaagccccaaaggggtcccaaatttaaacctcccccggggcaaaaaaaatttccccccccaaaatattgggttttttttgaag

SEQ ID NO: 45494 - protein, 45 aa, Zea mays
  misc_feature: Ceres CLONE 1449471-F
  misc_feature (12)..(12): Xaa is any aa, unknown, or other
  misc_feature (13)..(13): Xaa is any aa, unknown, or other
  misc_feature (15)..(15): Xaa is any aa, unknown, or other
MAPLAALAPVAXXLXFSTPLASNPTPYRINIEGPFCLAWSARKKS

SEQ ID NO: 45495 - DNA, 681 bp, Zea mays
  misc_feature: Ceres CLONE 1449478-F
ctggagctccccgcggtggcggccgctctataactagtggatcccccgggctgcaggaattcgcacgagaccattacctagaacatcctaatcgaaaatactagtcgtcggtaatatctcgagccatccggcaccaaatcttcctccacgccgccggctgcccggcgcccacaggatacagtccagagaaatgccggccaccgccgcccagccaggtgcaacccctcggtccgcaatccgcttcctccgcctccgcagcacccaaacctcaaacctcgccatccccacgcgcactgctgcgcccccgcacgcgcgcctccgctgccacctttcccgctccagtgattccactccaccctcaccccccaccacccccgaccccgaccccgaccccgaccctgaccctgaatccgaatccgaatccgaagaataccctacgcttcgccttcgcgtgtgggggcccgggccccggggggcgcgtttactccgccatcgcgctcggccaacaagcttctacggcctcgctgcgcgccctccccgtcccctcattatgggggggccacgcccccgtcccttaaaaaccctaaagatgccccccgccggccctctttacccctttccgcccaccgtccccacggggagtttgcccccccgtggagggggaatccttccccccccggg

SEQ ID NO: 45496 - DNA, 660 bp, Zea mays
  misc_feature: Ceres CLONE 1449481-F
  misc_feature: Encodes the peptide sequence at SEQ ID NO. 45497
ctccccgcggtggcggccgctctagaactagtggatcccccgggctgcaggaattcgcacgagaccattacctagaacatcctaatcgaaaaatcacacagcttgcaaggcgccccatctctcaaaccatccgaacccccctcgccgctcactcccaagctaatccccgccggcagcgatggcccgcacgaagcagacggcgcgcaagtcgacgggcggcaaggcgccgcggaagcagctggcgacgaaggcggcgcgcaagtcggcgccggccacggggggcgtgaagaagccgcaccggttccgcccgggcaccgtggcgctgcgggagatccgcaagtaccagaagagcacggagctgctgatccggaagctgccgttccagcggctggtgcgggagatcgcgcaggacttcaagacggacctccggttccagtcctccgccgtggccgcgctgcaggaggccgccgaggcctacctcgtgggcctcttcgaggacaccaccctctgcgccatccacgccaagcgcgtcaccatcatgcccaaggacatccagctcgcgcgccgcatccggggcgagaggccctgagcacccccccgtctctgctgcgcttccttcgctttctgaattctgtagtgcgagaaactagtgcgtgttat

SEQ ID NO: 45497 - protein, 136 aa, Zea mays
  misc_feature: Ceres CLONE 1449481-F
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTTLCAIHAKRVTIMPKDIQLARRIRGERP

SEQ ID NO: 45498 - DNA, 699 bp, Zea mays
  misc_feature: Ceres CLONE 1449484-F
  misc_feature: SWISSPROT Homolog: EC 2.4.1.18 1,4-alpha-glucan branching enzyme
ctggagctccccgcggtggcggccgctctagaactagtggatcccccgggctgcaggaattcgcacgagaccattacctagaacatcctaatcaaaaatgattaggcttgtcacaatgggtttaggaggtgaaggctatctaaatttcatgggaaatgagtttgggcatcctgaatggatattttccaagaggtcctcaaagtcttccaaatggctccgtcattcctgggaataacaatagctttgataaatgccgccgtagatttgaccttggagatgcagattatcttagatatcgtggtatgcaagagtttgaccaggcaatgcagcaccttgagggaaaatatgaattcatgacatctgatcactcatatgtatcacggaagcttgaagaggataaggtgatcatctcccacagaggagatttggtcttcgtgttcaccttccactggagcaatagctattttaacctaccccgtgggttgtttcaagcctgggaaatacaaaatccttttaaattcgaacaatggccttttttccgggaattaatccggtttgaccatgatgcccaaaaccttttcctgcagacgggcccctttaaaaaaaggccgggttctttctccgcgctaattccccccaaaaaaacaccccgcctattttcccccccgcaggggcgaaaaaaaaaaaatagggcccacc

SEQ ID NO: 45499 - DNA, 789 bp, Zea mays
  misc_feature: Ceres CLONE 1449493-F
ctccccgcggtggcggccgctctagaactagtggatcccccgggctgcaggaattcgcacgagaccattacctagaacatcctaatcgaaaagatgcaagctgacgttctattcccacaatcccactccagaatctgccgagaccgagagagcctgccgattacacgcatctggccgacccccgcccccgatggccgatctctgcccgccggagccggggatgaacggctccagcgccagcgtggatcccgcactgccccacctgcaacccggtggtaccacagagagcttgattcctgctgccgggggcccatcgccagctggcaagggtttactcttcgggtatgaaattaaacccaacacccaccctccccagacatcaggcgtgggggtacctctgggattagaaaaatattaacccacccctcccggggggaaatcctatgaataacccaggcctgcgccggcaccaaaaagatgaacttctttgccggggaaggccccacgaagacgtcacaggggggataaaagactgggcggtgatttattttttctcggaccgggggaaaccttttttgcatcttatctgacggctggccttttttgcgctctccgagccacgccataaggcctctgtcgccaacttcccaatgatagctcttgctggctggtttaattgtgtggaatgaatcgcgaatttccgggaaatggcgtgtgcacaatctctagttcttcgtgtcttttcgcaaaaagcccaaaaggggcggcgtgtgaactattaacacaccg

SEQ ID NO: 45500 - DNA, 635 bp, Zea mays
  misc_feature: Ceres CLONE 1449503-F
  misc_feature (589)..(589): n is a, c, t, g, unknown, or other
gcggtggcggccgctctagaactagtggatcccccgggctgcaggaattcgcacgagaccattacctagaacatcctaatcgaaaatgagagccagaaatcacccttggttgcaaacaacactaatggtaaagaacacaaactaggaaagtcagaaaagacggtttgggaaaaaaatgacgaacccggtgatgaggtcgatgttcagcaaaatggctggggaacatggaaacaaaatagtacgtcagcttggtcttatagagcccttaggagcagcgcccttggcccgacgatggcacttctacgagggaagaacaaccagaggggtaaaccaccctatcgaaagaagggcaagtaattgcctatgtgtttagtgtttaagttcaacgatacctatgtaatcctgtgttggtccaatcttttagcagttgatcttatttatgtaaaatttggcgaggaagagtgactgccgttgctgccctggtcattttgaagtctggccaagcgaattgttatcgtttgcaaaggatcgttatgatttgctccgacacttgtcaaatgctggttttagagttttgcatgtgcactanaaatgttcataattccaaaaaaaaaaaaaaaaaagcttatcgatac

SEQ ID NO: 45501 - DNA, 654 bp, Zea mays
  misc_feature: Ceres CLONE 1449504-F
  misc_feature: Encodes the peptide sequence at SEQ ID NO. 45502
  misc_feature (526)..(526): n is a, c, t, g, unknown, or other
ctggagctccccgcggtggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggataccccgctcctgctccaaaatatgattcgtctggtctggcgcgcgtgagtccagctcgtgtgtcgtgtgtgtctctgtgtgaggtgtcggcgggcgtgtgtgtatgtatggagtcngccgccgcggcggcggcggaagaggtgtgcgcgtggtgggtggtacctgcttcaacgcgccccggtttgtcgcggcgatcatgtactaccctgctggcgtttcctggttatcaaagaaatgaattaat

SEQ ID NO: 45502 - protein, 57 aa, Zea mays; identical to SEQ ID NO: 43282
  misc_feature: Ceres CLONE 1449504-F

SEQ ID NO: 45503 - DNA, 726 bp, Zea mays
  misc_feature: Ceres CLONE 1449508-F
  misc_feature: Encodes the peptide sequence at SEQ ID NO. 45504
  misc_feature (517)..(517): n is a, c, t, g, unknown, or other
  misc_feature (531)..(531): n is a, c, t, g, unknown, or other
  misc_feature (537)..(537): n is a, c, t, g, unknown, or other
  misc_feature (562)..(562): n is a, c, t, g, unknown, or other
  misc_feature (563)..(563): n is a, c, t, g, unknown, or other
agctccccgcggtggcggccgctctagaactagtggatcccccgggctgcaggaattcgcacgagaccattacctagaacatcctaatcgaaaaatcgaggtccaaaaatccatctggattctggagagaggagaccccaaaatcgcagcgcgcgaaaacgcaggagcaacccgcccactcgccaccaccgcccgcgcgcacggcggcgaccgatggccccgctcgtgccgatgtcgcagccatgggtggagaaataccggccgaggcaggtcaaggatgtggctcaccaggaggaggtgattcgggtgctcaacaacaccctccagaccgccgacctgccgcacatgctgttctacggcccgccggggacgggaaagaccaccaccgcactagccatcgcctaccagctctacggtccagagctgtataagtcaagggttttggagctcaatgctagtgatgatcgtggaattaatgtggtgaggacgaaaatcaagaactttgctgctgttgctngtggtactgcacgnaaagcntggtatccctgcccacccttacagnnatatatacttgacgaagcagatttcatgacagaagatgcccagaaatgcttgaggcgtaccacggagacttactcccaagtgaccagattcttttttatatgcaactatatcagcaggataatagaaccactttgcatcagatgtgcaaagtttaggtttcag

SEQ ID NO: 45504 - protein, 171 aa, Zea mays
  misc_feature: Ceres CLONE 1449508-F
  misc_feature: SWISSPROT Homolog: EC 2.7.7.7 DNA-directed DNA polymerase
  misc_feature (102)..(102): Xaa is any aa, unknown, or other
  misc_feature (117)..(117): Xaa is any aa, unknown, or other
MAPLVPMSQPWVEKYRPRQVKDVAHQEEVIRVLNNTLQTADLPHMLFYGPPGTGKTTTALAIAYQLYGPELYKSRVLELNASDDRGINVVRTKIKNFAAVAXGTARKAWYPCPPLQXYILDEADFMTEDAQKCLRRTTETYSQVTRFFFICNYISRIIEPLCIRCAKFRFQ

SEQ ID NO: 45505 - DNA, 613 bp, Zea mays
  misc_feature: Ceres CLONE 1449517-F
  misc_feature: Encodes the peptide sequence at SEQ ID NO. 45506
ggcggccgctctattccagtggatcccccgggctgcaggaattcgcacgagaccattacctagaacatcctaatcgaaaacacgtccaaaaaccaaccaaagcacacacacactctgccggccaccatgccctcctctgcctccgctgacgccgagggcgcccgcagcaaacgcaaaagaggctcgtcggccgcatgcgcatccgacggcagcgaccagcagggcccgtcgtcccactggctgacgccgcgcgcgcagcaggcatactcctccaagctcctccaggcgctgcgcctcgtgcgcggcggcactggcacacccacctgctccgcctccgccccggcggtgcgcgacgcggcctaccgcgcgctggccgtggcggcgcggggtcggacacgctggagccgcgccatcctggcacgcagccgccggcgccgggcgctcctccgcgcgcgccgaccgccgcccccgacgccaaggcaccgtcagcggcggcatcagcagcagcaggacgagcggccggcgggagggctggctggcaaggccaaggtgctggcgcggttggtgccagggtgccggaacctgtcgctgaccgcgctcctgggcgaagtgt

SEQ ID NO: 45506 - protein, 162 aa, Zea mays
  misc_feature: Ceres CLONE 1449517-F
MPSSASADAEGARSKRKRGSSAACASDGSDQQGPSSHWLTPRAQQAYSSKLLQALRLVRGGTGTPTCSASAPAVRDAAYRALAVAARGRTRWSRAILARSRRRRALLRARRPPPPTPRHRQRRHQQQQDERPAGGLAGKAKVLARLVPGCRNLSLTALLGEV

SEQ ID NO: 45507 - DNA, 624 bp, Zea mays
  misc_feature: Ceres CLONE 1449521-F
  misc_feature: Encodes the peptide sequence at SEQ ID NO. 45508
ggagctccccgcggtggcggccgctctataactagtggatcccccgggctgcaggaattcgcacgagaccattacctagaacatcctaatcgaaaaaaggatgaaaataacgtgaacaaattctaccaactacgctgtgcttatcgcctctggcggcggcgagttcgctcacgtcccggcgacccctcgccggtggccacgggccgtgacactccggcatgccgcgcgccccacgccggcagtccgacgaggcgcgccgtggcgcctacaagccgcgcgtcgacttcagccgctcgcgccgccgccgcgaggacggcctcctcgccctccgccgcctcaaccgcgacacgggactcttcaagcgccgccgcgacgagcccgctcccgccgtccctgcctccgatctgactcctacacgcgccgaagcagccccattcgcaggaatcacccgtccggcattcactccctcctcaccgcccgacgtagcggctccccgggatgctgctgagtcagagcttgaaggcctgtcagagctggtcgacaaactatgttcagatgacaccaccagtcagctcgaagccacaatccagttcaggaaacttctttcagatgagaagaactcaa

SEQ ID NO: 45508 - protein, 135 aa, Zea mays
  misc_feature: Ceres CLONE 1449521-F
  misc_feature (5)..(124): Pfam Name: IBB Pfam Description: Importin beta binding domain
MPRAPRRQSDEARRGAYKPRVDFSRSRRRREDGLLALRRLNRDTGLFKRRRDEPAPAVPASDLTPTRAEAAPFAGITRPAFTPSSPPDVAAPRDAAESELEGLSELVDKLCSDDTTSQLEATIQFRKLLSDEKNS

SEQ ID NO: 45509 - DNA, 660 bp, Zea mays
  misc_feature: Ceres CLONE 1449523-F
  misc_feature: Encodes the peptide sequence at SEQ ID NO. 45510
ggagctccccgcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaaatatgattcgtctggtctggcgcgcgtgagtccagctcgtgtgtcgtgcgtgtctctgtgtgaagtgttcggcggcgtgtgtgtatgtatggagtccgccccgccggccgcggaggaggaagtgtgcccgtggtgggtggtacctgcttcgacgcgccactgtttgtcgcggcgatcatgtactaccctgctgcgttttcctgttatcaatgagatgatttatttgattcaaaaaaaaaaa

SEQ ID NO: 45510 - protein, 57 aa, Zea mays; identical to SEQ ID NO: 43282
  misc_feature: Ceres CLONE 1449523-F

SEQ ID NO: 45511 - DNA, 651 bp, Zea mays
  misc_feature: Ceres CLONE 1449528-F
  misc_feature: Encodes the peptide sequence at SEQ ID NO. 45512
  misc_feature (418)..(418): n is a, c, t, g, unknown, or other
aaagctggagctccccgcggtggcggccgctctagaactagtggatcccccgggctgcaggaattcgcacgagaccattacctagaacatcctaatcgaaaaactctcgtgcttctgcttccccacccagtcacctcgacctcagcccctctcgccctccctaatctcgactccgatgccgccgccgctcctccaggcgcgcgactacatgggcgccggcgccacccctctgtcctactcctccagcggcgagggcacggggccgcacctcgcgctgcggctcgggctcccagggtccgactcccccggccgcgacgcggggccggagccggaccacgcccacgtcgacgccgcgctcaccctcggccctgcccccgcccccgcccccgcgcctcccagggtcggcgcaaagcccgcnttcgccgactcccgcgaccggtgcgcgaagcgggacgccactgctgcggatgacgctgctgggggagtgaccggggaggagaagcgggtaggtgcggccgctgccggagctccgccggctgccaaggcgcaagttgttggatggccgcctgttaggagctaccggaagacccactagctatgagtgccacaaagacaaacggggaaaatgaagggagggagtgacgccggacc

SEQ ID NO: 45512 - protein, 139 aa, Zea mays
  misc_feature: Ceres CLONE 1449528-F
MPPPLLQARDYMGAGATPLSYSSSGEGTGPHLALRLGLPGSDSPGRDAGPEPDHAHVDAALTLGPAPAPAPAPPRVGAKPAFADSRDRCAKRDATAADDAAGGVTGEEKRVGAAAAGAPPAAKAQVVGWPPVRSYRKTH

SEQ ID NO: 45513 - DNA, 610 bp, Zea mays
  misc_feature: Ceres CLONE 1449537-F
  misc_feature: Encodes the peptide sequence at SEQ ID NO. 45514
  misc_feature (338)..(338): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
ggagctccccgcggtggcggccgctctagaactagtggatcccccgggctgcaggaattcgcacgagaccattacctagaacatcctaatcgaaaaagccacggatcgagacgtcccaatcgagctaatctcacaccgccagtgccagtgccagcggcagctgctaatccgtgccgtgttccagcagcgatgggagtggagtcggagtgcgacaggataaagggcccctggagccccgaggaggacgaggcgctgcggcgtctcgtggagcgccacggcgcgcggaactggacggcgatcgggcgcggcatcccggggcggtcggggaagtcgtgccnggctgcgtggtgcaaccagctgtcgccgcaggtggagcgccgccccttcacgccgaaagagacgccgcgatcctggcgcgcaagcccggtgggcaccgggggggccgcattcgggggcttttccggggggcacgaaaaagccgttaaaaacccttgaaatcctcccctaaaaggaaatttcccccccccggggaacctcccnnngaattaattttaaagggtgtttaaacccaaacccctgcccgggaaacccaaggggttgaaacccaacc

SEQ ID NO: 45514 - protein, 101 aa, Zea mays
  misc_feature: Ceres CLONE 1449537-F
  misc_feature (11)..(57): Pfam Name: Myb_DNA-binding Pfam Description: Myb-like DNA-binding domain
  misc_feature (50)..(50): Xaa is any aa, unknown, or other
MGVESECDRIKGPWSPEEDEALRRLVERHGARNWTAIGRGIPGRSGKSCXAAWCNQLSPQVERRPFTPKETPRSWRASPVGTGGAAFGGFSGGHEKAVKNP

SEQ ID NO: 45515 - DNA, 719 bp, Zea mays
  misc_feature: Ceres CLONE 1449538-F
  misc_feature: Encodes the peptide sequence at SEQ ID NO. 45516
  misc_feature (432)..(432): n is a, c, t, g, unknown, or other
aagctggagctccccgcggtggcggccgctctagaactagtggatcccccgggctgcaggaattcgcacgagaccattacctagaacatcctaatcgaaaaatatattccctcggagcaaagtgttgcggaattcacatcagccagggagaagcccgctgacagctgcaactgcaagccgccagcgggctgagctgaggctgtgtcgatccatccggattcaggaaaacaacgccgatcaatccagtccagaggaagggcgatggccgcccctaggatcgccgcctgcaccacctccgcccgcaccgccctcgccttgacagacgaccccgcgccgccggacactctggacgtggtgcgccggcagtaccagctcctacgccgcgccgcggccctctgcctcgacccgataaacttatcccccccccccacncatccactctgcctccgatgtccactccttgggccggagccggagccaggagcagaccgccgacccctccgcactgccggcgcgtccctgaggatctgaaccgacaaagacaagaccctttccttcttgccataggagttgatggggacttggttcttaaacgcttagagttcaaaaagcggcaacctacaaaagtgttaagtgtaaaagaccttctgtcctccagagccattatataccctccgggcaaaaaatggagtttccagaaccaacggtctataaaaccc

SEQ ID NO: 45516 - protein, 89 aa, Zea mays
  misc_feature: Ceres CLONE 1449538-F
MAAPRIAACTTSARTALALTDDPAPPDTLDVVRRQYQLLRRAAALCLDPINLSPPPTHPLCLRCPLLGPEPEPGADRRPLRTAGASLRI

SEQ ID NO: 45517 - DNA, 658 bp, Zea mays
  misc_feature: Ceres CLONE 1449542-F
  misc_feature: Translation starting site: 370
  misc_feature: Pfam Name: Ribosomal_S26e Pfam Description: Ribosomal protein S26e
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaaaaaaaggtgttcttctcccctcatcgcatacgggataccgcactagaggcgccgccgccgccgtttcgcgcaccggaccctatccgtcgtcagcgggggcttcgagctcatccagacatgactgtcaagacggaggactggcgaacgcgacaagcacgggcgcggccacgtcaagtacatccgctgctccaactgcgacaggtgctgccccaacgataacgctatcaagcggttcttgctgaggaacattgttgagcaagctgccgtgagagatgtgcatgaggcctgtgtacatgatgcacatgttctacccaaattgtatgcaaaggttcatcactgagtctcatgtgcaagcaatgcacacattgcccggatccgctctcgtgagaccaggaggaaccgtgagcccccgcagcgcttcagacgccgggatgatggccctaggcctggtcgtggcccgccgcgacgaggcggtgcagctcctgcagctgcagctgctggtgctcctcggacctaagttctggcacttacttcgagtgcttactttttcggaaacctgan

SEQ ID NO: 45518 - DNA, 725 bp, Zea mays
  misc_feature: Ceres CLONE 1449554-F
  misc_feature: Encodes the peptide sequence at SEQ ID NO. 45519
tggagctccccgcggtggcggccgctctagaactagtggatcccccgggctgcaggaattcgcacgagaccattacctagaacatcctaatcgaaaaagacccagatcgcacgacgcaaccgatccccaaatcttcccagttcccccctcccgctcgacccagatcgaggcctcgatccaccggccatggcgctggagtgggtggtgctgggctacgcggcgggcgcggaggcggtcatgctgctgctgctgacgctgccggggctcgacggcctgcgccggggcatggtctccgtggtgcggagcgcgctcaagcccatgatgtccgtggtgcccttctgccctctcctgctcatggacatctactggaagtacgagacgcggcccacctgcgacgacgagcacgcctgcaccccctccgagcacctccgccaccagaagtccgtcatgaagtcgcagcgcaacgggctcctcatcgccgccgcgctcatcttctactggatcctctttctcggtcacccagctcgtcgtcaggcttcgaccagatgcagaaacgcgttcaacaaagctcaagaaagccccaccactgatgggggctcgggtttcccgccttcccccggtccccccggggggccccgttcttcccctgggcccggaaatttttggtttttttttttccccgggggggaggggcgggaagctaaaaactccccacggaattttgg

SEQ ID NO: 45519 - protein, 179 aa, Zea mays
  misc_feature: Ceres CLONE 1449554-F
MALEWVVLGYAAGAEAVMLLLLTLPGLDGLRRGMVSVVRSALKPMMSVVPFCPLLLMDIYWKYETRPTCDDEHACTPSEHLRHQKSVMKSQRNGLLIAAALIFYWILFLGHPARRQASTRCRNAFNKAQESPTTDGGSGFPPSPGPPGGPRSSPGPGNFWFFFFPGGEGREAKNSPRNF

SEQ ID NO: 45520 - DNA, 626 bp, Zea mays
  misc_feature: Ceres CLONE 1449557-F
  misc_feature: Encodes the peptide sequence at SEQ ID NO. 45521
  misc_feature (11)..(11): n is a, c, t, g, unknown, or other
  misc_feature (35)..(35): n is a, c, t, g, unknown, or other
  misc_feature (79)..(79): n is a, c, t, g, unknown, or other
  misc_feature (294)..(294): n is a, c, t, g, unknown, or other
  misc_feature (296)..(296): n is a, c, t, g, unknown, or other
  misc_feature (297)..(297): n is a, c, t, g, unknown, or other
  misc_feature (327)..(327): n is a, c, t, g, unknown, or other
  misc_feature (328)..(328): n is a, c, t, g, unknown, or other
  misc_feature (336)..(336): n is a, c, t, g, unknown, or other
  misc_feature (408)..(408): n is a, c, t, g, unknown, or other
  misc_feature (409)..(409): n is a, c, t, g, unknown, or other
  misc_feature (554)..(554): n is a, c, t, g, unknown, or other
ggagctccccncggtggcggccgctctataactantggatcccccgggctgcaggaattcgcacgagaccattacctanaacatcctaatcgaaaaatcgattcgcctcctccgctctttactcttcgtcgtactcgtctccccccacccgcaaccgcagggagagaaaggggaagcccgccgccgccccggcccccagcaaccagcagatcgggacctctgttctgcgcaatccatccatggcggaggaatcaggccgtcccttgccaaagtttggtgaatgggatgtcaacnanncggcttccgcagacggatttactgtcatanncaacaaanccagagatgagaagaagggtgggaatggtcaagacacagactcaccttccaaggaccccaggactgagaggnnggagtcttatgctgcaaaaccaagcacgaagaaatggttttgttgtgtgacagccagccctacgcaatcctgaggaaggcaattgcatgcgctggaaatactgcccctttaattttctatacatactatccataaaacactgtanaggtacccatggctctctgggctccaggatgggtgtctcataaaactctggcgtgcatgtatgtatggtgtg

SEQ ID NO: 45521 - protein, 80 aa, Zea mays
  misc_feature: Ceres CLONE 1449557-F
  misc_feature (1)..(73): Pfam Name: NOI Pfam Description: Nitrate-induced NOI protein
  misc_feature (19)..(19): Xaa is any aa, unknown, or other
  misc_feature (20)..(20): Xaa is any aa, unknown, or other
  misc_feature (30)..(30): Xaa is any aa, unknown, or other
  misc_feature (33)..(33): Xaa is any aa, unknown, or other
  misc_feature (57)..(57): Xaa is any aa, unknown, or other
MAEESGRPLPKFGEWDVNXXASADGFTVIXNKXRDEKKGGNGQDTDSPSKDPRTERXESYAAKPSTKKWFCCVTASPTQS

SEQ ID NO: 45522 - DNA, 666 bp, Zea mays
  misc_feature: Ceres CLONE 1449563-F
  misc_feature: Encodes the peptide sequence at SEQ ID NO. 45523
  misc_feature (403)..(403): n is a, c, t, g, unknown, or other
  misc_feature (470)..(470): n is a, c, t, g, unknown, or other
  misc_feature (471)..(471): n is a, c, t, g, unknown, or other
  misc_feature (500)..(500): n is a, c, t, g, unknown, or other
aagctggagctccccgcggtggcggccgctctagaactagtggatcccccgggctgcaggaattcgcacgagaccattacctagaacatcctaatcgaaaaattttcgagatgaacgaacagtccagaacccactgctcgaaaccgcagccactggccagtcgatgcccatgactgcggtgcccaggaccggccccggttgcctggggtcgccgccggctcaggctctgtcgagctcactagccggggttcaaggcgccccgaagcgactgggcgtatcgaagccgtcgtggatcgttcgcactgagtcaaacgtgaggagggagagagcaaaacgacctgatcctccttgcaccatctgcaaaggcacagggagaatagactgccgcaactgctttggtcgnagaaagacaaaccatgccgatgtggccatgctttcgaaacgcgaatggctacatggtgtcgaatttnngtgtgtagtgaactggattactgcctccngtgccatggactggtgagtatccagaacccatgggctccacttcactgtcaaagaaatgagtgggatggccttaatgctacaatccacccattggaccagctgcgggaactcgaaacccttcgaagttgttttcccctgtttttcaaatcaaaaatttatgctacc

SEQ ID NO: 45523 - protein, 117 aa, Zea mays
  misc_feature: Ceres CLONE 1449563-F
  misc_feature (103)..(103): Xaa is any aa, unknown, or other
  misc_feature (113)..(113): Xaa is any aa, unknown, or other
MPMTAVPRTGPGCLGSPPAQALSSSLAGVQGAPKRLGVSKPSWIVRTESNVRRERAKRPDPPCTICKGTGRIDCRNCFGRRKTNHADVAMLSKREWLHGVEFXCVVNWITASXAMDW

SEQ ID NO: 45524 - DNA, 684 bp, Zea mays
  misc_feature: Ceres CLONE 1449567-F
  misc_feature: Encodes the peptide sequence at SEQ ID NO. 45525
  misc_feature (272)..(272): n is a, c, t, g, unknown, or other
  misc_feature (312)..(312): n is a, c, t, g, unknown, or other
  misc_feature (352)..(352): n is a, c, t, g, unknown, or other
  misc_feature (366)..(366): n is a, c, t, g, unknown, or other
  misc_feature (385)..(385): n is a, c, t, g, unknown, or other
  misc_feature (395)..(395): n is a, c, t, g, unknown, or other
ggcggccgctctagaactagtggatcccccgggctgcaggaattcgcacgagaccattacctagaacatcctaatcgaaaatactcagtgctcaccgaactccatctatctcttccccacgaacgcttgcggcggcggcggaattaggaggcgatggggcactccaacgtctggaactcgcaccccaagaactacgggcccggatcccgcgtctgccgtgtctgtgcgaaccctcatggactgatcaggaagtacgggctgatgtgctgcangcagtgcttccgcagcaatgccaaggacattggcttcatncagtaccgctgaaatcaggtgggaatggacccatgtgtanaagcgaagctgtantttttattcccagtaattnaaatgttttngtcaaaagtctgctagtaaagactgctacgtttatgatgaagaacttagccatgtttgggcaaattgatcatgagattaccttggtttgacctaaacctatcctgggtcccaacctcccctggaaaaaaagaatcctggaagggagggggggttaaagccccaaaattaaaccttattttggcgggggcaaaaaaccctttcccaaaaaaaaaaaaaaaaaaaattttttctctccccccccccgggggggggggcccggccacccactccccccaaggggggcaataa

SEQ ID NO: 45525 - protein, 56 aa, Zea mays
  misc_feature: Ceres CLONE 1449567-F
  misc_feature (3)..(56): Pfam Name: Ribosomal_S14 Pfam Description: Ribosomal protein S14p/S29e
  misc_feature (40)..(40): Xaa is any aa, unknown, or other
  misc_feature (53)..(53): Xaa is any aa, unknown, or other
MGHSNVWNSHPKNYGPGSRVCRVCANPHGLIRKYGLMCCXQCFRSNAKDIGFXQYR

SEQ ID NO: 45526 - DNA, 664 bp, Zea mays
  misc_feature: Ceres CLONE 1449575-F
  misc_feature: Encodes the peptide sequence at SEQ ID NO. 45527
  misc_feature (595)..(595): n is a, c, t, g, unknown, or other
  misc_feature (613)..(613): n is a, c, t, g, unknown, or other
tggagctccccgcggtggcggccgctctagaactagtggatcccccgggctgcaggaattcgcacgagaccattacctagaacatcctaatcgaaaaaacaggtcagccctcaccccccgtcgtcccaggcatggccccaacgagagcgctgcccgccctctggttgtccatggccgccgccgccagctatgtcgtcggagaaaagtactgcaggttgtgctatctgaagggcagttccatggtccccactatccaagcccagggcgacgtcgggctgctggaccgccgctgccttgccggctacgacttctcccacggcgacgtcgttgttttcaggttgtcgacggatcatgggatgaagatggtccagaggctgatcgcgctgccgggggattggatccagatcccggagaagcgggacatccggcaggtccccagcggccactgttgggtggaaggggacaatgccggcaacagctgggactcgagacactatggccccgttcctctggacctgatggaagggaagatcacacacataatctggccaccccatagagtgcgtcgggtggacaggatggtaccggaaggcangattatgcctctgtcagncactccaagggagaaagcaacatagggtctcaatcgaccgcatcgaaggcg

SEQ ID NO: 45527 - protein, 168 aa, Zea mays
  misc_feature: Ceres CLONE 1449575-F
  misc_feature (31)..(104): Pfam Name: Peptidase_S24 Pfam Description: Peptidase S24-like
  misc_feature: SWISSPROT Homolog: EC 3.4.21.89 Signal peptidase I
  misc_feature (155)..(155): Xaa is any aa, unknown, or other
  misc_feature (161)..(161): Xaa is any aa, unknown, or other
MAPTRALPALWLSMAAAASYVVGEKYCRLCYLKGSSMVPTIQAQGDVGLLDRRCLAGYDFSHGDVVVFRLSTDHGMKMVQRLIALPGDWIQIPEKRDIRQVPSGHCWVEGDNAGNSWDSRHYGPVPLDLMEGKITHIIWPPHRVRRVDRMVPEGXIMPLSXTPREKAT

SEQ ID NO: 45528 - DNA, 712 bp, Zea mays
  misc_feature: Ceres CLONE 1449576-F
  misc_feature (320)..(320): n is a, c, t, g, unknown, or other
  misc_feature (324)..(324): n is a, c, t, g, unknown, or other
  misc_feature (325)..(325): n is a, c, t, g, unknown, or other
  misc_feature (330)..(330): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (369)..(369): n is a, c, t, g, unknown, or other
  misc_feature (379)..(379): n is a, c, t, g, unknown, or other
  misc_feature (415)..(415): n is a, c, t, g, unknown, or other
  misc_feature (425)..(425): n is a, c, t, g, unknown, or other
  misc_feature (426)..(426): n is a, c, t, g, unknown, or other
  misc_feature (436)..(436): n is a, c, t, g, unknown, or other
  misc_feature (438)..(438): n is a, c, t, g, unknown, or other
  misc_feature (439)..(439): n is a, c, t, g, unknown, or other
aagctggagctccccgcggtggcggccgctctagaactagtggatcccccgggctgcaggaattcgcacgagaccattacctagaacatcctaatcgaaaaatcccccgcctctgccaccgccggtcaagtccctgatggacacgccgccgccctctctcccgccgtccaccctcctctggccggacctcctcgcgggcgcggcgtcctccacctgccgcctcgtcgccgcgcattcccgtcacttcctggccctatcctctctcctccttctcccgctcgccctcctcctactcgccctcccctgcccgttcttctctngctnncgctncctcgcgnnnctccctccgtacatctccgggtcccgcangatccgtcanggtacccactacccatccccgctgcgctgctcgccnttttgcgcgnngctctttacntnnggcgctttcgcgccgccggggccaggcgcacgcagggttcctcggtccgccccgtcgggtcctggcctcggtccgttcgtggcaagctaattcctcccgcttattctgaccccatccgggggctccccgttgggatttttttcggttccccccgttccccggggggttttggcgcccaaatgcccgcccccgggtttccctttttttccccgttttgggccccccctgggcccccttttgtgggtaaaatgccccaagttttccccccccccc

SEQ ID NO: 45529 - DNA, 694 bp, Zea mays
  misc_feature: Ceres CLONE 1449586-F
  misc_feature: Encodes the peptide sequence at SEQ ID NO. 45530
ctggagctccccgcggtggcggccgctctagaactagtggatcccccgggctgcaggaattcgcacgagaccattacctagaacatcctaatcgaaaacacaccacacctcacgtctcctcactacccgcgctctcaggcagcgcacctcgctcctcctcccccacagcgctttccattttcgtctatctcccgagaaccctcctgcgcctcccaaagctctcttgttcgttgctccccccccccccccgtgctggttaatcatccccttcgatttcgatcacatacatataatctctctcagctatcgcggccgcgcgcctgatcgacgtacgaccggtctggtacgtacgtgtgctcgcccgccatggctcgcggcgacggcgagctggagctgtccgtgggggtccgcggcaccggcggcgcggcggcggcggcggcggaccacttggcgccgatcagcctcggcaggctcatcctcgccggcatggtcgccggcggcgtgcagtacggctgggcgctggagctctccctcctcacgccctacgtgcagactctggggcctctcacatgcccctcacttcatttcatgtggctatgcgggccctatggcctggcttaatgggccattggttggttggcttcctcgtccgaacatcggaagctggctcttgggggaaccacaaaggaaaccc

SEQ ID NO: 45530 - protein, 84 aa, Zea mays
  misc_feature: Ceres CLONE 1449586-F
MARGDGELELSVGVRGTGGAAAAAADHLAPISLGRLILAGMVAGGVQYGWALELSLLTPYVQTLGPLTCPSLHFMWLCGPYGLA

SEQ ID NO: 45531 - DNA, 680 bp, Zea mays
  misc_feature: Ceres CLONE 1449591-F
  misc_feature: Encodes the peptide sequence at SEQ ID NO. 45532
ctggagctccccgcggtggcggccgctctagaactagtggatcccccgggctgcaggaattcgcacgagaccattacctagaacatcctaatcgaaaaacgctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatttccaagtggacggatggcaagcaggagaagccaactgtccgcacagaatcggatgactaagggctggcgccatggcgacatagtccttcctacagatgatttgaagcgtcgttgcaagtttctgggacttgttatttagttggcttgatttgtaatcaatgctgaagaataaatactttttgcgacaatggtctttttacaatgtcgtgttgttttcgttgctaattgcacttgccctaccctaatcaagcatgtgaactaatggaatgcttcagttttgtgcaaaaaaaaaaaaaaaaagcttatcgataccgtcgacctcgagggggggcccggta

SEQ ID NO: 45532 - protein, 70 aa, Zea mays; identical to SEQ ID NO: 4918
  misc_feature: Ceres CLONE 1449591-F
  misc_feature (9)..(57): Pfam Name: ATP-synt_Eps Pfam Description: Mitochondrial ATP synthase epsilon chain

SEQ ID NO: 45533 - DNA, 652 bp, Zea mays
  misc_feature: Ceres CLONE 1449598-F
  misc_feature: Encodes the peptide sequence at SEQ ID NO. 45534
ccgctctagaactagtggatcccccgggctgcaggaattcgcacgagaccattacctagaacatcctaatcgaaaaacttacctggacggggtcgactggctatcaagaaggcccgtggcctagatcaatggcccacattgcacttggtggatgcgttggcttaccatctccccaagtgggagagtggacgtcataatttgtggtagatggggtacgcgacgcagttcacgtctcggtttgctgcttcttgatcaggtcagatctcggtgtgctgcttcttgatccagatcagggtttctgatccatatagtctgtactttgttacaaaaatcatgtaattttaaaacttttttccatatcttgggttcctgatttatgaagccaacaactcccccccccctagtaaaaaaataaaaaagcttatccataccgtccaacctccgagggggggggcccgggtacccaattcgccctatatggaagccgtattacccccctctccctggcccgtcgcttttacaacgtttttgacctggaaaaaccctgggggttaccccaactttatcccctttgaaaaacaatcccccttttccccgctgggcgaaatacgaaagaagcccccaccgaatccccctttccccaaaaattgcg

SEQ ID NO: 45534 - protein, 43 aa, Zea mays
  misc_feature: Ceres CLONE 1449598-F
MRWLTISPSGRVDVIICGRWGTRRSSRLGLLLLDQVRSRCAAS

SEQ ID NO: 45535 - DNA, 565 bp, Zea mays
  misc_feature: Ceres CLONE 1449599-F
  misc_feature (1)..(1): n is a, c, t, g, unknown, or other
  misc_feature (176)..(176): n is a, c, t, g, unknown, or other
  misc_feature (177)..(177): n is a, c, t, g, unknown, or other
  misc_feature (203)..(203): n is a, c, t, g, unknown, or other
  misc_feature (204)..(204): n is a, c, t, g, unknown, or other
  misc_feature (333)..(333): n is a, c, t, g, unknown, or other
  misc_feature (335)..(335): n is a, c, t, g, unknown, or other
  misc_feature (397)..(397): n is a, c, t, g, unknown, or other
  misc_feature (402)..(402): n is a, c, t, g, unknown, or other
  misc_feature (404)..(404): n is a, c, t, g, unknown, or other
  misc_feature (458)..(458): n is a, c, t, g, unknown, or other
  misc_feature (464)..(464): n is a, c, t, g, unknown, or other
  misc_feature (484)..(484): n is a, c, t, g, unknown, or other
  misc_feature (491)..(491): n is a, c, t, g, unknown, or other
  misc_feature (528)..(528): n is a, c, t, g, unknown, or other
  misc_feature (531)..(531): n is a, c, t, g, unknown, or other
  misc_feature (542)..(542): n is a, c, t, g, unknown, or other
  misc_feature (545)..(545): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (552)..(552): n is a, c, t, g, unknown, or other
  misc_feature (562)..(562): n is a, c, t, g, unknown, or other
  misc_feature (563)..(563): n is a, c, t, g, unknown, or other
ngtggatcccccgggctgcaggaattcgcacgagaccattacctagaacatcctaatcgaaaagtggatggattgtctattacaacgaccccacgtcgtcccccataggcagagccaaggcgacgaggttggtacctcccccctcccgctccccagcctcaccgtcgccagagccnngtcctgggccgaaagaggctcacatnngggcatgaaggggattgggccgggggccaaaaaccggggggggggaaaaaagccctttgggcccctttccccttgggggcgctttcccctttttttccccccccccccctttttttttccctttttttncncgcggggggcggggtgcccaaaaaaaacaacaaacaatattttgtttgttttgggtgggggngaggntnaaaaaaaaaaaaaaaaaaagacacccccccccccccttttttttttttcttctnaaaaanaaaaaagaagaggggagtgntgtttcncccccccccccctttttttgtgttttaataagaaagnatntatgctcatcnctnccnnnantattcaattnnaa

SEQ ID NO: 45536 - DNA, 662 bp, Zea mays
  misc_feature: Ceres CLONE 1449613-F
  misc_feature: Encodes the peptide sequence at SEQ ID NO. 45537
ggagctccccgcggtggcggccgctctagaactagtggatcccccgggctgcaggaattcgcacgagaccattacctagaacatcctaatcgaaaagacaaggcaatctgaaaatgctctccgcaatctccacctccgcaatctccacctccctactagtagtactcttcggtgcagtccgcatccccacatctgaccgactctcaaagttcacagctccaatcctggtgcaagcgcacagtagcggagcaagatgcggggaggagaccggccatcggcgtcgctccagctcctctcgctgggcctcgtgctcctctacttcttcacctcaggcagcaccgttggtctcgtggagggacagaagacgtggtgcatcgcgaagccgtcggcgtcgaacgagatcctggcgcagaacctggactacgcgtgctcccaggtgagctgcgccgtgatccagaagggcgggccgtgctactacccggacagccccgtgtcccgcgccgccgtcgccatgaacctctactacgcctacagcggcaggcacccctggaactgctacttcaacaactccgcgctcgtcgtgaagtccgacccaagctatggctcctgcacatactactgaggaagagtgtgaggaggagtggagagacgaggagaggaga

SEQ ID NO: 45537 - protein, 122 aa, Zea mays
  misc_feature: Ceres CLONE 1449613-F
  misc_feature (38)..(121): Pfam Name: X8 Pfam Description: X8 domain
  misc_feature: SWISSPROT Homolog: EC 3.2.1.39 Glucan endo-1,3-beta-D-glucosidase
MRGGDRPSASLQLLSLGLVLLYFFTSGSTVGLVEGQKTWCIAKPSASNEILAQNLDYACSQVSCAVIQKGGPCYYPDSPVSRAAVAMNLYYAYSGRHPWNCYFNNSALVVKSDPSYGSCTYY

SEQ ID NO: 45538 - DNA, 687 bp, Zea mays
  misc_feature: Ceres CLONE 1449621-F
  misc_feature (312)..(312): n is a, c, t, g, unknown, or other
  misc_feature (345)..(345): n is a, c, t, g, unknown, or other
  misc_feature (348)..(348): n is a, c, t, g, unknown, or other
  misc_feature (453)..(453): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaaaataatagttcggtgcctttttctagcggggaggaggcaggcggcgcgatctggcaccggccatcacgttccctcccgccgcttccccctccctgccctcccgttccccagatccgaagccattaaaactagcggatctcacctcggggcgcgtccgcggcatctggggcagcgagtggtagagccagcagccatgagatggtatgcatncgtagcctcctgagggcgctggtcctgagtgcngcngcgtctgcgggcaggcgccgggggcccaggatcctgtgtgggcacgaaggcggatgtacccgttgactctcgggaccggacacggctgccccggattccgggcantcccggaaggaagaacctggacccctttgactgggccctttgttgcccccccccgaaagcggggcaggttgaacccccatgcccctcccnggggggccttcccccttggggccaaaggggggtttccccccgggggaaagggaaaggaaaaatattgccccgggggtttagaaaggctctcaaaaatagacccttgggccctttttatttttggggggcaaaaaggggttttat

SEQ ID NO: 45539 - DNA, 626 bp, Zea mays
  misc_feature: Ceres CLONE 1449625-F
  misc_feature: Encodes the peptide sequence at SEQ ID NO. 45540
  misc_feature (386)..(386): n is a, c, t, g, unknown, or other
tggcggccgctctagaactagtggatcccccgggctgcaggaattcgcacgagaccattacctagaacatcctaatcgaaaactacgcatccgcccatcaattagctgacgacaaggaatcccaccccactcccgagagcagcgaggaaggcgtgtgctttctctagtctgtgcagtgcaagcgccggtgcccgccgccgccggcgcggccatgtcctccgcctcgggcctcggcgggaaggaggtcccctccgccttctccgtggacctcgcggccgccgcgcgccggctgctgctcttcctccgcgcggcgccggccggggtgggcccgcggtccgttcggaggtacgaggagctgtggatgccgctcgcggcggaaaaagcangcgtaggaggaaaaggcgccaatgctttgttgccgcgcccgaacgtggactcgtctggttcgccactgcttccacatgaaagctactccccgtactgcacctccaagtttggaaccctctatcaacggtccataaatttttgaattggaaaagaaaattttgcctaggatctttgccaaaatgtctggcctaaccatttcccctccagacctttgaccctgaacccaaaggaaatggagg

SEQ ID NO: 45540 - protein, 105 aa, Zea mays
  misc_feature: Ceres CLONE 1449625-F
  misc_feature (59)..(59): Xaa is any aa, unknown, or other
MSSASGLGGKEVPSAFSVDLAAAARRLLLFLRAAPAGVGPRSVRRYEELWMPLAAEKAXVGGKGANALLPRPNVDSSGSPLLPHESYSPYCTSKFGTLYQRSINF

SEQ ID NO: 45541 - DNA, 649 bp, Zea mays
  misc_feature: Ceres CLONE 1449627-F
  misc_feature: Encodes the peptide sequence at SEQ ID NO. 45542
cctgcactagaggatcccccgggctgcagggtccctcacgagaccattacctagaacatcctaatcgaaaacctagtgcccgcgcgcctgccaggtatcgaacacccaaagatggcaatggcaaccttcacatcatccccagttctctgcagcttcaggaccatcgaacagaagaaggcccctctgctgaacaacagcacaaaacggccgcttcacttgggcttcccaaggagcgtgccgacgtcgccgagcttgagagagaggctagacctgcgcgtcgccgctgtctacaaggtgaagctcctcggccccgaagggcaggagagcgtgctcgacgtgccagaggacagctacatcctggacgctgccgaggaggccggtctccacctgccctactcctgccgcgccggcgcgtgctccacgtgcgccggcaagctcctggagggctccgtcgaccaggcagaccagtcgttcctcgacgaggcgcaggtcggtgccgggtacgcgctcacctgcgtcgcgtacccgacgtccgactgcgtcatccagacgcacagggaggaaacttgtactagaccgggctggtccccgtgcatggatcaaccttgcacgtccgtcacattcaactgtgagtttttgacgctgtcca

SEQ ID NO: 45542 - protein, 177 aa, Zea mays
  misc_feature: Ceres CLONE 1449627-F
  misc_feature (63)..(139): Pfam Name: Fer2 Pfam Description: 2Fe-2S iron-sulfur cluster binding domain
  misc_feature: SWISSPROT Homolog: EC 1.18.1.3 Ferredoxin--NAD(+) reductase
MATFTSSPVLCSFRTIEQKKAPLLNNSTKRPLHLGFPRSVPTSPSLRERLDLRVAAVYKVKLLGPEGQESVLDVPEDSYILDAAEEAGLHLPYSCRAGACSTCAGKLLEGSVDQADQSFLDEAQVGAGYALTCVAYPTSDCVIQTHREETCTRPGWSPCMDQPCTSVTFNCEFLTLS

SEQ ID NO: 45543 - DNA, 632 bp, Zea mays
  misc_feature: Ceres CLONE 1449641-F
  misc_feature: Encodes the peptide sequence at SEQ ID NO. 45544
tggagctccccgcggtggcggccgctctagaactagtggatcccccgggctgcaggaattcgcacgagaccattacctagaacatcctaatcgaaaagcgatgtttctctcgcgagaaaatcttcccttcggctgccaaattcttagagctttttctttggcttacggatcggcggtggtgggtggctgcagccagtgatctcgtacacgcagaagacgtggaagacggcgtctggcgagccgatgcacgccgagagcgggtactggcggccccgccctgacggctccgtcgacgtggtcatcgctcagagcactggcctcgccgaggtccagaagggttcatttgatgctgaaaagaaaacagtgacactccaaagcgaactcgtagggaatgcatcaaaggtgaagcagatcacgagaacttttcaggtggcagatggggagctctcgtacgtcgttcagatggcaacgatcacaactagcctacagccacatctcaaggcccttcttaggaggatttgaagttgaccggcaaaatctcctacaacgacgtcgctgcggctaaccacaaccgagggacacctgtaatacagagcatacttctggtgattactacgtagttattagtgaat

SEQ ID NO: 45544 - protein, 92 aa, Zea mays
  misc_feature: Ceres CLONE 1449641-F
  misc_feature (1)..(92): Pfam Name: DUF1794 Pfam Description: Domain of unknown function (DUF1794)
MHAESGYWRPRPDGSVDVVIAQSTGLAEVQKGSFDAEKKTVTLQSELVGNASKVKQITRTFQVADGELSYVVQMATITTSLQPHLKALLRRI

SEQ ID NO: 45545 - DNA, 747 bp, Zea mays
  misc_feature: Ceres CLONE 1449669-F
  misc_feature: Encodes the peptide sequence at SEQ ID NO. 45546
  misc_feature (521)..(521): n is a, c, t, g, unknown, or other
aaagctggagctccccgcggtggcggccgctctagaactagtggatcccccgggctgcaggaattcgcacgagaccattacctagaacatcctaatcgaaaaaagagggctttacactgaaccccagcgacccaggcgtcagcggcgtgatgcagttcctccgaggcagcggcggcgggggcgggggcggtgggttcccgggggtggcgtgggaggtgttgcggcggcacttctctaagaagcggtccgtggacgtgaggcggatcaaccccaaggtgcccaaggaggaggccgtcgccatttccggccgactcctccagatcctctccgaccatgggcccctcaccgtcggcaacacctggaaccacgccaaggatgttggcatcgctggtctgaaacagcagacgcacatgatgatcctgctgaaatggatgacggggaagaaatgtcgtgaagctgacctgcgtgcacgtgggcaacgcgaagaagttcctctactccccgtccactgaaagcagcancagcgccggcgcatcaccgtcatcaaatttggcctcgcaatgacggtcagtcccccgtaacccttggggggggttctggaatttgctttgggaatccaaggaggtttcccttgggcctggggaacccctgtttaaccctggggaccaactttgaaaaacctttttgtttttgggccgggattttccgcaaccccccaaaacaaaatatgttccccgctccaacccc

SEQ ID NO: 45546 - protein, 120 aa, Zea mays
  misc_feature: Ceres CLONE 1449669-F
MQFLRGSGGGGGGGGFPGVAWEVLRRHFSKKRSVDVRRINPKVPKEEAVAISGRLLQILSDHGPLTVGNTWNHAKDVGIAGLKQQTHMMILLKWMTGKKCREADLRARGQREEVPLLPVH

SEQ ID NO: 45547 - DNA, 636 bp, Zea mays
  misc_feature: Ceres CLONE 1449673-F
  misc_feature: Encodes the peptide sequence at SEQ ID NO. 45548
  misc_feature (442)..(442): n is a, c, t, g, unknown, or other
  misc_feature (469)..(469): n is a, c, t, g, unknown, or other
  misc_feature (473)..(473): n is a, c, t, g, unknown, or other
  misc_feature (474)..(474): n is a, c, t, g, unknown, or other
  misc_feature (503)..(503): n is a, c, t, g, unknown, or other
  misc_feature (527)..(527): n is a, c, t, g, unknown, or other
  misc_feature (533)..(533): n is a, c, t, g, unknown, or other
  misc_feature (538)..(538): n is a, c, t, g, unknown, or other
  misc_feature (539)..(539): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (630)..(630): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
ggagctccccgcggtggcggccgctctagaatagtggatcccccgggctgcaggaattcgcgcgagaccattacctagaacatcctaatcgaaaaatttcgtcatgttcttgcattgtttacgttatatatatacggagtagcgcgcggcagtatataagcattagctggtgggatcgatcgctgcagagttgttgattgcagggaaaccgccaattggcaaggatgatgaagcttgcgatcgccttcgtcgtgctgctctcttctttcctcgccgactcgtccaccgcggaggagttcgatttcttctaccttgtccaacagtggccgggctcgttctgcgacacgcggcagggttgctgcttcccggacggcgcgggcaagccggcggcggcgttcggcatccacgggctgtggcccaactacgcaaagtgccgcggccngccaccaccgcgagggcggcggcctcngccnncgcgcggtggctcgggccgccccgggcgnaaaaaagcccttttccctttttgncccccnccccnntttgggggggggggcccggggnnnnnnnnnnnnnnnnnnnnnnnnnnnnnnnnnnnnnnnnnnnnnnnnnnnnnnnnnnnnnnnnnnnggngnnnng

SEQ ID NO: 45548 - protein, 112 aa, Zea mays
  misc_feature: Ceres CLONE 1449673-F
  misc_feature: SWISSPROT Homolog: EC 3.1.27.1 Ribonuclease T(2)
  misc_feature (73)..(73): Xaa is any aa, unknown, or other
  misc_feature (82)..(82): Xaa is any aa, unknown, or other
  misc_feature (84)..(84): Xaa is any aa, unknown, or other
  misc_feature (101)..(101): Xaa is any aa, unknown, or other
  misc_feature (105)..(105): Xaa is any aa, unknown, or other
MMKLAIAFVVLLSSFLADSSTAEEFDFFYLVQQWPGSFCDTRQGCCFPDGAGKPAAAFGIHGLWPNYAKCRGXPPPRGRRPXPXRGGSGRPGRKKALFPFXPPPXFGGGGPG

SEQ ID NO: 45549 - DNA, 708 bp, Zea mays
  misc_feature: Ceres CLONE 1449678-F
aaagctggagctccccgcggtggcggccgctctataactagtggatcccccgggctgcaggaattcgcacgagaccattacctagaacatcctaatcgaaaaatatacgcatcttcctcccgtcctctctctctctctctctctcccggggcgacggcttccacggtccgcgacggcggacacgctgaaccccacccgtttgcccacggccaagcaggtcagccctccgtgtggagcgaaaacatctctaattcccagggattttaactccgagcacatcaagatcaagcaaggacccatgcgcatccaaaaagaaactcctaagaaaccctcccaagactgaatgctaccttctaccatcagcagcctttgaagttctaaagtgtttattttatatatgagcaagtgattaaggactcacgtgttcagcacgtagaagttgttgagcagaagctcattgaacgagaagaacaggtggtccaggaggagccccacaataaagagtacgagctcatctaagtggcgtctcccagtcaactttatggcaccaaggaataatatttagtttgctttattgttatcatttatttttgtaaggctttcgctatgtaataatgatacttgtgacatttatctctatacactttgtcattatatgtgatgttcttctttggcacaacaacaaaaaaaaaaagcttatcgataccg

SEQ ID NO: 45550 - DNA, 633 bp, Zea mays
  misc_feature: Ceres CLONE 1449681-F
  misc_feature: Encodes the peptide sequence at SEQ ID NO. 45551
tggcggccgctctagaactagtggatcccccgggctgcaggaattcgcacgagaccattacctagaacatcctaatcgaaaaatctcctcccactctcttccccccactcctaccaaaccctattcaatatccatttctccatccatggcgtggcgcggccccgccacccgggccgtcctcgccgccgtccgccgcccggcagcggccgcgcgcctccacgccccgcgccgccgcgtcccgcccgccttcgccaccacctcctccccgctcccgtccgcgcggcctctggcggcgttgatggggtccccggtgacggtggccgcggtgatggcgcgcctcacggcgcatcccggcgccagcgcgcgcgcgtgctgcgagctttcccagggaaacggaaaagatgggtgatgcaagagaggccatcgtagagcctgccaaaggtacttgaatctgttgtgtagaccccatcctttcgaaaggataaatgatgtatcttttggggaataaaagctattatggcatttcttccacagcaaagttcgaagaaattacccaacaatagctagtttcctcgttaggatttcgagaagccttaataattttaacgttacatggcatggttttggtgtgta

SEQ ID NO: 45551 - protein, 87 aa, Zea mays
  misc_feature: Ceres CLONE 1449681-F
MAWRGPATRAVLAAVRRPAAAARLHAPRRRVPPAFATTSSPLPSARPLAALMGSPVTVAAVMARLTAHPGASARACCELSQGNGKDG

SEQ ID NO: 45552 - DNA, 610 bp, Zea mays
  misc_feature: Ceres CLONE 1449682-F
  misc_feature: Encodes the peptide sequence at SEQ ID NO. 45553
acccgcggtggcggccgctctagaactagtggatcccccgggctgcaggaattcgcacgagaccattacctagaacatcctaatcgaaaaagtctctcgcccctctctcccaccccgcagccgccgcgcaggtagccctagcacccgcgacgagcaggacctgcccagttgctctttgagtagttcccccaactgtcaccatgcagaacgaggagggtaagactgtggacctctatgtccctaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatctttgttgggttccttctgagtttgatgtgtggtgttcgtttaattccct

SEQ ID NO: 45553 - protein, 81 aa, Zea mays; identical to SEQ ID NO: 6959
  misc_feature: Ceres CLONE 1449682-F
  misc_feature (1)..(81): Pfam Name: Ribosomal_S21e Pfam Description: Ribosomal protein S21e

SEQ ID NO: 45554 - DNA, 581 bp, Zea mays
  misc_feature: Ceres CLONE 1449687-F
  misc_feature (202)..(202): n is a, c, t, g, unknown, or other
  misc_feature (203)..(203): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (367)..(367): n is a, c, t, g, unknown, or other
  misc_feature (368)..(368): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (453)..(453): n is a, c, t, g, unknown, or other
  misc_feature (455)..(455): n is a, c, t, g, unknown, or other
  misc_feature (456)..(456): n is a, c, t, g, unknown, or other
  misc_feature (461)..(461): n is a, c, t, g, unknown, or other
  misc_feature (462)..(462): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (475)..(475): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (485)..(485): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (523)..(523): n is a, c, t, g, unknown, or other
  misc_feature (524)..(524): n is a, c, t, g, unknown, or other
  misc_feature (531)..(531): n is a, c, t, g, unknown, or other
  misc_feature (532)..(532): n is a, c, t, g, unknown, or other
  misc_feature (536)..(536): n is a, c, t, g, unknown, or other
  misc_feature (540)..(540): n is a, c, t, g, unknown, or other
  misc_feature (541)..(541): n is a, c, t, g, unknown, or other
  misc_feature (545)..(545): n is a, c, t, g, unknown, or other
  misc_feature (552)..(552): n is a, c, t, g, unknown, or other
  misc_feature (561)..(561): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (578)..(578): n is a, c, t, g, unknown, or other
cgcggtggcggccgctctagtctagtggatcccccgggctgcaggaattcgcacgagaccattacctagaacatcctaatcgaaaaaaccctcgcctccgcgtggcactccagggctccagaccccgccgccgccctaagccagacgctgaggcttgtggtctcttcgccggagacgagcaccaaccaggatgcaatgtttnnggtccggaatggtctgccgagccggaagccgtggagcggcggcgaggctcctgggagcttggccgcggctggtccggggtgcgaacgccagccccatccccggnnngggggggggggnnnnnnnnnnnnnnnnnnnnnnnnnnnnnnnnnnnnnnnnnnnnggnncccgggggggnnnnnngnnnnnnnnnnnnnnnnnnnnnnnnnnnnnnnnnnnnnnggnnnnnnnnnnnnnnnnnnnnnnnnnngngnnggggnngnnngnnnnnggngnnnnnnngngnnnnnngggggggggggggggggnnngggnnnggggnnggggggnngggngggnngggnggggggnggggggggngggggnnnngngggggnggg

SEQ ID NO: 45555 - DNA, 585 bp, Zea mays
  misc_feature: Ceres CLONE 1449689-F
  misc_feature: Encodes the peptide sequence at SEQ ID NO. 45556
  misc_feature (235)..(235): n is a, c, t, g, unknown, or other
tggagctccccgcggtggcggccgctctataactagtggatcccccgggctgcaggaattcgcacgagaccattacctagaacatcctaatcgaaaacaattttcacaaatgcgtcctgttgcaatggcgccttcagtaggtcctcgcatgcccatgtttccacctggtgtccctggagttggtcagcagctgttctatggtcagccaccaccagccttcacaaccctcaggctnggaatttgctttttccaagccaaaccttcttagaaggcccggggaaataaagccccccgggggggggcccccaagggcggcaaaaaatttttttttaaaagaccccccattggggtccaaaaaaagagagaaaaaaaaaaaaaaaaaaacccttctctggggaaaaaaaacccgggggggggggaaaggaaacccccccccccctccaggggggggggggggaaaaaaaaggtgtttctcaaaagagggggggggggtttttttcctcctttcaagggagaaaaaccctcctccctcctccccccctggtggggggggggcccccccccccccccaaaaaaaaaaaaaaa

SEQ ID NO: 45556 - protein, 88 aa, Zea mays
  misc_feature: Ceres CLONE 1449689-F
GAPRGGGRSITSGSPGLQEFARDHYLEHPNRKQFSQMRPVAMAPSVGPRMPMFPPGVPGVGQQLFYGQPPPAFTTLRLGICFFQAKPS

SEQ ID NO: 45557 - DNA, 603 bp, Zea mays
  misc_feature: Ceres CLONE 1449702-F
  misc_feature: Encodes the peptide sequence at SEQ ID NO. 45558
  misc_feature (345)..(345): n is a, c, t, g, unknown, or other
  misc_feature (371)..(371): n is a, c, t, g, unknown, or other
  misc_feature (447)..(447): n is a, c, t, g, unknown, or other
  misc_feature (457)..(457): n is a, c, t, g, unknown, or other
  misc_feature (603)..(603): n is a, c, t, g, unknown, or other
ggcggccgctctagaactagtggatcccccgggctgcaggaattcgcacgagaccattacctagaacatcctaatcgaaaaatcgtgcgccttcgcttcagccgtgagcccgcaaccgacccgccgcaaaagaccaaaaccctagccgtcacagcgccgcccccgaaccataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacaacgtcgacgtcgaagccgttttccgggaggttncggtatctcccccggcgttaccgtangcggcgaggctcacccgccccgtttccgcgatgaacactgcgcgacgtcccctgccgccatggccacgagtactgncagagagacngagcgagagcggcagccccgcacaggacaatgagctcgtggcgtcaagtggcggcgcgttcgcgctcgctgtcgtctgcaacaggcactattccccgtggaggtccccatcaacattgggcttaaagccggccggttcccaggggn

SEQ ID NO: 45558 - protein, 136 aa, Zea mays
  misc_feature: Ceres CLONE 1449702-F
  misc_feature (51)..(51): Xaa is any aa, unknown, or other
  misc_feature (59)..(59): Xaa is any aa, unknown, or other
  misc_feature (85)..(85): Xaa is any aa, unknown, or other
  misc_feature (88)..(88): Xaa is any aa, unknown, or other
MAFSGRIQELVRKYGKVAICVHLSVSCASIAGLYVAINNNVDVEAVFREVXVSPPALPXAARLTRPVSAMNTARRPLPPWPRVLXERXSESGSPAQDNELVASSGGAFALAVVCNRHYSPWRSPSTLGLKPAGSQG

SEQ ID NO: 45559 - DNA, 639 bp, Zea mays
  misc_feature: Ceres CLONE 1449704-F
  misc_feature: Encodes the peptide sequence at SEQ ID NO. 45560
  misc_feature (395)..(395): n is a, c, t, g, unknown, or other
  misc_feature (400)..(400): n is a, c, t, g, unknown, or other
  misc_feature (411)..(411): n is a, c, t, g, unknown, or other
  misc_feature (415)..(415): n is a, c, t, g, unknown, or other
  misc_feature (423)..(423): n is a, c, t, g, unknown, or other
tggagctccccgcggtggcggccgctctattctagtggatcccccgggctgcaggaattcgcacgagaccattacctagaacatcctaatcgaaaaatcacagaccagatccctgcgggtgcggcggccatggccgagaacttccaactccagggccggcacggcaagtcccgcgtccgcgtctcccgcgtctggcgccgcccggccgcggcggggggcgacgtcatcgttgagtggaacgtcgccgtcagtatcgtctccgactgcctcccctcctacacctccagcgacaactccgccatcgtcgccacagattccatcaagaacaccgtgtatgtcaaggcgaaagagtgcacggaagtggtgtccatggaggaattcgccgtgattcttgnaaggnatttcacctcnctgnacccccangtttcagaggccacggtgactatcgtggagcgcccatgggagcgtgtgactgtccacggaaagcctcattcgcatgggttcaaagttgggggtgagaaccacagcacagaggtcattgttaaaaaatctggaagcccgcccaataattcctggaattcaagatacctccctgctaaaaaaaacttcagctgggtttgaaaggtttgtgaacgaatc

SEQ ID NO: 45560 - protein, 163 aa, Zea mays
  misc_feature: Ceres CLONE 1449704-F
  misc_feature (8)..(139): Pfam Name: Uricase Pfam Description: Uricase
  misc_feature: SWISSPROT Homolog: EC 1.7.3.3 Urate oxidase
  misc_feature (89)..(89): Xaa is any aa, unknown, or other
  misc_feature (91)..(91): Xaa is any aa, unknown, or other
  misc_feature (96)..(96): Xaa is any aa, unknown, or other
  misc_feature (98)..(98): Xaa is any aa, unknown, or other
MAENFQLQGRHGKSRVRVSRVWRRPAAAGGDVIVEWNVAVSIVSDCLPSYTSSDNSAIVATDSIKNTVYVKAKECTEVVSMEEFAVILXRXFTSLXPXVSEATVTIVERPWERVTVHGKPHSHGFKVGGENHSTEVIVKKSGSPPNNSWNSRYLPAKKNFSWV

SEQ ID NO: 45561 - DNA, 725 bp, Zea mays
  misc_feature: Ceres CLONE 1449710-F
  misc_feature: Encodes the peptide sequence at SEQ ID NO. 45562
  misc_feature (439)..(439): n is a, c, t, g, unknown, or other
  misc_feature (447)..(447): n is a, c, t, g, unknown, or other
  misc_feature (449)..(449): n is a, c, t, g, unknown, or other
  misc_feature (450)..(450): n is a, c, t, g, unknown, or other
  misc_feature (460)..(460): n is a, c, t, g, unknown, or other
  misc_feature (465)..(465): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcangcccgccngnnagagctagcntattnnatataagctaataaatatagcggccgtccctgtgtgggtttcgagtcagtcagtcagttattgccgtgcatgggctggcatgctctgaactctaaataaaaataatccttaaggcggcccccggcccggaaaccccccccgccccccggggcttttttggggaaaaaatgttttttttttttttttggggggccccaccgtgaaggggaacccctgggcccccgtttgtgttgcccccccccctctaaaaacttttttt

SEQ ID NO: 45562 - protein, 82 aa, Zea mays; identical to SEQ ID NO: 43085
  misc_feature: Ceres CLONE 1449710-F
  misc_feature (1)..(80): Pfam Name: Metallothio_2 Pfam Description: Metallothionein

SEQ ID NO: 45563 - DNA, 659 bp, Zea mays
  misc_feature: Ceres CLONE 1449713-F
  misc_feature: Encodes the peptide sequence at SEQ ID NO. 45564
  misc_feature (573)..(573): n is a, c, t, g, unknown, or other
tacccgcggtggcggccgctctagaactagtggatcccccgggctgcaggaattcgcacgagaccattacctagaacatcctaatcgaaaactaaccctaaccctctctcgctcctgcgtcctctccgtgcggcggctcccggatccagctctcgctctcagtctctctcgctcctgtgtgcggctcatgtgctccggtgctctcggtcctgtgcgcggctgcctccggtgctccctgcttcttctccggcttgagagctccggtgctctctggtccctcctcccggcgcgagcggattcttcttcgggtaccggcaactggtggcggcggtgataggcacggcgaaggcgtcgggtaaccgggcgctgttcgtgccggcagaggggatggatctgctcgcccaaatgttcctggagccgccatactaccccagcctagacgccgtcaagacgtttctagcggattactgggtacaacagatagcgttgttttgcaggatttaaaatactatgcaggcatcgtaatttcgttggggccttttgccctttagtgatagagcgattcatttctantagcgatcatgtactggtgttctacgtagatagatggattcagttagataacagtaagatctctttatctctgagaaaaaaaaaaa

SEQ ID NO: 45564 - protein, 38 aa, Zea mays; identical to SEQ ID NO: 43794
  misc_feature: Ceres CLONE 1449713-F

SEQ ID NO: 45565 - DNA, 813 bp, Zea mays
  misc_feature: Ceres CLONE 1449714-F
  misc_feature (14)..(14): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
tccctccctccctncttttttgcgaacgcgctccgaggtcttccgcaaaatccgtttacaannnnnnnnnnngtaaannnaaacaaatgggactccccgcggtggcggccgctctaaaactagtggatcccccgggctgccggaattcgcacgagaccattacctagaacatcctaatcgaaaatgaggagccctctcctccgccgtcccatgggcgcgccctgttcctgggacacttccttccacgaaaaaaagcagcagcagcagcataagctctagctacctctactaccgagctgaattcactcaacccggtacgctaagctccccttttccggtcgactagaaaagaaaagaggttattcatcccttccgggccgcagcctgccagaaatcgccaaaggaagagaaggggcctttgaacgggggcaagtcatagcgagaagcctggaaaatggtgggggccggatccatcgcccgcacttttctaacttgccagtggggtgaaagaattattatatannnaaaaataaagaacaccccccccccaggagggagtccggggcgggaccgctgggagtgaatggttcccccttggggcaggaggtaatacccaaccgaccgcctaccccccgaatcacccaaagaaaaattgttgggggcatggtgggtcctctgttgcccacaccccccctaagaatacttctccccccccccacccctcaatttccaaccccccccacccccgggtaaagcccctcaaccttatttccccgtcaggcgaggcgtcctatagaggccgcccggaagccc

SEQ ID NO: 45566 - DNA, 710 bp, Zea mays
  misc_feature: Ceres CLONE 1449733-F
aaagctggagctccccgcggtggcggccgctctagaactagtggatcccccgggctgcaggaattcgcacgagaccattacctagaacatcctaatcgaaaaaaactttcactctctcttgcgcttgcgcagcctcttcttctccgatcccgactccaactctccctctctccttcgcctggcacatcctcggcggcgcggcagcctgcttcttcaccggcgcggcggcctgcttcttcgacgacgcggaggcctacggcggcctaccgagcggacgggtccacggacgaacggatctccggcgcctggcagatcttcggcgcgcggcctaccggttgtggacggatctccgctgcctggtgccctggcagacgcggcagcgtcttctccaggcgggtggatctccagcgctcctcgagctggagcaggcaggcgtgccggtcttctccaggcgggtggatcttcaccggcgcggcggcctaccgggcggacggatccggtcgatctccagctgctccgtgcctctgctgctccgcggcctgagctccgggcggacggatccgcggcccagcgactccgctgcctctgctgctctgtgtctccagcggatccgtgcctctgctgctcggcgtcctgagctccggccgtctcgcgctgttgcttgctccttgaatccgcacacatgtgattggtcaaataaattttctttg

SEQ ID NO: 45567 - DNA, 738 bp, Zea mays
  misc_feature: Ceres CLONE 1449735-F
  misc_feature: Encodes the peptide sequence at SEQ ID NO. 45568
  misc_feature (333)..(333): n is a, c, t, g, unknown, or other
taaagctggagctccccgcggtggcggccgctctagaactagtggatcccccgggctgcaggaattcgcacgagaccattacctagaacatcctaatcgaaagaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatncaccaccaccagaagtgccgccacctcgtcgaccaatacctaagagctacccgcggcgtgggtgggggcagggatgcccgcccgcctgacctcccaagccaaaaaaaacgtcaagggcgaataccggccctgctgccttgcttccgggctggggttcccggattgaaaaggggatccgccccctccttggatttaaagaaaaaccccgaaacctgggaatttccccttttacccctaaggcggggaaaaactccaaaaaaaattttccccaaaaaaacttttggggacccatttttttccccccattttgttatttgacccccccccaagaagaaacttttttgcctttcttttttttaaaaccccctcacaccaaaaaaaaaaaaaagtttttttttttccccc

SEQ ID NO: 45568 - protein, 168 aa, Zea mays
  misc_feature: Ceres CLONE 1449735-F
  misc_feature (63)..(63): Xaa is any aa, unknown, or other
MVRKAKVEFDEQPPDNFDPKNPYADPVAMLEYREHLVREKWIQIETAKIIRERLRWCYRIEGXHHHQKCRHLVDQYLRATRGVGGGRDARPPDLPSQKKRQGRIPALLPCFRAGVPGLKRGSAPSLDLKKNPETWEFPLLPLRRGKTPKKIFPKKTFGDPFFSPHFVI

SEQ ID NO: 45569 - DNA, 614 bp, Zea mays
  misc_feature: Ceres CLONE 1449741-F
  misc_feature: Encodes the peptide sequence at SEQ ID NO. 45570
  misc_feature (614)..(614): n is a, c, t, g, unknown, or other
gcggtggcggccgctctagaactagtggatcccccgggctgcaggaattcgcacgagaccattacctagaacatcctaatcgaaaaactggtccatagggtcactggcatgtggttcccactctgcagactctgtccacaccggctcacgagggtgccacctcccttctcgtttcttcctgtcctggtgtcctgcccacctctcctctgatcctctccgccatttctgtgcgcatctggagctgttgttctaaacccccaaaccctccgtcctaacctctgcgccaccggcgtcaccaccgccggagccgcagccatgaacgccttcaggttcctcggggacatgacccacctcttctcggtcctcgtcctcctcctcaagatctacgccaccaagtcctgctcaggggtgtcgaggaagacgcaggagctgtacatgttggtgttcgtggcgaggtacctggacctcttcacggattatgtctcgctctacaactcggtgatgaaggtggtgttcatcaccagctcggcggccatcgtgtggtgcatgcgccgccacccgcaggtacgaaggacgtacgacaaggagcaggacaccttccgccacacggtgcn

SEQ ID NO: 45570 - protein, 99 aa, Zea mays
  misc_feature: Ceres CLONE 1449741-F
  misc_feature (1)..(99): Pfam Name: ER_lumen_recept Pfam Description: ER lumen protein retaining receptor
MNAFRFLGDMTHLFSVLVLLLKIYATKSCSGVSRKTQELYMLVFVARYLDLFTDYVSLYNSVMKVVFITSSAAIVWCMRRHPQVRRTYDKEQDTFRHTV

SEQ ID NO: 45571 - DNA, 639 bp, Zea mays
  misc_feature: Ceres CLONE 1449747-F
  misc_feature: SWISSPROT Homolog: EC 3.2.1.23 Beta-galactosidase
tggagctccccgcggtggcggccgctctagaactagtggatcccccgggctgcaggaattcgcacgagaccattacctagaacatcctaatcgaaaacagaaccctagcctcgtcgccatggcctcctccttgctccgctcctaggcgatcatcgagcggatgaaggcagttggcgccaaggtcgtcatggactgatcagaacaagcctttttcaacggtggccaggtgctgtagctccatgcgcttctctatcctcagggttgatgccgcatgctgcttggctcggcactgttactgaaatttcgaggctcaacggtcttcaatcattcatgtcatcatgtgtttcttcttgtcctgtttaggaatagccttcgctaacaggaaacagggaataaattatttctaaatttgagataaaaagcatgcacagttggagtattaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaaa

SEQ ID NO: 45572 - DNA, 630 bp, Zea mays
  misc_feature: Ceres CLONE 1449750-F
  misc_feature: Encodes the peptide sequence at SEQ ID NO. 45573
tggagctccccgcggtggcggccgctctagaactagtggatcccccgggctgcaggaattcgcacgagaccattacctagaacatcctaatcgaaaaacatccaaaattcccagtccgcgatacaagaccaatccaatcccagcggaagtggaagcagtttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttctcaggggtttcagcctactgcccgccatggccgcccacccactagcctgcgcttgaggcagctagtagtagatactgtaggttgaccagtgatccacggtgtgtttctcgctttccttttgtctgttgatttctattggctatactacacggtgctgtaaaggatcaattagttctgcctttgaggccctcatttggtgtaaatatttttgataacatggaccatgg

SEQ ID NO: 45573 - protein, 65 aa, Zea mays; identical to SEQ ID NO: 44442
  misc_feature: Ceres CLONE 1449750-F

SEQ ID NO: 45574 - DNA, 670 bp, Zea mays
  misc_feature: Ceres CLONE 1449753-F
  misc_feature: Encodes the peptide sequence at SEQ ID NO. 45575
ctccccgcggtggcggccgctctagaactagtggatcccccgggctgcaggaattcgcacgagaccattacctagaacatcctaatcgaaaaattctgttgtttgtcttgtcattttcactaggagcaggccctgtcccaggacttcttttgcctgagattttccctaataaaatccgagctaaggctatggctctctgcatgtctgtacattggatcgtgaacttctttgttagtttgatgttcttgcgtcttctggagcaacttggtccacagcttctctacacaatattttcgtcagtctgtgtggtagcctcaatatttgtgaggcgccatgtgttggaaacgaaggaaaagacttttacaagagatagaggttttcacccctgcacccacaataaaggtacatattttgacttggctggacccttgggccagcctgtttgctgaacagaaacaagctgggccctgcaaaagcttgattccttgaagtcatcggcaacccccctaacaatggtcttcagggaagtttccagatttgccgcttgccaacagctagggccggtgtttccatagaacatccggtactgaaatttatgcttgtatcccccccccctaaaaagaaaatttccaaacttggggtgggccccgggtccatctttaaatccaga

SEQ ID NO: 45575 - protein, 148 aa, Zea mays
  misc_feature: Ceres CLONE 1449753-F
PRGGGRSRTSGSPGLQEFARDHYLEHPNRKILLFVLSFSLGAGPVPGLLLPEIFPNKIRAKAMALCMSVHWIVNFFVSLMFLRLLEQLGPQLLYTIFSSVCVVASIFVRRHVLETKEKTFTRDRGFHPCTHNKGTYFDLAGPLGQPVC

SEQ ID NO: 45576 - DNA, 659 bp, Zea mays
  misc_feature: Ceres CLONE 1449757-F
  misc_feature: Encodes the peptide sequence at SEQ ID NO. 45577
  misc_feature (230)..(230): n is a, c, t, g, unknown, or other
  misc_feature (236)..(236): n is a, c, t, g, unknown, or other
  misc_feature (245)..(245): n is a, c, t, g, unknown, or other
  misc_feature (279)..(279): n is a, c, t, g, unknown, or other
  misc_feature (310)..(310): n is a, c, t, g, unknown, or other
  misc_feature (311)..(311): n is a, c, t, g, unknown, or other
  misc_feature (351)..(351): n is a, c, t, g, unknown, or other
  misc_feature (353)..(353): n is a, c, t, g, unknown, or other
  misc_feature (395)..(395): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (424)..(424): n is a, c, t, g, unknown, or other
  misc_feature (425)..(425): n is a, c, t, g, unknown, or other
  misc_feature (474)..(474): n is a, c, t, g, unknown, or other
  misc_feature (514)..(514): n is a, c, t, g, unknown, or other
aaatatgagactccccgcggtggcggccgctctagaactagtggatcccccgggctgcaggaattcgcacgagaccattacctagaacatcctaatcgaaaaccaagatgttgcaggcggcgctggactgggcgtgcggccccgggaaggtggactgctccctgctgatgcagggcccgccctgctaccacccggacaccgtggaagcgcacgccacgtacccctttcangcctantaacacggnaggggaatgggctcccgggacatgctattttaanggggtctcggtccccacaaggaccaacccgnnccctggttttttttttttgggggggaaaaacggaccgtcntnataaaatttttttcccccccccccgggggaaagaacgggggngnannnnnnnnnnnnnnncnnnnnnttcnnaaaaaaaaacaaacatcttcccaccgggccggggggggtgtttttcaanccccccccccccctaacaaaaactcccaacattacccaanccccctcgaattataggagtttttgtaaaatgaggggctccccccgaaaaagacgcacatttttttttccctgcgaacaccggaggattgttcgtcccctccttcatcaaatatggaaaggagggtgtttgcgtcgaaatacacc

SEQ ID NO: 45577 - protein, 42 aa, Zea mays
  misc_feature: Ceres CLONE 1449757-F
  misc_feature (1)..(40): Pfam Name: X8 Pfam Description: X8 domain
  misc_feature (41)..(41): Xaa is any aa, unknown, or other
MLQAALDWACGPGKVDCSLLMQGPPCYHPDTVEAHATYPFXA

SEQ ID NO: 45578 - DNA, 614 bp, Zea mays
  misc_feature: Ceres CLONE 1449762-F
  misc_feature: Encodes the peptide sequence at SEQ ID NO. 45579
gcggtggcggccgctctataactagtggatcccccgggctgcaggaattcgcacgagaccattacctagaacatcctaatcgaaaagggctggcggcatcgtggcctcatctcgcgctcaagctgctccccgtggtcccgttgagaccaacggcagcgcgcgcgttcgtgtacgtttatattattttttataagggagcaagaggctcggcggcagcggcgacggcgaccgcgacggcagtggcagtggcaggctggcagccgtccctatcttgtgtgtcaagcgcgaactccctatctcgtgtgtcaagcgcgttcgcgtgcgttctaggcacaggcagccgaggcgagccccttccgctcagtggccgccgccggaccgtggacgcagctagcccatcagcccatggcagggacggacgtcgcaggctccgcacgcggctccgatgccgcgctcggcaagacgggcgaaccacccgccgcggcgcgctctggcgcagccaagaaggtgactctcgctctgctagcctccttctcggcgctgctgtacagccagattcagccgccgccgtctaagatccccggcacgccgggcgggcctccggtcacggcgcc

SEQ ID NO: 45579 - protein, 69 aa, Zea mays
  misc_feature: Ceres CLONE 1449762-F
MAGTDVAGSARGSDAALGKTGEPPAAARSGAAKKVTLALLASFSALLYSQIQPPPSKIPGTPGGPPVTA

SEQ ID NO: 45580 - DNA, 648 bp, Zea mays
  misc_feature: Ceres CLONE 1449768-F
  misc_feature: Encodes the peptide sequence at SEQ ID NO. 45581
ggagctccccgcggtggcggccgctctataactagtggatcccccgggctgcaggaattcgcacgagaccattacctagaacatcctaatcgaaaaaacaaaccctaggttgcctgatcggctgatcgctccatggcgatcatctccgacttcaaggacgacgaggcaccggagcagcagctggcggccggccacggcgtcgaggaggccctcgtggcggcgttggagaggagcggcggcgcgctccccttcctacaggcggctatcgatgtcgcccaccgcaggtccggcctgttccgcgacccttcggcggtgagcaaggtcaccgcgatggcggcggcagccagggcgcagatcgaagccgaggagagggtgaccagagaggcggaggccaagaggaaggcggagggaccaccacaggaaggcggaagccgaggcgcagagggctgccaaggaggccgtaatgccgacggcagaggagaagccagagagcacggtggagaaggacatcatgaaggtggataaaaaagaaggaagccaacgtgaagacaaccaaatgctgggcaatgggcctggactgtggagaaatactccggggacctcaccggttggcccggaggtttacaatcccccatttcctggttcctc

SEQ ID NO: 45581 - protein, 130 aa, Zea mays
  misc_feature: Ceres CLONE 1449768-F
MAIISDFKDDEAPEQQLAAGHGVEEALVAALERSGGALPFLQAAIDVAHRRSGLFRDPSAVSKVTAMAAAARAQIEAEERVTREAEAKRKAEGPPQEGGSRGAEGCQGGRNADGRGEAREHGGEGHHEGG

SEQ ID NO: 45582 - DNA, 1211 bp, Zea mays
  misc_feature: Ceres CLONE 1449771
  misc_feature: Encodes the peptide sequence at SEQ ID NO. 45583
acaaacaatttgttccccctgcctaggccgccgccggggaagcggggaaaaagatcccgtcccaatggctctcctcccccaaatcctccactctcctcaccccgcgctcgccgccgccgcctcctcctctcgcgcattctgccgagcaccacgccacctccatgtctcagcgtcccggggccggggccgcggccgcctcgccacggcggcgggggcgtccgggcccggaccatcatcgccggagccatctccccctgagtccgacgacgggctggtggagctcccgctgttccctctcccgctcgtgctcttcccggacgccacgcacgcgctgcacatcttcgagtatcgctaccgcatcatgatgcacacggtgctgcagaccgacctccgcttcgggatcgtcttcgtcggcaactcggggtccgccgcggaggtgggctgcgtcggggaggtcgtcaaacacgagcgcctcgccgacgaccggttcttcctcatctgcaagggccagcagcggttccgcgtcgcccgcatcgtgcgcaccaagccctacctcgtcgccgccgtgcagtggctcgaggaccgcccgcccgcagagcccccggcgcccggggaggacgccgaggcgctcgctgccgacgtcgaggccctaatgcgggacgtcatacgcatcgccaaccgcctcaacggcaagcctgagaaggaggtcggggacctgcgcaggggcctgttccccacccccttctccttctacgtcggcaacaccttcgagggcgcgccccgcgagcagcaggcgctcctcgagctcgaggacaccgccgccaggctgcgcagggagcgggacaccctgcgcaacacgcttaactacctcaccgccgcctccgccgtcaaggacgcattcccttcctcgccgtcttcggggtgaagtgaggtgaggtgaggtcgtcactcgtcagctaggaatggatgaggataaggagtttgtggtcgtgggtataggactgaactttgttatcactctttcaagccctttttctttcttctttctcttattattatatattctatggctaggttctatctgcatggggttagcatcttagcgtgtaaaattgtataatttggtgtgtgttaactcaagaaaaattggagctgtgatatataagtccttgaaaaggacgggaattttgctctcaaaaaaaaaaaaaaaa

SEQ ID NO: 45583 - protein, 286 aa, Zea mays
  misc_feature: Ceres CLONE 1449771
  misc_feature (72)..(264): Pfam Name: LON Pfam Description: ATP-dependent protease La (LON) domain
MALLPQILHSPHPALAAAASSSRAFCRAPRHLHVSASRGRGRGRLATAAGASGPGPSSPEPSPPESDDGLVELPLFPLPLVLFPDATHALHIFEYRYRIMMHTVLQTDLRFGIVFVGNSGSAAEVGCVGEVVKHERLADDRFFLICKGQQRFRVARIVRTKPYLVAAVQWLEDRPPAEPPAPGEDAEALAADVEALMRDVIRIANRLNGKPEKEVGDLRRGLFPTPFSFYVGNTFEGAPREQQALLELEDTAARLRRERDTLRNTLNYLTAASAVKDAFPSSPSSG

SEQ ID NO: 45584 - DNA, 615 bp, Zea mays
  misc_feature: Ceres CLONE 1449779-F
  misc_feature: Encodes the peptide sequence at SEQ ID NO. 45585
  misc_feature (421)..(421): n is a, c, t, g, unknown, or other
  misc_feature (435)..(435): n is a, c, t, g, unknown, or other
ggagctccccgcggtggcggccgctctataactagtggatcccccgggctgcaggaattcgcacgagaccattacctagaacatcctaatcgaaaaacacaccagtaccactgcacaaaagcacactctgttcggcttgccttgtcctttttccttgccatatggctaccaagatggtcctgtgtcgctttgtagccctcgcggctgtcgcctgcctcctccgccctggcgcgcccgtcgagctccaccgcaagctctccgggtggtccgacgacgcgggcgcgacgtggtacggcgcagccaccggcgctgggaagcgacggtggtgcatgcgggtaccagaacgccgtcgaccagccgccgttctcgtccatgatcgccgccggcagtccatccatcttccagaacggcaagggctgcngcgcctgctatcangtgaaatgcaccgggcacgcgtcgtgctccggcagcccggtgacggtggtcctcaccgaccagtgccccgggcgcgcgtgcctgggacaacccgtgcacttcgaactgaccggcacggcgtttcgagccatggccaaggacggccagccgaacaattcccccgggcccgaaacctcaaga

SEQ ID NO: 45585 - protein, 81 aa, Zea mays
  misc_feature: Ceres CLONE 1449779-F
  misc_feature (2)..(70): Pfam Name: DPBB_1 Pfam Description: Rare lipoprotein A (RlpA)-like double-psi beta-barrel
  misc_feature (17)..(17): Xaa is any aa, unknown, or other
  misc_feature (21)..(21): Xaa is any aa, unknown, or other
MIAAGSPSIFQNGKGCXACYXVKCTGHASCSGSPVTVVLTDQCPGRACLGQPVHFELTGTAFRAMAKDGQPNNSPGPETSR

SEQ ID NO: 45586 - DNA, 555 bp, Zea mays
  misc_feature: Ceres CLONE 1449780-F
  misc_feature: Encodes the peptide sequence at SEQ ID NO. 45587
acccgcggtggcggccgctctagaactagtggatcccccgggctgcaggaattcgcacgagaccattacctagaacatcctaatcgaaaaacgcgtcagacccacgcagcgcaccttctcttctccgccgcgtcgccgccgaacatcagcatcggatcgatggagggctgggacaaggggaccaagagcacggtgggcgagatcccgctgctgtcgacgcgcgcgggtccgcgggacggcgaggcgtggcggcagcggctcaagaggagtaccgcgcgctcatcgcctacacctcggtgaacaggccaggacacgactggttcgcatcgccggcgcccacccgggaggggaacccccctggggaggggaaccttggttgggaacccccccaaccccccccccgaaaggatccccccccagataaaaccccccccccccccccggggccccccaaaaaaagccccccccccccgggggaaaaaccaaaaaaaataccggggggggaaaaaaaatcccccccccgggtttttaacccggggggggggaaaaaaaaaa

SEQ ID NO: 45587 - protein, 46 aa, Zea mays
  misc_feature: Ceres CLONE 1449780-F
MEGWDKGTKSTVGEIPLLSTRAGPRDGEAWRQRLKRSTARSSPTPR

SEQ ID NO: 45588 - DNA, 626 bp, Zea mays
  misc_feature: Ceres CLONE 1449781-F
  misc_feature: Translation starting site: 122
  misc_feature (397)..(397): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (610)..(610): n is a, c, t, g, unknown, or other
ctctataactagtggatcccccgggctgcaggaattcgcacgagaccattacctagaacatcctaatcgaaaaacgcactggaatcatcgtgcggcgcagcgagcgagaggagtggagaggatgacggcgcccaagcctggcgggggagcggcggccgcggcgagggcggcggcggcggggcccaggacggtgctcatcacgggggtcagcagggggctgggccgggccctggcgctcgagctcgcgcgtcgcgggcactcggtggtcggctgcggccgctccgccgagcacctccgctcccttgaggaagagatcacgtcgccatcgcgccacttcttcacccgtcgccgacgttaggtctgacagcagtgtggccgagctggcaaagactgttgnaaaaaagaagcaagttccagatattatagtaaacaacgctggtacgataaacaagaataacaagacatggaatgttcccgccggaagattttgatatgggtggtcgatacaaatttcaagggaacagcagattgggcttcccccttttttgtaccccttattgataaagaaagagannntggggattataaaccaatcctatccctcctgggntgggggcaccgacccc

SEQ ID NO: 45589 - DNA, 762 bp, Zea mays
  misc_feature: Ceres CLONE 1449793-F
  misc_feature: Encodes the peptide sequence at SEQ ID NO. 45590
  misc_feature (73)..(73): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (510)..(510): n is a, c, t, g, unknown, or other
tgtgtgtgtccccgcgcccccacactcaaaaaaaaaatattcttcgaacaacgaaaatcatgattataaaaanaaannnnnnnnntaaaaactgggactccccgcggtggcggccgctctagaatagtggatcccccgggctgcaggaattcgcacgagaccattacctagaacatcctaatcgaaaacttccttgtccgctccatttcgagttcaatcgctgcccgctctccactcctccggtccttccgccggcgggcacgcgccgggcgaaatggaagcggcaccatccgtccgcaccttccccccctcatcgttcttctccgcggggcctagacactgccttctgctcgcgggcccggcctcgcggcgcgcccgggggctcgccgcgccgcccctgccccgcgccgtcgctttccacctgcgcggcgctggtgggtctcccagtccgccaccgccccgcgggcttgggggaaggctgcaacccgggcaagccaagggtcgaaaggntccgggccgtttctgcaagccctccgggcccgccggggagcccccccccaaaggaattccctaaaccgggggggtttggagaggaaacccaaaatcgttttgggtcccttccaccccgcaggaaccacgcccaaaaaaaaaaagcccggggttttgtttttccaaaaagggggggccctccctggggtttcaaacccctattgaacctttttggggggggggaaccccctcctaaggtttggaaaaaacgag

SEQ ID NO: 45590 - protein, 99 aa, Zea mays
  misc_feature: Ceres CLONE 1449793-F
  misc_feature (79)..(79): Xaa is any aa, unknown, or other
MEAAPSVRTFPPSSFFSAGPRHCLLLAGPASRRARGLAAPPLPRAVAFHLRGAGGSPSPPPPRGLGGRLQPGQAKGRKXPGRFCKPSGPAGEPPPKGIP

SEQ ID NO: 45591 - DNA, 747 bp, Zea mays
  misc_feature: Ceres CLONE 1449795-F
  misc_feature (503)..(503): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (663)..(663): n is a, c, t, g, unknown, or other
  misc_feature (664)..(664): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (693)..(693): n is a, c, t, g, unknown, or other
  misc_feature (716)..(716): n is a, c, t, g, unknown, or other
  misc_feature (723)..(723): n is a, c, t, g, unknown, or other
  misc_feature (730)..(730): n is a, c, t, g, unknown, or other
  misc_feature (736)..(736): n is a, c, t, g, unknown, or other
  misc_feature (744)..(744): n is a, c, t, g, unknown, or other
aaagctggagctccccgcggtggcggccgctctagaactagtggatcccccgggctgcaggaattcgcacgagaccattacctagaacatcctaatcgaaaaacacccacaccaactttccccgtctgcctttcttctcggccgacgccagctacgaaccctagccgcgcgaggaacgcccagatcccaaaagacggcgatccatggcggcggttcaactgctcggcgaggatgctccccaggtctctgctccaccgaacgctcgcgagctgcctcggacgagggacccctgctcacgccaagctggctcatgccctcccgccgactctccaccaaggtctccggctagcgaatctctcgtggtgaagctacacctcctccagccagtctgcctcgtgcgctcccgccagctctccggttagcgtgctcgcaacatccagaagataatgatgactgctggacggctcctcaatagagacgactcaagagcttgctcgagcttncctcaaaaagaagatgctgcgtgccctttccaccccnnnngcccccgaagggaatttccaatcggaccccggggagtattaaaaagacgctttggggccaaaatgtgggcctttttaaaagagggggggaaaaaagttttttccccaaaagggggggggnncccccccccccnnnnnnnnnnnccgcctncgcgcgcgctcgcgcgctacctncgccgcncgacccncccctnctccgtgnaca

SEQ ID NO: 45592 - DNA, 787 bp, Zea mays
  misc_feature: Ceres CLONE 1449801-F
  misc_feature (307)..(307): n is a, c, t, g, unknown, or other
  misc_feature (323)..(323): n is a, c, t, g, unknown, or other
  misc_feature (342)..(342): n is a, c, t, g, unknown, or other
  misc_feature (343)..(343): n is a, c, t, g, unknown, or other
  misc_feature (345)..(345): n is a, c, t, g, unknown, or other
  misc_feature (346)..(346): n is a, c, t, g, unknown, or other
  misc_feature (351)..(351): n is a, c, t, g, unknown, or other
  misc_feature (378)..(378): n is a, c, t, g, unknown, or other
  misc_feature (399)..(399): n is a, c, t, g, unknown, or other
  misc_feature (426)..(426): n is a, c, t, g, unknown, or other
  misc_feature (427)..(427): n is a, c, t, g, unknown, or other
  misc_feature (429)..(429): n is a, c, t, g, unknown, or other
  misc_feature (430)..(430): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (458)..(458): n is a, c, t, g, unknown, or other
  misc_feature (461)..(461): n is a, c, t, g, unknown, or other
  misc_feature (464)..(464): n is a, c, t, g, unknown, or other
  misc_feature (466)..(466): n is a, c, t, g, unknown, or other
  misc_feature (467)..(467): n is a, c, t, g, unknown, or other
  misc_feature (472)..(472): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (486)..(486): n is a, c, t, g, unknown, or other
  misc_feature (487)..(487): n is a, c, t, g, unknown, or other
  misc_feature (490)..(490): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (509)..(509): n is a, c, t, g, unknown, or other
  misc_feature (511)..(511): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (524)..(524): n is a, c, t, g, unknown, or other
  misc_feature (526)..(526): n is a, c, t, g, unknown, or other
  misc_feature (530)..(530): n is a, c, t, g, unknown, or other
  misc_feature (532)..(532): n is a, c, t, g, unknown, or other
  misc_feature (536)..(536): n is a, c, t, g, unknown, or other
  misc_feature (537)..(537): n is a, c, t, g, unknown, or other
  misc_feature (539)..(539): n is a, c, t, g, unknown, or other
  misc_feature (540)..(540): n is a, c, t, g, unknown, or other
  misc_feature (563)..(563): n is a, c, t, g, unknown, or other
  misc_feature (574)..(574): n is a, c, t, g, unknown, or other
  misc_feature (576)..(576): n is a, c, t, g, unknown, or other
  misc_feature (591)..(591): n is a, c, t, g, unknown, or other
  misc_feature (601)..(601): n is a, c, t, g, unknown, or other
  misc_feature (609)..(609): n is a, c, t, g, unknown, or other
  misc_feature (612)..(612): n is a, c, t, g, unknown, or other
  misc_feature (634)..(634): n is a, c, t, g, unknown, or other
  misc_feature (642)..(642): n is a, c, t, g, unknown, or other
  misc_feature (644)..(644): n is a, c, t, g, unknown, or other
  misc_feature (645)..(645): n is a, c, t, g, unknown, or other
  misc_feature (647)..(647): n is a, c, t, g, unknown, or other
  misc_feature (648)..(648): n is a, c, t, g, unknown, or other
  misc_feature (664)..(664): n is a, c, t, g, unknown, or other
  misc_feature (670)..(670): n is a, c, t, g, unknown, or other
  misc_feature (684)..(684): n is a, c, t, g, unknown, or other
  misc_feature (685)..(685): n is a, c, t, g, unknown, or other
ccgagctggagctcaccgcggtggcggccgctctagatctagtggatcccccgggctgcaggaattcgcacgagaccattacctagaacatcctaatcgaaaatccttcccgactcggcgcctcgttccgacaacgacgaagcagctgggggacttgttgagcagcgagcggtacagatcccgatcctgaatcctccgagcgagttcttccgtcctcctcgcagtcagccatggcccgctcctcctcgcagtcgcagtcctccgtcggtggcggcggcggcggcggcggcgcgcgaccggccaccgncggcccgcgcggcacngccgcggcggccccccggnngnnccgcnggcggggtggtgttgtgttggcgcacnccgggtgggtgggttttgtantgggggtagtgttgccccccccccccnnannannnnnnnnnnnnannnnannnnnnnanaanaanannaaaanaacacannnnaaannaanaaannnnnnaaaannnnananannnnnnnaaaananaaananaaannannaaagaaaaaaaaaaaaaaaaccnaaaaaccaacncnatacaccacacaccnagggaacccnccacaccnccncacaccaccgcaataacaccgnacataacncnnanncggccacccaatctcnaatcgnaaatacgcccaagnnaagcgacccccgaaaccacacagcgcgcccaagcggttgatcagccaagcatggccgcccccacgcccgctttcgcgtgagcactagagaatgtttcaggcg

SEQ ID NO: 45593 - DNA, 787 bp, Zea mays
  misc_feature: Ceres CLONE 1449805-F
  misc_feature (373)..(373): n is a, c, t, g, unknown, or other
  misc_feature (419)..(419): n is a, c, t, g, unknown, or other
caaagctggagctccccgcggtggcggccgctctataactagtggatcccccgggctgcaggaattcgcacgagaccattacctagaacatcctaatcgaaaaatcatgcttccatcctgtgggccatcctcggaagtcctcacccccacatactgccattcacggactgaacgtagatgaaagatgaagccttcagtccgcgtctcttcgtctcgagatctcacgcccgcgccgtcgatggaaggctcgcctccagtccgcgcctacgcccgcaacctcgcccgcgcccaagatgtcgccctctcccccaccgttgtcctcgcttcctccctccagcacctgctgtctttctcactcaatggtgtggatcangacggtcctcgcggcggaagccacctgagaaagccaccccccccancactcgcccccgcctcgcccgatcgatctgacacagtgcagctgactggcacacagtacgcatcgtcattggacttgctctggctcttcacctacaacaccctgaatgactacaagaggtaattgtatcgactccaccctgtctgctgagaccgggttcgctgtttaagttggagaagtcaaaggacatcaattcaagtctgcctagcaggtgacgttggagccctaccaggctgaccatgcatgtggtgtgggcggttataaaaaggcccaaaaaccaaaaagctacctgatcgccccataaatcaaaaatccgggcctcatttttgtccaaataagggatggcttcaatggaattaaaggataata

SEQ ID NO: 45594 - DNA, 746 bp, Zea mays
  misc_feature: Ceres CLONE 1449808-F
  misc_feature: Encodes the peptide sequence at SEQ ID NO. 45595
acaactggagctccccgcggtggcggccgctctagaactagtggatcccccgggctgcaggaattcgcacgagaccattacctagaacatcctaatcgaaaaaggacaacgcagcagccgctgccgttgccgctgccggctgccgctacctatgctcaagtgctcagtgcttagtgctcaccgatctgcccctgcctcatcacacgcgcgcaaggcgcacaaataccttttctctcctctaccgtcccactctcctcggcaatcccggcccggcatggcgagacagtcctcgtccccctcgcggaaagctctgagcaacatcgcctgcatccgcctgcacaaggagctcgcagagtgccaggttaacccgcccgcgggcttcaagcacagggtcactcacgacctccagagatggatcatcgatgtagcacgggcagcacgcacgctctacactgaagaaacctacaagttgcacgtggatttccccgagcattatccgatggaggcacctcaggttatatttctgcatccaggaccgatgcatacatacatttacagcaatggcacactactgtttaaatatactacaatgattcgaaggtccccagcgaagacaagaacagttctatctcgcacaaccatatttatctaaggctggtccaccttcgctcgaaaaattctctcccccccctgataaagggtccctaatggtcaagaaactggccgcaaatgggaaggttctccta

SEQ ID NO: 45595 - protein, 125 aa, Zea mays
  misc_feature: Ceres CLONE 1449808-F
  misc_feature (20)..(125): Pfam Name: UQ_con Pfam Description: Ubiquitin-conjugating enzyme
  misc_feature: SWISSPROT Homolog: EC 6.3.2.19 Ubiquitin--protein ligase
MARQSSSPSRKALSNIACIRLHKELAECQVNPPAGFKHRVTHDLQRWIIDVARAARTLYTEETYKLHVDFPEHYPMEAPQVIFLHPGPMHTYIYSNGTLLFKYTTMIRRSPAKTRTVLSRTTIFI

SEQ ID NO: 45596 - DNA, 798 bp, Zea mays
  misc_feature: Ceres CLONE 1449811-F
  misc_feature: Translation starting site: 191
  misc_feature (320)..(320): n is a, c, t, g, unknown, or other
  misc_feature (323)..(323): n is a, c, t, g, unknown, or other
  misc_feature (344)..(344): n is a, c, t, g, unknown, or other
aaagctggagctccccgcggtggcggccgctctagaactagtggatcccccgggctgcaggaattcgcacgagaccattacctagaacatcctaatcgaaaaaaaccataagagcttctgagtctagacactagatacagtaagccttagcaccaacagaggttagtatctcaacaaggatacttcaaatatgtccgcctcacgcagctcctctcccaactccatctcacagtggagccagaaagagaacaagatgtttgaagaggcactcgcatactacggcgagggcacatccaaccggtggggacaggtgtcagagnccnatggagcatcaagtctgctgnagaagtgcgctgccactatgaagatcttgactatgacgtcaagatgattgaatcaggccacgtgccgtacccccagtacaagaacctggaatccgggacctgaggttgaaagttggaagccttcaggaggcaaaaacaaacccttttgaattcaaaaaggccttgggtcttaaaaagaaccaaaaacccccgcccgggggtgaaaaaaaaaaggtaaaccggggggcctttgttaaaaaaggttaagaacatttttttttccccggggggggaggacacgggccccccccaaaggggggggttttttttccctcccaaaaatgtggggagggagacccctcttttttataaaaaaaaaaaatttttcgtaaaaaaaaaaaaaaaaatttctcttcccccccgcgggggggggggcgcccccccccccccgaaggaggaaatacccccgccccgc

SEQ ID NO: 45597 - DNA, 756 bp, Zea mays
  misc_feature: Ceres CLONE 1449815-F
  misc_feature: Encodes the peptide sequence at SEQ ID NO. 45598
  misc_feature (733)..(733): n is a, c, t, g, unknown, or other
  misc_feature (734)..(734): n is a, c, t, g, unknown, or other
aaagctggagctccccgcggtggcggccgctctagaactagtggatcccccgggctgcaggaattcgcacgagaccattacctagaacatcctaatcgaaaacaggctgggtttattccaccaccaagtgccgggacatcttctgaagtaaatacttccgtatccaagaaggcagctccggaaccttttgatccttttggcgctattcctttgaacagttttgatggacctgacccatttggtggcgtcagctcaaatgctggatcatctaccgcagcagcacccacccacggttcaactggaaatatcaggacatcgaacaagaaccttcatgctgcaaccgactttgctgcctttgtatcaaacaatgagggagcagcgaaagacccattcgatctttcttcgagtgccaatgtcggaaaaacacctttggcagctcccaagatcgacgcatctgatttcggtgcatttgtatctagcaccgaggaagcagccaaggaccatctcgatctttcttcgggtagcaaccttggaaggacaggccaagcacctgcggcagcctccaagccaaacgcaaagaaagacaattttcaggtcaagtccggcatatgggcagactcgctgagccggggattgattgatctgaacataactgcaccgaagaaggtgaacctagctgatattggcatcgtcggtggccttggcgaatggtccgatgagaagccctgccctnnctgacatgggcgccggatccgc

SEQ ID NO: 45598 - protein, 244 aa, Zea mays
  misc_feature: Ceres CLONE 1449815-F
KAGAPRGGGRSRTSGSPGLQEFARDHYLEHPNRKQAGFIPPPSAGTSSEVNTSVSKKAAPEPFDPFGAIPLNSFDGPDPFGGVSSNAGSSTAAAPTHGSTGNIRTSNKNLHAATDFAAFVSNNEGAAKDPFDLSSSANVGKTPLAAPKIDASDFGAFVSSTEEAAKDHLDLSSGSNLGRTGQAPAAASKPNAKKDNFQVKSGIWADSLSRGLIDLNITAPKKVNLADIGIVGGLGEWSDEKPCP

SEQ ID NO: 45599 - DNA, 773 bp, Zea mays
  misc_feature: Ceres CLONE 1449820-F
  misc_feature: Encodes the peptide sequence at SEQ ID NO. 45600
  misc_feature (676)..(676): n is a, c, t, g, unknown, or other
  misc_feature (755)..(755): n is a, c, t, g, unknown, or other
ggagctccccgcggtggcggccgctctagaactagtggatcccccgggctgcaggaattcgcacgagaccattacctagaacatcctaatcgaaaaatttttttcatttccgttccaggtctcctgtttccatcctcttccacggttccacttccacccccatctcctcgccctcggcaagcccagcaaccccaatccccaatcccgtccgcttctttccccgtccccgaccttgccgaggaacctcccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgaacgggtcccaccgcttcgtgatccagggctactcgctcgccaagggcatgggcgtggggaagcacatcgccagcgacaccttcaccgtcggcggctaccagtgggcgatctacttttacccagacgggaagaaccccgaggacaactccggctacgtctcggtcttcatcgcgctcgcgtccgacggcaccgacgtgcgcgcgctcttcgagctcacgcttctagaccagagtggcaaggggcagcacaangtgcactcgcactttgaccgctccctagagtccggaccgtacactctcaagtaccgcggaatccatgtgtaatgatctnagagttttgtcccttttt

SEQ ID NO: 45600 - protein, 151 aa, Zea mays
  misc_feature: Ceres CLONE 1449820-F
  misc_feature (128)..(128): Xaa is any aa, unknown, or other
MEDEDAGLGDGGEASPPHHAAASGDRARDLAASPTSSRSVTQTVNGSHRFVIQGYSLAKGMGVGKHIASDTFTVGGYQWAIYFYPDGKNPEDNSGYVSVFIALASDGTDVRALFELTLLDQSGKGQHXVHSHFDRSLESGPYTLKYRGIHV

SEQ ID NO: 45601 - DNA, 758 bp, Zea mays
  misc_feature: Ceres CLONE 1449823-F
  misc_feature (394)..(394): n is a, c, t, g, unknown, or other
  misc_feature (395)..(395): n is a, c, t, g, unknown, or other
  misc_feature (398)..(398): n is a, c, t, g, unknown, or other
  misc_feature (469)..(469): n is a, c, t, g, unknown, or other
atttgctggagctccccgcggtggcggccgctctagaactagtggatcccccgggctgcaggaattcgcacgagaccattacctagaacatcctaatcgaaaagaaaacggaagttaccaattcacccgactcgatagacacaccggctctgctctaagcgagaatccgaggagcgctgccaagcgcctccgcgacgggatcgacgcgacttgattcgcgagtttcaacgtcgcgaggagagcagaaaattacgcaggcagagcggctgccggctgggtgttgaagctagagcggctaggagcaggttcggagcgctaccaaacaggcccttaacctaagcgctcctgcccttcggatcctttatttcccccccccgcgaggggggggagggtnnaanttctcccttgctacacccccacggggtgacgatggaacaccagcggggcgccgccgcatccggccacccancggctccaaacctcgaggaaaaacgcgctgtttattgatttattacatgaagccgcccccgtctgggcaccgggagcccagaaaactaatttggggggaccctgtactgtatcctattgggagggttttcctgcggtggccctttcagcccccaggaattttcttttccgccccaaatgatctcccccttgggagtgagcctccaagggtccccccctccttacttatgggttttttcaaaatattggggttcaccccaccagagaattgaatctggcgggggttatat

SEQ ID NO: 45602 - DNA, 757 bp, Zea mays
  misc_feature: Ceres CLONE 1449825-F
  misc_feature: Encodes the peptide sequence at SEQ ID NO. 45603
  misc_feature (380)..(380): n is a, c, t, g, unknown, or other
  misc_feature (393)..(393): n is a, c, t, g, unknown, or other
  misc_feature (397)..(397): n is a, c, t, g, unknown, or other
  misc_feature (456)..(456): n is a, c, t, g, unknown, or other
ccccgcggtggcggccgctctagaactagtggatcccccgggctgcaggaattcgcacgagaccattacctagaacatcctaatcgaaaagaagccgcgggctcaaccctaactgacccagagcgatcggagctgacgacgatggccgggaaggcggcggccgcgacggcggcgaggtgggcggaggggtacccgtggaaggagaagctggcaaagtacaagggtgagctcgggaagggggtgtggggatactgggagctcggcgcgtggaagccgctcggcatcagcgctcgcaagcgcgcccgcctccgcaaggaggtgctcctcgccggcgaggactggagctactatcctccccgccgggagaggggtggggggcncaagggccacaantgcnaccgcatctccgccgagaagcgagcaaatactgttgagctgatggagaagatgccccanatgctgctcgactacaagaaacgtaggtgggagaagaagaagaaagtggaggagagcgccaagaattgataccccgcggctcgctccgggtgcttctcttccctaataaaggcccaacttttacccggagggttgcaggacggcttaatttcttgaccccatctttccttgggggattccctcctccccggggaggcgaccttggaccccctttcctgattggggatgctttcccacctctttgcaccgggatcggggatttcggggacccccaacctttggtacgacccccatttttggg

SEQ ID NO: 45603 - protein, 127 aa, Zea mays
  misc_feature: Ceres CLONE 1449825-F
  misc_feature (80)..(80): Xaa is any aa, unknown, or other
  misc_feature (84)..(84): Xaa is any aa, unknown, or other
  misc_feature (86)..(86): Xaa is any aa, unknown, or other
  misc_feature (105)..(105): Xaa is any aa, unknown, or other
MAGKAAAATAARWAEGYPWKEKLAKYKGELGKGVWGYWELGAWKPLGISARKRARLRKEVLLAGEDWSYYPPRRERGGGXKGHXCXRISAEKRANTVELMEKMPXMLLDYKKRRWEKKKKVEESAKN

SEQ ID NO: 45604 - DNA, 734 bp, Zea mays
  misc_feature: Ceres CLONE 1449829-F
  misc_feature: Encodes the peptide sequence at SEQ ID NO. 45605
  misc_feature (660)..(660): n is a, c, t, g, unknown, or other
  misc_feature (681)..(681): n is a, c, t, g, unknown, or other
tggagctccccgcggtggcggccgctctagaactagtggatcccccgggctgcaggaattcgcacgagaccattacctagaacatcctaatcgaaaaacccatgccttcatcttcgtcgtcttgcagccccgcaacagtcgttagcttagagcatcgcacctcatcgttccaccgtccgtccgtccgctcgttcgcgtgatctgtttgagagttggggaatggaggcctacgtcctgttcgcgcccgccaaggaggtgatcaggttcgaggagcaggaggaggacatcggctgcccgtccgagtcgtccgcggcgcgttcaacgtcgtcgtcctcctcctcgtcagacggggtggacctcgccgacgacgccagctcgtccgggtccagctgtcacttcgagatggcctccctcatgacgcagctcccgatcaagaggggcctgtccaagttcttcgacggcaagtcgcagtcgttcgcgtcgctggcggcggtcggcggcctcgaggacctgcccaagccgccggcgaagcgggctcagacgtcgcggagctgcggcgtcggcctcgaggacgcgcaccgccgtggccctccctcccgcgacggcaggaagcaggcgtccagggctcggctgacgcccgcggcgctcgccctcgcgccnaaaaggctggtgcgagcgcgnccgctcgtactggcgagaccggcgcggccggaaagcccctggtattggcgtag

SEQ ID NO: 45605 - protein, 171 aa, Zea mays
  misc_feature: Ceres CLONE 1449829-F
MEAYVLFAPAKEVIRFEEQEEDIGCPSESSAARSTSSSSSSSDGVDLADDASSSGSSCHFEMASLMTQLPIKRGLSKFFDGKSQSFASLAAVGGLEDLPKPPAKRAQTSRSCGVGLEDAHRRGPPSRDGRKQASRARLTPAALALAPKRLVRARPLVLARPARPESPWYWR

SEQ ID NO: 45606 - DNA, 855 bp, Zea mays
  misc_feature: Ceres CLONE 1449833-F
  misc_feature: Encodes the peptide sequence at SEQ ID NO. 45607
  misc_feature (1)..(1): n is a, c, t, g, unknown, or other
  misc_feature (156)..(156): n is a, c, t, g, unknown, or other
  misc_feature (403)..(403): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (418)..(418): n is a, c, t, g, unknown, or other
  misc_feature (460)..(460): n is a, c, t, g, unknown, or other
  misc_feature (462)..(462): n is a, c, t, g, unknown, or other
  misc_feature (855)..(855): n is a, c, t, g, unknown, or other
nacacgctggagctccccgcggtggcggccgctctagaactagtggatcccccgggctgcaggaattcgcacgagaccattacctagaacatcctaatcgaaaactctagaaccctagcgcccgtcctgccgccgctgcagccgccatcgcacggncatgggtatcgatctcgtagccggcggccgcaacaagaagaccaagcgcacggcgcccaagtccgacgatgtctacctcaagctcctcgtcaagctctaccgcttccttgtgcgcaggacaaagagcaacttctacgcccgggatctgaagcgcccctttatgaagtaagactcaacgcccgccggtttttaaatgggccccccctttttttttttcccccccccccggaggggggggagggctttnttttnnncncccccncccccccccccttttctatctcaaaaaaaaacccccctattnantcttgggggggggcggtaacattgaaaccctcaggtggcaaaataaaaaattgtgtggcggaaaagtctctccccctctcaaaataggcacgcgcccgccgtccctccctttgcttaaacacccaacccttcgcgagaggatccctacaaacgtctaaaacaattgcggcactccccacgcgtgtcacccccgccatgccccaattctctgcccacatctcgccgtaggtacgagcacgtcgtgtcgacaggcacgcgcccacgctactgccaccccacactctacctgtagaccataacaatacaatcatactcaaacagtctattcactcctgcgcgcctcatcgtgatagctacgcctccgcccccctctcatcttctctcctccttttn

SEQ ID NO: 45607 - protein, 55 aa, Zea mays
  misc_feature: Ceres CLONE 1449833-F
MGIDLVAGGRNKKTKRTAPKSDDVYLKLLVKLYRFLVRRTKSNFYARDLKRPFMK

SEQ ID NO: 45608 - DNA, 765 bp, Zea mays
  misc_feature: Ceres CLONE 1449834-F
  misc_feature: Encodes the peptide sequence at SEQ ID NO. 45609
  misc_feature (411)..(411): n is a, c, t, g, unknown, or other
ggagctccccgcggtggcggccgctctagaactagtggatcccccgggctgcaggaattcgcacgagaccattacctagaacatcctaatcgaaaatccattcccatcccattccccactctactcattcagcagatcccgtcactcgctctccacaagcagagcaccgcagcagaacgaggaaggatgctggccatcttccagaagcaggtggcgcacgcgccgcaggagctcaacagcccccgcgccggcgcgtcgcccagcaagccccggaaccccgacgagatcctgcgcgacttccacgccgcgcacccggccgccgccttctccgcctccttcggcggcggcgccgcgctcgcctgcgtcggcccctcctcctccgccaccgccaccgggaccgccacctaccancccacgctctgcggcctggaccacatctactgcgtcttcctgggccgcctcgacaacctcagcggcttcatccgccagtacgggctggggcggccgctccccccacgaggcgatgctggtcatcgaggcctaccgcacgcttcgcgaccggggggcctacccggccgaaccaggtcgtcaaggacccccccggcgcccttcccctcgtccggctttcaaaagccgctccgggggccgtttttctccggccctccggggccgcccaaaaccggggggagcgcccggggccccgtgtatctgggggggtcctccgcccaaagggatcccccgggtggatcccgccacccaccggga

SEQ ID NO: 45609 - protein, 193 aa, Zea mays
  misc_feature: Ceres CLONE 1449834-F
  misc_feature (75)..(75): Xaa is any aa, unknown, or other
MLAIFQKQVAHAPQELNSPRAGASPSKPRNPDEILRDFHAAHPAAAFSASFGGGAALACVGPSSSATATGTATYXPTLCGLDHIYCVFLGRLDNLSGFIRQYGLGRPLPPRGDAGHRGLPHASRPGGLPGRTRSSRTPPAPFPSSGFQKPLRGPFFSGPPGPPKTGGSARGPVYLGGSSAQRDPPGGSRHPPG

SEQ ID NO: 45610 - DNA, 733 bp, Zea mays
  misc_feature: Ceres CLONE 1449837-F
ggagctccccgcggtggcggccgctctagaactagtggatcccccgggctgcaggaattcgcacgagaccattacctagaacatcctaatcgaaaaaccaactcttttaactcccttcctctccagggaaggaggccagaatcccccgtcgacgcgcacgcgccgtcgcgcagagctccgcgtccgcatcggccaccgcccacccgcgccggccgccggcggcgtggatggggaagctcgccgccctgaagcgggaagcggtcggggtggactaggtgctcggcgaattcctagtttagactttagaagcagtaggtggaggtgatgcggggcggagcgatgaaggctctgcggcgatccagcacctcctcgccgccgtcttccccgcattttcattcgtggatccaccgccggtacctcctcgttacctcgtcggcgacgtcctctttgtctgcatcggcgaattcggccgcggaggggtcggattcagcgtcagtggtggcagcttcctcgtccgcctcgttggatccttcgtctccgaacagggaccggggtgtaataaaatctccatggcctcgaagaaaaggaaacgagcgctcacctgtcaacccgggattcgtctattttcaccgaacgggaaattttcctgagggggaaagaaagtttctaaaaaaggtccccagggggggaattgaacccagcataagggctgaatttggcccattccggctgg

SEQ ID NO: 45611 - DNA, 731 bp, Zea mays
  misc_feature: Ceres CLONE 1449839-F
  misc_feature: Encodes the peptide sequence at SEQ ID NO. 45612
  misc_feature (394)..(394): n is a, c, t, g, unknown, or other
  misc_feature (396)..(396): n is a, c, t, g, unknown, or other
  misc_feature (438)..(438): n is a, c, t, g, unknown, or other
  misc_feature (625)..(625): n is a, c, t, g, unknown, or other
ctggagctccccgcggtggcggccgctctagaactagtggatcccccgggctgcaggaattcgcacgagaccattacctagaacatcctaatcgaaaaagttagtttcagccttcaggcttccagcgatgtgttcctgcgcctgcgcgcgcctcctcccccggctcttcagcctcgctccaagccccaatctcagacccgccttcccgcacagcccgacgccagcccgcagccgcgccgtcgtcgcgctcgcgggcgcagcctcccgggacgacgcgcctgcgccgttgtccagcttcgacttcctcgcactgaagcgggagcttgatgaaaaggagaagcagtggtggctgttgatgcaaaagacgtgctggagctgtcaatgaggacaatgnanagtgggtgcggaaacgaatgcgggtggtaccaagagaccgcngcggaagcaaatggccaagccatccgctctgctggcgaagcaggtgattagtgtgacctcggcgcggagtctcggggtcgtgtcgcaactctggatcgacaccgcctcggttgagagaacttcaccaaaatgtcccaaggaaatggatgaatatgctgggtgcatgtattactacccaacgaaatcnacttctgcctaaggagcagcaagcttttgaggaagcctgcccatttccgaggtaatcttgaaagtttacctgcaggggcttcccaaataagaaaaaagggaaaaaa

SEQ ID NO: 45612 - protein, 85 aa, Zea mays
  misc_feature: Ceres CLONE 1449839-F
MCSCACARLLPRLFSLAPSPNLRPAFPHSPTPARSRAVVALAGAASRDDAPAPLSSFDFLALKRELDEKEKQWWLLMQKTCWSCQ

SEQ ID NO: 45613 - DNA, 733 bp, Zea mays
  misc_feature: Ceres CLONE 1449843-F
  misc_feature (237)..(237): n is a, c, t, g, unknown, or other
  misc_feature (242)..(242): n is a, c, t, g, unknown, or other
  misc_feature (243)..(243): n is a, c, t, g, unknown, or other
  misc_feature (339)..(339): n is a, c, t, g, unknown, or other
  misc_feature (388)..(388): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (546)..(546): n is a, c, t, g, unknown, or other
  misc_feature (612)..(612): n is a, c, t, g, unknown, or other
  misc_feature (613)..(613): n is a, c, t, g, unknown, or other
  misc_feature (716)..(716): n is a, c, t, g, unknown, or other
tggagctccccgcggtggcggccgctctagaactagtggatcccccgggctgcaggaattcgcacgagaccattacctagaacatcctaatcgaaaaatgtcccactcccctctccctcctccagtcttccaaaatatctccctgcgcttttccgagtccttttccctccaaggaacagaaacaaccggagcttttaccccacccgctttcccctccccgccaggaacaacagggcntcctnncgcaataattccggtcccaattccattgggcggagctcgtcaacagctggtcgattcgtcgaccacacgaagcgccggcgccggaacgtcgctgcntgcgcgccgtgcttgcccaaatctttctccacttccctcttcggttttnaaccgggggtttccccccctccctttggccccccgggcccgcgggaaaccccgggaaggttattccaagtgggaacctgggggggggggggttttttccccacccccgggggggcccgggggggcccctttnnnaagaggaggggtgtaaaaatttcnggggggccaccccaacccccggggggagagggggaaatttttttttcgcgcccaaaaaaacaaaanngggggggggggtttttttttctccccccccaaggggggtggggccccccccccgggggttctcctccccccaaaaccccacggggggggtggtagagcccccnccaccccctttgggggg

SEQ ID NO: 45614 - DNA, 813 bp, Zea mays
  misc_feature: Ceres CLONE 1449844-F
  misc_feature: Encodes the peptide sequence at SEQ ID NO. 45615
  misc_feature (373)..(373): n is a, c, t, g, unknown, or other
  misc_feature (418)..(418): n is a, c, t, g, unknown, or other
  misc_feature (419)..(419): n is a, c, t, g, unknown, or other
  misc_feature (813)..(813): n is a, c, t, g, unknown, or other
aagctggagctccccgcggtggcggccgctctataactagtggatcccccgggctgcaggaattcgcacgagaccattacctagaacatcctaatcgaaaatccatatcttcttcttggtccgccgtctccactccgcgttccctggctccctgcgttgcgtcttgtgggagagagagaagtgggagacccgcgagaggctgccgtgtacggactagggaccgtatagtaagcgacagcgaaggagggagagggggatggccgggatcgggccgatcatgcaggactgggagccggtggttgtgcggaagaaggcacccaccgccgctgccaagaaggatgagaaggccgtcaacgccgcgcgccgttgtggngcggatatcgagaccatgaagaagttcaacgctgggtacacacanncccccgtccagcgggaaaatccatcaacaccaagcgccctcgacgacgacacagagaacctcgcccatggaccgaattccaagtggcctgaaaaaaaaatctcatgcaagcaaggctcgataagaaagttggacccggcaccagcttgcctcaaatgatcaatggagaaccccccgggggatcccagaatatgaactccgggaaaggcaatttccccaccccgccaaatcatttggtaagccccaagaggcgccctggggaaaccacaacttgctggggctagaaaatacaccccgcagccctctttaatcggaagaaacaagggcaacaactgtccggccttaataaattttgccatacggttgggggtatctccccagcgtcctgtgcgggn

SEQ ID NO: 45615 - protein, 106 aa, Zea mays
  misc_feature: Ceres CLONE 1449844-F
  misc_feature (9)..(80): Pfam Name: MBF1 Pfam Description: Multiprotein bridging factor 1
  misc_feature (54)..(54): Xaa is any aa, unknown, or other
  misc_feature (55)..(55): Xaa is any aa, unknown, or other
MAGIGPIMQDWEPVVVRKKAPTAAAKKDEKAVNAARRCGADIETMKKFNAGYTXXPVQRENPSTPSALDDDTENLAHGPNSKWPEKKISCKQGSIRKLDPAPACLK

SEQ ID NO: 45616 - DNA, 772 bp, Zea mays
  misc_feature: Ceres CLONE 1449850-F
  misc_feature: Encodes the peptide sequence at SEQ ID NO. 45617
  misc_feature (357)..(357): n is a, c, t, g, unknown, or other
  misc_feature (394)..(394): n is a, c, t, g, unknown, or other
  misc_feature (426)..(426): n is a, c, t, g, unknown, or other
acccgcggtggcggccgctctagaactagtggatcccccgggctgcaggaattcgcacgagaccattacctagaacatcctaatcaaaaacagcgaaaaccatcaatcctattcctctcctccgctagtagccgccaaatcgacgagaaggagccgaggccaggcctccaccaagtatcagattccacgccctacgaatcatcgcaatgacgaagaaacagcggagggaggcgggggcgatgcgacggcgagaccgacaccaccatcaccgggcgcagccgcgggacgagcgctgcgtttcctgcaccacgtttaacatcctggcgcccgatctacagcgcatggacaacgagattngcagggagagccagtacaggccctactgggtcagccngcaccgaaaaaataattgaccgcctttccggntgatccctccctcatcatctggcctacaggaggtatgtttggggaaccaacaaactggccaatttgaacccaaagggtctgggggaaacccaatataatgtgtctttaggtttggccccccccaaatttgggggaaggggtccttttttcgggggaaaaaaaaaaacccttccagttttttgattataagggaaacggtttttaaaagaacccggggggggggggacccccccgtgggtgggtgggagaaaacagggtgttttttttaaaaaaaaaaacaaccggtggggttcccccaaagaaccttgtgtggaaacctttttttggttccccccaaacacccccc

SEQ ID NO: 45617 - protein, 68 aa, Zea mays
  misc_feature: Ceres CLONE 1449850-F
  misc_feature (51)..(51): Xaa is any aa, unknown, or other
  misc_feature (63)..(63): Xaa is any aa, unknown, or other
MTKKQRREAGAMRRRDRHHHHRAQPRDERCVSCTTFNILAPDLQRMDNEIXRESQYRPYWVSXHRKNN

SEQ ID NO: 45618 - DNA, 746 bp, Zea mays
  misc_feature: Ceres CLONE 1449854-F
  misc_feature: Encodes the peptide sequence at SEQ ID NO. 45619
  misc_feature (562)..(562): n is a, c, t, g, unknown, or other
  misc_feature (746)..(746): n is a, c, t, g, unknown, or other
tggagctccccgcggtggcggccgctctagaactagtggatcccccgggctgcaggaattcgcacgagaccattacctagaacatcctaatcgaaaacaggccagaggattgttatgttttcgtatggcagtgggttgacatcaacaatgttctctttcaagattaaagaaggccatcaccctttcagcttgctaaacattgcaaacataatggatgtttccaagaaattgaaggcaagacatgtggtcccgccaaagaaatttatcgaggtactgaaactgatggagcaccggtatggggcgaaagatttcgtgaccagtcaagacacaagtttgctatctgtaggcacatattatctcacgcacgttgactccaagtaccgaaggttctatgacgtgaaaggtgaccgcgtcaccactactgcaatgtccaacggccactgatctgtcttctgcccggagctgcaacaagtcaaataacagaggcaggtgttcctaagcattctgactcttcttagattatctattaggaggggacgctggagcttagattaatctctgncaagttgtaagggtgtaaagttagtaagagctggctccattgctgaaatggcttggctggtaaaaagttctgggggctcttcagttcttcacggctttgcaaaatcaaaaacaagctccccacccggggtgtaaggaattctgaaataacctgcaggaacccctgggttactcccaaaaacaan

SEQ ID NO: 45619 - protein, 109 aa, Zea mays
  misc_feature: Ceres CLONE 1449854-F
  misc_feature (1)..(96): Pfam Name: HMG_CoA_synt_C Pfam Description: Hydroxymethylglutaryl-coenzyme A synthase C terminal
  misc_feature: SWISSPROT Homolog: EC 2.3.3.10 Hydroxymethylglutaryl-CoA synthase
MFSYGSGLTSTMFSFKIKEGHHPFSLLNIANIMDVSKKLKARHVVPPKKFIEVLKLMEHRYGAKDFVTSQDTSLLSVGTYYLTHVDSKYRRFYDVKGDRVTTTAMSNGH

SEQ ID NO: 45620 - DNA, 772 bp, Zea mays
  misc_feature: Ceres CLONE 1449856-F
  misc_feature: Encodes the peptide sequence at SEQ ID NO. 45621
  misc_feature (340)..(340): n is a, c, t, g, unknown, or other
  misc_feature (345)..(345): n is a, c, t, g, unknown, or other
  misc_feature (397)..(397): n is a, c, t, g, unknown, or other
  misc_feature (412)..(412): n is a, c, t, g, unknown, or other
  misc_feature (441)..(441): n is a, c, t, g, unknown, or other
ctggagctccccgcggtggcggccgctctagaactagtggatcccccgggctgcaggaattcgcacgagaccattacctagaacatcctaatcgaaaacccgtcccgtccgctgctggctctgcatatcccgcgcccgactcccgttgctgcgtgcggcggcccgactagtcgcgccgcgctcgggctcggcttgattgaaccggccgggatgggggtgttggaggacctcgtggcgagagcgggcgggtgcgcggtcatcgacggcggcttcgccacgcagctagaggcgctcggcgccgacatcaacgacccgctctggagcgccgcttgcctcatcnacagnccgcacctcgtcaaggaggttcatatgcagtatcttgaagctgggtgcgacntcatcatttctcatncttacaggcaaccatcccgggtttcatanctagaggaatgtctgtccctgaggccaaaaatttactgcgaaacaatgtaaaactggccaatgaagctccgaatgattttggaagccaaccctgagggaaccccaccttttttccaccgggcctgggtggccccaccctgggaagcccggagcccttttctggaaggggccggaaaccgggggatataaggggtggaaaccccccccaaaaggtggagttcttcccggccccgggggggtttttaagaagccgccccccactgtttttttgagaccccccccaaagggggcgccccgtttgttctccttttggaaaaaaaaacccccctcc

SEQ ID NO: 45621 - protein, 93 aa, Zea mays
  misc_feature: Ceres CLONE 1449856-F
  misc_feature: SWISSPROT Homolog: EC 2.1.1.10 Homocysteine S-methyltransferase
  misc_feature (44)..(44): Xaa is any aa, unknown, or other
  misc_feature (45)..(45): Xaa is any aa, unknown, or other
  misc_feature (63)..(63): Xaa is any aa, unknown, or other
  misc_feature (68)..(68): Xaa is any aa, unknown, or other
  misc_feature (77)..(77): Xaa is any aa, unknown, or other
MGVLEDLVARAGGCAVIDGGFATQLEALGADINDPLWSAACLIXXPHLVKEVHMQYLEAGCDXIISHXYRQPSRVSXLEECLSLRPKIYCETM

SEQ ID NO: 45622 - DNA, 717 bp, Zea mays
  misc_feature: Ceres CLONE 1449858-F
  misc_feature: Encodes the peptide sequence at SEQ ID NO. 45623
  misc_feature (467)..(467): n is a, c, t, g, unknown, or other
  misc_feature (579)..(579): n is a, c, t, g, unknown, or other
  misc_feature (620)..(620): n is a, c, t, g, unknown, or other
tggagctccccgcggtggcggccgctctagaactagtggatcccccgggctgcaggaattcgcacgagaccattacctagaacatcctaatcgaaaactgatgtctccatcctgctcgacaacgaggccatctatgacatctgcaggcgctccctcgacattgagaggcccaactactccaacttgaatcgccttgtgtctcaggtgatctcatcgctgactgcttctctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagcgggcttccatgatggtcaagtgcgacccacggcacggcaagtacatggcttgctgcctgatgtaccgcgncgacgtggtgcccaaggacgtgaacgcccgcgtagccaccatcaagacgaagcgcaccatcccagtcgtggactggtgcccgacggggttcaagtgcggcatcaactaccangcgccgaacagtggtgccggtgccgacctcgcaaggtgcancgtgcgtgtgcatgatctccacctccacagcgtcgtcgaggtgtctcccgctcacagcaagtcgactcatgaccccagcgcgcgtcgtgactgtact

SEQ ID NO: 45623 - protein, 137 aa, Zea mays
  misc_feature: Ceres CLONE 1449858-F
  misc_feature (1)..(128): Pfam Name: Tubulin_C Pfam Description: Tubulin/FtsZ family, C-terminal domain
  misc_feature (54)..(54): Xaa is any aa, unknown, or other
  misc_feature (91)..(91): Xaa is any aa, unknown, or other
  misc_feature (105)..(105): Xaa is any aa, unknown, or other
MLSSYAPVISSAKAFHEQLSVAEITSSAFERASMMVKCDPRHGKYMACCLMYRXDVVPKDVNARVATIKTKRTIPVVDWCPTGFKCGINYXAPNSGAGADLARCXVRVHDLHLHSVVEVSPAHSKSTHDPSARRDCT

SEQ ID NO: 45624 - DNA, 677 bp, Zea mays
  misc_feature: Ceres CLONE 1449859-F
  misc_feature (444)..(444): n is a, c, t, g, unknown, or other
  misc_feature (481)..(481): n is a, c, t, g, unknown, or other
  misc_feature (599)..(599): n is a, c, t, g, unknown, or other
tggagctccccgcggtggcggccgctctagaactagtggatcccccgggctgcaggaattcgcacgagaccattacctagaacatcctaatcgaaaaatgaatggcgtttatttaagtctccaccctccgccccggggaactcttttctgtgtatcgcggaattttttgggttctcgggcttccgccgcgatcccatcccatccccgccttgccgttgccgttgccggcctccccggttctcccggagttttctttctggccggcgcagtagagaagcgagacagaattgcggcggcgcctgcccgcgcaaaggaataatcagcactgtttgccaaaggcagctcctgacgcatggctagtactctaggatactttatgtgcagaccatgaagatagatgacgaaaggccttacaaaactcatatttttcatgatcttgcatcntaacgcagtccctaattagactgtgaggctgaaagancaagtatcaccaaggtgaagcagataaaatggttgagcaaacaatcaatctgaagtagctttgtgaaagctgagctctgaatggaggtaaattcggaaagacacccttgaggatactnccatgacaggatgttgtagagatcaactgccaaccccgatcttccttctgatacggggtcatttgtcaaggatgctgc

SEQ ID NO: 45625 - DNA, 735 bp, Zea mays
  misc_feature: Ceres CLONE 1449861-F
  misc_feature: Encodes the peptide sequence at SEQ ID NO. 45626
  misc_feature (304)..(304): n is a, c, t, g, unknown, or other
ggagctccccgcggtggcggccgctctagaactagtggatcccccgggctgcaggaattcgcacgagaccattacctagaacatcctaatcgaaaaatccatccattgttttcgtctcttgcggccttgccccacccataaagccgatgggttagctcccccgcaccgcacgcccaagaacacagaggagccgacgccacggcgacggtcgtcctctcccggccagcaccgtcgcggactgcgtttcatccgtgcctttgcttctctcttcaccccgcgtctctctctcttggcgacgactggnggaccactgccgccgctcaagccaggtagtcccttcgccggcgacgagcacccactagttttgtgatcagtgaaaatggctgctgctgaagcaggggctgcttggcaacgcgctgcaaaccgttgcctggttcagggagacaggaagagagctcccaaactagcttgctgtccatcatcggctgaacaacatgtgcggttcaatattttttctagcagtagcacaaccggattggaaagcaaacaacactccagaatggctctgagcgagacatgattttggaggcactccgccatcacaaactcgtgctagagaagctgatatgggcgctagaaagcgtacatgagaaggacgacgtcatcaagcttttgctccgaaggcctccatctctttgcgtgaaccggtgctgaaaatatgcagctggaaatatt

SEQ ID NO: 45626 - protein, 66 aa, Zea mays
  misc_feature: Ceres CLONE 1449861-F
MAAAEAGAAWQRAANRCLVQGDRKRAPKLACCPSSAEQHVRFNIFSSSSTTGLESKQHSRMALSET

SEQ ID NO: 45627 - DNA, 772 bp, Zea mays
  misc_feature: Ceres CLONE 1449863-F
  misc_feature: Encodes the peptide sequence at SEQ ID NO. 45628
  misc_feature (419)..(419): n is a, c, t, g, unknown, or other
  misc_feature (420)..(420): n is a, c, t, g, unknown, or other
  misc_feature (424)..(424): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
ggagctccccgcggtggcggccgctctttactagtggatcccccgggctgcaggaattcgcacgagaccattacctagaacatcctaaaaaaaagaaaaacacaagacctcctattcaccatgccgaccgaagagggttccgacggcggtggcggcgccggagccggagccggggagaagaagagctcgcaggcgcccgcaaagcctggagcgtgcggcgccgcaaagttcctcgcggggttgccgtcgcgcggcaacttctcttcggctccgccccctccaatctgggagggttcaggatttacgtctgcgagcacagcaccaatccccccaaagggacaagttataaagacggatttcacgaataatttaatcaggggtgttcggttgaaaaagtaaaaaattttacttacccaccnnaaancaaaaatgttnnnnaaaaaaaaaaaaggaaaaaaacctgccgcccaaagtttggggggcacccaattcagcagagaaggggaattgggaacctcccccggacctcccgccttggggaaaatttcgggtttttcacccccccccggggcttttttacggggggaaatgaggggggcttttcgtccaaggtgcgcccctcccccacgctaaaggggcaccccgcctccccccccccgaactccccgcgcacgatcgttgcctttcgtttttgtcacccccctccttcgggggggtccccacacctaaaacacggggcccttctgcgggctggcctcacggaaaaggtggg

SEQ ID NO: 45628 - protein, 92 aa, Zea mays
  misc_feature: Ceres CLONE 1449863-F
MPTEEGSDGGGGAGAGAGEKKSSQAPAKPGACGAAKFLAGLPSRGNFSSAPPPPIWEGSGFTSASTAPIPPKGQVIKTDFTNNLIRGVRLKK

SEQ ID NO: 45629 - DNA, 760 bp, Zea mays
  misc_feature: Ceres CLONE 1449864-F
  misc_feature: Encodes the peptide sequence at SEQ ID NO. 45630
  misc_feature (356)..(356): n is a, c, t, g, unknown, or other
  misc_feature (433)..(433): n is a, c, t, g, unknown, or other
  misc_feature (437)..(437): n is a, c, t, g, unknown, or other
  misc_feature (593)..(593): n is a, c, t, g, unknown, or other
  misc_feature (632)..(632): n is a, c, t, g, unknown, or other
  misc_feature (633)..(633): n is a, c, t, g, unknown, or other
  misc_feature (640)..(640): n is a, c, t, g, unknown, or other
  misc_feature (641)..(641): n is a, c, t, g, unknown, or other
  misc_feature (660)..(660): n is a, c, t, g, unknown, or other
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacngcgggtgcaagtgcggcggcaactgccagtgcgaccccctgcactgcggcaagtgagctaggtgctccaccctgcangccnggccggagaagctagctaattattttatagctaataaagtatagcggcgtcgctgtgtgtgtttcgagtcagtcagtcagttagttgcgtgccatggctggcatgccctgagtctgaaatgatgatgatgcctgatggccgcgtcctgtcctgtantcctcccctgccccctcgggcgcttctgggcgcaagcanngggttgnngtgggttgggggggtgcancaccgtaacaagctaactatgtgccctgcttggttggggcaccatccatctataataatcttatatcctaacccaaaaaaaaaaaaaaaaagcttatcgt

SEQ ID NO: 45630 - protein, 82 aa, Zea mays
  misc_feature: Ceres CLONE 1449864-F
  misc_feature (1)..(80): Pfam Name: Metallothio_2 Pfam Description: Metallothionein
  misc_feature (65)..(65): Xaa is any aa, unknown, or other
MSCCGGNCGCGSGCKCGNGCGGCSKMYPDMAEQVTTTTQALIMGVAPSKGHAEGGFEAAAGAENXGCKCGGNCQCDPLHCGK

SEQ ID NO: 45631 - DNA, 783 bp, Zea mays
  misc_feature: Ceres CLONE 1449866-F
  misc_feature: Encodes the peptide sequence at SEQ ID NO. 45632
  misc_feature (403)..(403): n is a, c, t, g, unknown, or other
aagctggagctccccgcggtggcggccgctctagaactagtggatcccccgggctgcaggaattcgcacgagaccattacctagaacatcctaatcgaaaaatctccttttccggtcttcccgaccgagcgatccagccagcgagaggttgcgagaagtagccgccggaggagcacgccaaggccgccgcctacgaggacggccatggggttctgggtgaccacgctcatctttctcctcgccggcgtcgccgcatccctcttcacgctcctctgctgcaaccgcgggccctcccacaacctattccatttgactttggtgactacagctgtaattttgttgtggatgatgtatgctatcgtttaccttgctcaaatcgagccttgatcaaccccatcctgancggggagtgatctctcctcttgcttaaaaggaatgaagctaggcctgctgaacattattcaggctggggactttccattcctttgcccccccgggggaaaaaaaaaacggccgggagttttttttttttgcccccctcccccgaaaatttagaaagcccccgggttttgggggccccttttttttaacccccaaaaaaaaaacctcccaaattgtggggcgcggcctggggggggtaaaaaaaaaaaaaatttttttttcccccccccccggggggggggcccccccccccccccccaaaagggagaaatcacgcccccccggggcttttttttacacccggggggaaaaaacattttttcttatttttttttttttttc

SEQ ID NO: 45632 - protein, 60 aa, Zea mays
  misc_feature: Ceres CLONE 1449866-F
  misc_feature (1)..(60): Pfam Name: ATP_synt_H Pfam Description: ATP synthase subunit H
MGFWVTTLIFLLAGVAASLFTLLCCNRGPSHNLFHLTLVTTAVILLWMMYAIVYLAQIEP

SEQ ID NO: 45633 - DNA, 743 bp, Zea mays
  misc_feature: Ceres CLONE 1449868-F
  misc_feature: Encodes the peptide sequence at SEQ ID NO. 45634
  misc_feature (301)..(301): n is a, c, t, g, unknown, or other
  misc_feature (417)..(417): n is a, c, t, g, unknown, or other
ggagctccccgcggtggcggccgctctagaactagtggatcccccgggctgcaggaattcgcacgagaccattacctagaacatcctaatcgaaaacagacccttgttctttcttcgacgcgcccccgggcatggcgaaccgcagtgttgccatgggcgtggccctcgcgttcgtggccatgaccgcgctctgttgcgcgccgggcgccgcggagttgcccaggctggaccacccggccaggagcgacggatcgctgaagctgctcgtcgtcggggactggggacgcagggggactcacanccagtcccgggtcgccgaccagatgggaagggtcggggagaagctcgatatcgacttttgtatatccacccgcggacactgcgtacaggacggcctcaagggcgtgcgcgaccagncatttgaagaaatcgtcgtggatatctacacagctcaaagcttacagaagccatggtactcagtttctagaaatcatgattacaggggcaatgcgctcgcacagcttagcccagtcttgagaagatcgacgaccgattcatttgcatgagatcgttcatcgttaacgcagaacttgtggacttcttcttggtcgacacactccgttcaactggatattggactcccctggcaggatcgttatactggaaaggggtgcgcctcaggcagtactagccaattgctgaagatctgatgtgcttgagaatcactgcaagtggagatgtgg

SEQ ID NO: 45634 - protein, 144 aa, Zea mays
  misc_feature: Ceres CLONE 1449868-F
  misc_feature: SWISSPROT Homolog: EC 3.1.3.2 Acid phosphatase
  misc_feature (57)..(57): Xaa is any aa, unknown, or other
  misc_feature (96)..(96): Xaa is any aa, unknown, or other
MANRSVAMGVALAFVAMTALCCAPGAAELPRLDHPARSDGSLKLLVVGDWGRRGTHXQSRVADQMGRVGEKLDIDFCISTRGHCVQDGLKGVRDQXFEEIVVDIYTAQSLQKPWYSVSRNHDYRGNALAQLSPVLRRSTTDSFA

SEQ ID NO: 45635 - DNA, 732 bp, Zea mays
  misc_feature: Ceres CLONE 1449869-F
  misc_feature: Encodes the peptide sequence at SEQ ID NO. 45636
  misc_feature (375)..(375): n is a, c, t, g, unknown, or other
  misc_feature (492)..(492): n is a, c, t, g, unknown, or other
ctggagctccccgcggtggcggccgctctagaactagtggatcccccgggctgcaggaattcgcacgagaccattacctagaacatcctaatcgaaaaatcggccatcgcagtttcacagacagcatccattccacagtcaccagagcactagagcagagcaacaaccgacaagagcagagtgagatcgtcgtcagcgagcccagcagatacgagagagaggatggcggacatcgcgttgctggtggcggagcagttcgagaagacggcaaggcgaggcgcccccggcggggacagcggcagcagcagcgggagcggcggcgagacaaggaacttcggggccgtgggccaggtgtggagctcgtgggtggagtcngcctccccgcgcgcgtccggggtcagattcaccgtcgcggtgcagctggagcccaagaccgggctcgcgctggccgctggcgacggcctctttctcgcctagcttcctggctgcttncatgtctttctcctgagcagtgccagtgatcgagcgagtcctgctcctgcacccgtactatgcttgtgcgacctggacatttcgttcgtcgttgcccaggtgcgcctgcgctctaatccggaacaaatactattcatatttggtcagaactccattcatgaaaaaaaaaaaaaaaaaggttatcgataccgtccaccccgaggggggcccggtaccaattcgccttatagggaggcgaat

SEQ ID NO: 45636 - protein, 84 aa, Zea mays
  misc_feature: Ceres CLONE 1449869-F
MADIALLVAEQFEKTARRGAPGGDSGSSSGSGGETRNFGAVGQVWSSWVESASPRASGVRFTVAVQLEPKTGLALAAGDGLFLA

SEQ ID NO: 45637 - DNA, 786 bp, Zea mays
  misc_feature: Ceres CLONE 1449874-F
  misc_feature: Translation starting site: 182
  misc_feature (278)..(278): n is a, c, t, g, unknown, or other
  misc_feature (375)..(375): n is a, c, t, g, unknown, or other
ctggagctccccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcnggctgatcaaggtgaaacgcgtcccgattgagctcatcaggccggagatgctccgcctcaaggccttcgagcccatcctgctgggcgggcgctccangcttcaagacatcgacatgaggatcccgcgtccaaagccgccggaagaattcccaaatctacgccattcgccagggcgttcgcaaaggggtcgtcccctactaccaaaagtaccttcaacaagccccccaaaaagggaggcaagagattttttccccgggtaaaaacgaacctttttctttccccaaacccagggttttgaaaccaaaaaatttccgggggcccgggcccccgccccagtttccaaaaaccacacctttaaagctttggttcccccccttttccaaacaaaatccgtgtttgcccccaatttccatttaaaccgggcccccggggttttttttctccccggccctcttttgggggttaaaaaaaaggggtcttaccccaggggggggggggcccataatta

SEQ ID NO: 45638 - DNA, 800 bp, Zea mays
  misc_feature: Ceres CLONE 1449875-F
  misc_feature (278)..(278): n is a, c, t, g, unknown, or other
tggagctccccgcggtggcggccgctctagaactagtggatcccccgggctgcaggaattcgcacgagaccattacctagaacatcctaatcgaaaagaacatcacaaggccgcgaacctcctagaagctcgaggagatgctgctctccaagctgtcggcgtggttcgtgaacccgcggaggaatccgctcgcgcgtctccaccggaacgccgtcgcctcccgcctcccgcaatacgggctccggtatgacgacctctacgacccgtacacgacctanacatcaaggaggcgctggcccggctgccgcgggaggtggtggacgcccgtaaccagcgcctcagggggcctgggacctttcctggaaccaccattacttcccgaagacctccaggttttaggggccccccccagacctccctttttaatggttgccctgggaaaaaggaaaccccaaagggggaactttggggcccctcccccccccaaaaaaccccccaaaagggcccctttgcggggcccccacaatgggcccctattttacaaagaggggaaccgggggtgtggtttggtttttttggggaaccctccctccttttataaaaaaggggggccccccctcttctctttttttcctcttaaaaaaaaaaaaaaaattttctctcttcccccccccggggggggggcgcccacccctccccccccaagtggtgtattttcccccccccgggggcggcggttttatctcgggggggggagggagggagtgggggtctccatatttgttgtgggggcgcccccc

SEQ ID NO: 45639 - DNA, 902 bp, Zea mays
  misc_feature: Ceres CLONE 1449876-F
  misc_feature: Encodes the peptide sequence at SEQ ID NO. 45640
  misc_feature (11)..(11): n is a, c, t, g, unknown, or other
  misc_feature (16)..(16): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (377)..(377): n is a, c, t, g, unknown, or other
  misc_feature (492)..(492): n is a, c, t, g, unknown, or other
  misc_feature (532)..(532): n is a, c, t, g, unknown, or other
  misc_feature (797)..(797): n is a, c, t, g, unknown, or other
tttctatgggnacccnaaccaccnnnnnnnnnnnnnnnnnnncaaagctggagctccccgcggtggcggccgctctagaatagtggatcccccgggctgcaggaattcgcacgagaccattacctagaacatcctaatcgaaaacccaactgtcaggcgccgcgatggaggctctccacgaggagatgcccttcgacctcgacttccacccgtcgtctccgctcgtcgtcacctccatcatcaccggagagctctgcctgttccgctacggcccggagtcgcagcctgagaggttacttttgttaaaagcccacaaggattcatgcggaggctgttcattttgtccactcaggaaaagagaatttgtcaggtacatntaattgatcagttccttgcctccgggtgttgggtgggggtgaagatttttgggggtttgggaggatgttggtgtagatgtcggactaccccgccattggtcctgactttcttgtnttccttaatttgggccccctgctcgatgcaccaccccccncccaatacccgctaccctaataccccctgagaaggcaattcttttcattgtactcctcttttggaagatacccatcattgaatttacatattttctggatttgtagagtgatgtagcttcggagataaaaatatcaaaatcatactcagtccgcggccgatttcgcacactttctcttggcgaaagccacccgcttgccgatatgaagctcgggcgacccaatacggatattgtccagaagaacctaactcgcccttcccaccgnctgcccagcacaccctccgtccagaacgtacacccgacgcgcaccccccacgagcgaaccacactatcataaggcgccggcgcggcaatacatcagtaccattgt

SEQ ID NO: 45640 - protein, 70 aa, Zea mays
  misc_feature: Ceres CLONE 1449876-F
MEALHEEMPFDLDFHPSSPLVVTSIITGELCLFRYGPESQPERLLLLKAHKDSCGGCSFCPLRKREFVRY

SEQ ID NO: 45641 - DNA, 766 bp, Zea mays
  misc_feature: Ceres CLONE 1449877-F
  misc_feature: Encodes the peptide sequence at SEQ ID NO. 45642
ggagctccccgcggtggcggccgctctagaactagtggatcccccgggctgcaggaattcgcacgagaccattacctagaacatcctaatcgaaaaagttcgttccctcctctgtgtaccggccagtaaaatccgaacccacagcgagaaatggcggcggcagcgctccgtccggcgatcctccgccgcatccgcctctccccctccccttcgctcgccctcgccgccgctgggacaggtgcatcccacccgcacgcgctggggcggtggctcgcgcggcccatgtcctcccacgacgcgcacctcacccgcgacgaagtcatcgaccggatcctcgacgtcatcaagagccaccccaagatcgacccctccaaggtgaccccggaggcgcacttcgagaaggatctggggctcgacagcctgaacaccgtcgaggtggtcatggccctcgaggaggagttcaagctcgagatcccagacatggaggctgacaagatcgactcactccctctgggcatcgagtaactcgccaaccaccccatggctggctgagcctctgctcgcccgagaggaggcgagttgaagtgaggcttccccttggttttgttttccaagggcaattatctgctggaagggcacagaaaaacttggtcctgggggtcctgcttggctccacggggaggaatgataatgtcaaaatggaactttaacatttttccgccgttaaatggttgtttttgtgtgcgggggtaaatccataaaaacg

SEQ ID NO: 45642 - protein, 124 aa, Zea mays
  misc_feature: Ceres CLONE 1449877-F
  misc_feature (59)..(116): Pfam Name: PP-binding Pfam Description: Phosphopantetheine attachment site
  misc_feature: SWISSPROT Homolog: EC 6.1.1.13 D-alanine--poly(phosphoribitol) ligase
MAAAALRPAILRRIRLSPSPSLALAAAGTGASHPHALGRWLARPMSSHDAHLTRDEVIDRILDVIKSHPKIDPSKVTPEAHFEKDLGLDSLNTVEVVMALEEEFKLEIPDMEADKIDSLPLGIE

SEQ ID NO: 45643 - DNA, 747 bp, Zea mays
  misc_feature: Ceres CLONE 1449880-F
  misc_feature: Encodes the peptide sequence at SEQ ID NO. 45644
  misc_feature (357)..(357): n is a, c, t, g, unknown, or other
  misc_feature (378)..(378): n is a, c, t, g, unknown, or other
tggagctccccgcggtggcggccgctctagaactagtggatcccccgggctgcaggaattcgcacgagaccattacctagaacatcctaatcgaaaaaatcggccccatcactcttccgtcgtgtcttctcgcgctttccactcccaacgagatccatcacccccgacctctgtaagcttcccttgacgtcgtcgtcgtcatccatggagagcaaggacggcacccacgatcccgccacgacggccgcgccaccggccggcgcgccgcagcccgcgatgccttccgcggagacggcgcggtggggcacgcggcagatgggcccgcggcggcccccggggcgcacccggagaacaggnagcggggcgttggacggcccncgcgggaaccaagagctgccgccgtacgtcatcatcggtgagcctgtggcggcgccgccgcacagcataggggcagggggacagcccctggagcaatcctcgacttctcaaacctggagcccaaggccaagagttgcctccagcttctgtttcaatcggaaggcgcgcatccatgtccgacgccccaatggggaacttaccctccgccccaaagctctgtccgaaggcggcttcaaaaattgtaaaaacagaattttctcgtcagccccgacgaaaactctgaaaaaaaagttcgcttgttacctcttcagggccaggggccccgtcccgggacctttttacttgaacaaactgaacagtcccctttcg

SEQ ID NO: 45644 - protein, 181 aa, Zea mays
  misc_feature: Ceres CLONE 1449880-F
MESKDGTHDPATTAAPPAGAPQPAMPSAETARWGTRQMGPRRPPGRTRRTGSGALDGPRGNQELPPYVIIGEPVAAPPHSIGAGGQPLEQSSTSQTWSPRPRVASSFCFNRKARIHVRRPNGELTLRPKALSEGGFKNCKNRIFSSAPTKTLKKKFACYLFRARGPVPGPFYLNKLNSPLS

SEQ ID NO: 45645 - DNA, 712 bp, Zea mays
  misc_feature: Ceres CLONE 1449881-F
  misc_feature: Encodes the peptide sequence at SEQ ID NO. 45646
  misc_feature (177)..(177): n is a, c, t, g, unknown, or other
  misc_feature (311)..(311): n is a, c, t, g, unknown, or other
  misc_feature (392)..(392): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (401)..(401): n is a, c, t, g, unknown, or other
  misc_feature (411)..(411): n is a, c, t, g, unknown, or other
  misc_feature (412)..(412): n is a, c, t, g, unknown, or other
  misc_feature (480)..(480): n is a, c, t, g, unknown, or other
atagctggagctccccgcggtggcggccgctctagaactagtggatcccccgggctgcaggaattcgcacgagaccattacctagaacatcctaatcgaaaaagtacaaggctacaagcctacaagcaaccgcgtccgcgtgtggagcaaggaaggataggggagcgagcgagcgancaaccggcggcgacagccatggcggagcagcacaaggaggagtcgggcgtgacagtgctggacaagatctccgacaagctccacgggcgagggggcggctcgtcctcttcgtcggactcgacgacgagcgctcntcggcgattgtcgccgtgaaggccaagatctaccgcatcttcggtttttattacccccccccccggggacagaaagggggnaaannnncnatttttttcnnttgggggaaaagaagaacaccggccggcggccccgcgggcgcgcgggcctcctggttgctgtttaaantcctggattaccccccccccccccgctaggccctgcgccatccccacccgggcctcccgttccccggggcaaagcctccccctttctcaaccagtgatcctcctaattccccgagggaaaaatcccaaagaccccgcctggttgggggccccttccacccaaatacacccaaggggtatcgcaccctcgcaggcgacggagcagccaccttctccccctctgttgtttttct

SEQ ID NO: 45646 - protein, 44 aa, Zea mays
  misc_feature: Ceres CLONE 1449881-F
  misc_feature (39)..(39): Xaa is any aa, unknown, or other
MAEQHKEESGVTVLDKISDKLHGRGGGSSSSSDSTTSAXRRLSP

SEQ ID NO: 45647 - DNA, 758 bp, Zea mays
  misc_feature: Ceres CLONE 1449882-F
  misc_feature: Encodes the peptide sequence at SEQ ID NO. 45648
  misc_feature (134)..(134): n is a, c, t, g, unknown, or other
  misc_feature (342)..(342): n is a, c, t, g, unknown, or other
  misc_feature (343)..(343): n is a, c, t, g, unknown, or other
ggagctccccgcggtggcggccgctctagaactagtggatcccccgggctgcaggaattcgcacgagaccattacctagaacatcctaatcgaaaaaaaaaagcccaaaccccaggcggtcgctctgtattttntctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaacgtcttnnctcctcatcgccccaccccaccttgcggtcgtctccgggatcgtgtacgacgtcatcgttgagcccccctggcatcggcagcgcccaggacccgggcattggggccgttcggccccgtccgtcttcctttcaagggggggtcaacggccagtaaatctccgagggactccccctcccgggttcatggtcctcccttgggcggattgggatcatccttcctcaaactccccgtcaaccgaagaagccccgggaagctcccgggtcttcgtttggagccgccggggcacatccccggttggcataccccctacgccatgggcatgctcttcctcccgaatcaaaatccccgggtaccctcccggggggggtgaaaaaatcttgccgggtaaaataaacccaaatcccgccgggagaa

SEQ ID NO: 45648 - protein, 82 aa, Zea mays
  misc_feature: Ceres CLONE 1449882-F
  misc_feature (62)..(62): Xaa is any aa, unknown, or other
  misc_feature (63)..(63): Xaa is any aa, unknown, or other
MPPRSDHAAGSGAAAAATQAHFDSIDPLFHVLRVLPFSFLLPPRTRLRLPSNLALPSPMNVXXPHRPTPPCGRLRDRVRRHR

SEQ ID NO: 45649 - DNA, 724 bp, Zea mays
  misc_feature: Ceres CLONE 1449883-F
  misc_feature: Translation starting site: 385
  misc_feature: Pfam Name: Dabb Pfam Description: Stress responsive A/B Barrel Domain
  misc_feature (286)..(286): n is a, c, t, g, unknown, or other
  misc_feature (523)..(523): n is a, c, t, g, unknown, or other
ctggagctccccgcggtggcggccgctctacaactagtggatcccccgggctgcaggaattcgcacgagaccattaccagaacatcctaatcgaaaaacctgataatcatttctgggatcatttctcaggtcgcgcagcaaagtagcaaactcctgcgaccctacccaccgcacctaccattctggagaggagaggaacagagccaagaaacaagcccggaagatggcaggcggcggggtggtgaagcacatcctgctgggcagcttcaaggaggaggtgacgcangagcgcctggacgagctcatccgcggatacgccgcgctcgtcggcgtggtcccctccatgaagccttccactggggaactgatgtgagcatagaaaacatgcatcaagggttcacgcacgtcttccagtccacgtttgaaagcacggaaggaatcaaagagtacattgagcaccctgcacacgtcgaattcgcaagtgtgttcttgcctgtgctggagaaggtccctcatatcgacntacaaccgacgtcggccaattagtggtagaacatgctctgtacttgtccctcgaggatccaggttgggtccactctttattttgctaaataaactcggtctgctttgtcccttgttaagaatgagctttgagttttcggtattgcaattgttggaacctcccctgttttcctatggaaataacgttcctaaagaccggatt

SEQ ID NO: 45650 - DNA, 760 bp, Zea mays
  misc_feature: Ceres CLONE 1449887-F
  misc_feature: Encodes the peptide sequence at SEQ ID NO. 45651
ctggagctccccgcggtggcggccgctctagaactagtggatcccccgggctgcaggaattcgcacgagaccattacctagaacatcctaatcgaaaaatcgtctgacacactctatacctcatcccgtcagccacatctctacctatctgtgcacatgcaatgcgtgccaagttgacctggtggtggaggtcaaggccccggctgacaagactgtgggcggggctgcgtgcctcgacggagctgttccccatcatcttcccccaccagtaccccatcatcgagaccgtccatggccacagcaaggcagcgggcaccgaccgcctcctcgagtacacctgaggcggtgccgatgctgactttctgatacgacaaccttgagacgcttgacgacgataacaacgtggtgtcgaacaacacgaagtacagcaagctgccgaacttctaccttatcgttcatatcacactataagtagactccggacacctgctgagtgcgacgacatcgccctcgtcagctgtgccatgaagttcgactaggcctaccaccacatgcctgaccctgacttcatctgagaaactgcgtccaagaccttcactacctctacgactacctcctcaagagctacatggagcgactactgcacatggtccaatacagtacacttgcggtccattcatcgacgcgtcacagtctactagggcacccccctcgtgtgaagttgggcttggtgcctgctggtcccttaattgcttgctac

SEQ ID NO: 45651 - protein, 59 aa, Zea mays
  misc_feature: Ceres CLONE 1449887-F
MRAKLTWWWRSRPRLTRLWAGLRASTELFPIIFPHQYPIIETVHGHSKAAGTDRLLEYT

SEQ ID NO: 45652 - DNA, 751 bp, Zea mays
  misc_feature: Ceres CLONE 1449889-F
  misc_feature: Encodes the peptide sequence at SEQ ID NO. 45653
  misc_feature (414)..(414): n is a, c, t, g, unknown, or other
aaagctggagctccccgcggtggcggccgctctagaactagtggatcccccgggctgcaggaattcgcacgagaccattacctagaacatcctaatcgaaaaaaaaaacccctacatcctgccatccatccgcggtccgccgccgccgccatctcctcccactctcttccccccactcctaccaaaccctattcaatatccatttctccatccatggcgtggcgcggccccgccacccgggccgtcctcgccgccgtccgccgcccggcagcggccgcgcgcctccacgccccgcgccgccgcgtcccgcccgccttcgccaccacctcctccccgctcccgtccgcgcggcctctggcggcgttgatggggtccccggtgacggtggccgcggtgatggcgcgcctcacggcncatcccggcgccagcgcgcgcgcgtgctgcgagctttcccagggaaaacgaaaagatgggtgatgcaagagaggccatcgtagagcctgcccaaagtacttgaatctgttgtgtagaccccatcctttcgaaaggataatgatgtatcttttggggaataaagctattatggcatttcttcacagcaaagttcgagaaatacccacaatagctagtttcctcgttaggattcgagaagccttataattttaacgtacatgcatggttttgttgtgtaaacagctatgacgaataatttaatggtggttcactgagtaaaggatgttgcacagatgtt

SEQ ID NO: 45653 - protein, 87 aa, Zea mays
  misc_feature: Ceres CLONE 1449889-F
MAWRGPATRAVLAAVRRPAAAARLHAPRRRVPPAFATTSSPLPSARPLAALMGSPVTVAAVMARLTAHPGASARACCELSQGKRKDG

SEQ ID NO: 45654 - DNA, 801 bp, Zea mays
  misc_feature: Ceres CLONE 1449890-F
  misc_feature (480)..(480): n is a, c, t, g, unknown, or other
aaagctggagctccccgcggtggcggccgctctataactagtggatcccccgggctgcaggaattcgcacgagaccattacctagaacatcctaatcgaaaaattttccgtgcccgcgcccgtgccgtaccgtccctatcacaccggatcgccactcgctcccccccaccccactccgccccacctccgcgcctcagatccatccccaaccggcaaccctagcgccgggttcctcctcctcggatccgcccgccgccgcgcggactccattgccagaggtgatcgagggggagagatagagcttgggtggttggattagggagagagggaggggaggatgtccaaaccgtcgttgaacccgagccggtgggtggcccaccggggtttgtcgacagtcgtaaggcttgttccacccccgggtatggctccgcccccgtggcttactattgccctcacccccccagggaggcaaagattctngatcacctaatttccaacagcggcttaggtacggtccaaagaacccccggacgaaactggtcacccaccaaaaaggtgttgtcgactagtattggaaggccaacccaggcccaccaaaaagcccaccgtctcacacacacaccaaatttgtgtaaacgtggcaaaccccttccacaccccccctgggggccacccgccgatttcccctgaagctgcttcgacaaaacaacccagggccctttaaaaaaaccctggggagcgtttggcccacacccattgtgagcgcaggctgtgtcgaccccccccctggagcccaccacc

SEQ ID NO: 45655 - DNA, 819 bp, Zea mays
  misc_feature: Ceres CLONE 1449892-F
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
ccaagctggagctcaccgcgnnntgcgccgctctatgactagtggatcccccgggctgcaggaatacgcacgagaccattacctagaacatcctaatcgaaaaataattctattactctctggaggcagctatgtcaaccactggtgatccgacctagcaacttgattcttggtgggcgagataaccatacagcaggtacctcgagcgagaatgagccaagagcagccgaggaggccgtccggccatgacgagacgagcggcggatagcagggcgccatccgctaccgctacttgttcacggcggtgagcgggggcctcccggagcaacccgtggcgccgcacgaagcggccactatgtattccggtgtaaaaactgacgtccggccagacgctcaagggttgccctgtggcccccctgttgttcggtgcccccccccaacaagcttatggccgccgtgggggaaccaaccaccccccggaaacctcctcccgtgcagggcgtacaccgtccaccgagaaccgagcgcccggggggggtggccgcatcatctactaatattcccccgccggccatgcttgtcacccatttaccgcggtgagggaaaaaaaatggaggcggggatatattgtcccgcccctggttcctgtggcgggcaacttccagtgtatggcctcccacgttggcgcacccttccgtgttagcgcccttgtaggaaattctgtctctctcggaggggggtgacgccccacttgggagcgtaaacctagtgtgtgtcgctcttctctctaacgtcagaaaggccttcctctctccgcgc

SEQ ID NO: 45656 - DNA, 767 bp, Zea mays
  misc_feature: Ceres CLONE 1449893-F
  misc_feature (660)..(660): n is a, c, t, g, unknown, or other
  misc_feature (661)..(661): n is a, c, t, g, unknown, or other
  misc_feature (733)..(733): n is a, c, t, g, unknown, or other
caaagctggagctccccgcggtggcggccgctctagaactagtggatcccccgggctgcaggaattcgcacgagaccattacctagaacatcctaatcgaaaatgttcaagtttatgctgagacattgcatcaagtgatgcaccattgctccgagtgattgcaagtctaattttttgcagattttttggttgagggctgcattcactttggttcagccatcttttgtggacagaaaactaaaccgagtgttaaatcatccccgtgcgtctatctagggaagcaaatcaatacttcaacctcaccagatccaaatcatttttctgttgtaaggggggagggggttaagcaggtcatcatctcatccgcatttgattggcttgtgctcttggcatgacaaaaccttcgagtctgactagtttggttacctatgttcagcggatacatcagaatcttccagatgttatttccattacatgtgtccagaccgaaaaaaaaatcgcacctttcgcttttgctgcgctgaatttgttgaccctgtaatgatgtcgcgcagaagcatacacaaaaaaatctccctgtgaaagcgaatctgcctccttcgaaaaaaaaaaaaaaaagcttatcgataccgtcgacctcgagggggggccggtacccanntcgcctatagtgagtcgtattagcgcgctcactggccgtcgttttaacacgtcgtgactgggaaaaccctgnccgtacccactaaatcgcttgcagacatccccct

SEQ ID NO: 45657 - DNA, 798 bp, Zea mays
  misc_feature: Ceres CLONE 1449894-F
  misc_feature: Encodes the peptide sequence at SEQ ID NO. 45658
  misc_feature (409)..(409): n is a, c, t, g, unknown, or other
  misc_feature (431)..(431): n is a, c, t, g, unknown, or other
  misc_feature (506)..(506): n is a, c, t, g, unknown, or other
acagctggagctccccgcggtggcggccgctctagaactagtggatcccccgggctgcaggaattcgcacgagaccattacctagaacatcctaatcgaaaaaaacgctcgagaaagagagagagactaaatcctccctcgaaaccctagcatagccactgccttcccgcacgctaggaaggggaagatatgggcgccgaggaggacgccgctgcacgccgcgagcgtctccgcgccctccgtgccgccaaggacctcctctccacccccgacggcgccccaaccccttccaccgacggagaacaccaaaatggcaaccatgagatggcagaggagccagatttaccaggtcatcaggatgcaccttggtgaggttgccaaagaggagggggggccccactgaggaggnaaaggtcccccccccccaaggngaagttttaagggatggaagttcgaaaactacctttccccaggatgaacaacttgcgaggagggcagcgggggtncagcgggcccttccccaggttggacgacccccactagccgccaaaactcgcaaaacccaacggcagcggccaccctcttttcggaacccctccctccccgctgaccgccctggggctctccggacaccgggccgcccccagaagaatccaggaacctggcgcagccgcccctcacaacgccgcggccgcgcccccgccaccgaccccccacgcgcgcctccaccctccggcctgcccccccgagctaccccctcgccccccgcccaccgcgcccccccgcccgctcgccccg

SEQ ID NO: 45658 - protein, 30 aa, Zea mays
  misc_feature: Ceres CLONE 1449894-F
MATMRWQRSQIYQVIRMHLGEVAKEEGGPH

SEQ ID NO: 45659 - DNA, 767 bp, Zea mays
  misc_feature: Ceres CLONE 1449895-F
  misc_feature (735)..(735): n is a, c, t, g, unknown, or other
aagctggagctccccgcggtggcggccgctctagaactagtggatcccccgggctgcaggaattcgcacgagaccattacctagaacatcctaatcgaaaagtttgtcacaaactctgagaagtcagttgttgagtttgaaaacgctcgagttcttgtcactgatcagaagatctcctcaattaaagaaatccttcctttgttggagcaaacgacgcagttgagagcaccacttctcataattgcggaggatgtatctggtgaggctttggcaactctggttgtcaacaagcttagaggaattctgaatgtagctgcaattaaagctcctggttttggtgaaaggcgcaaggctctccttcaggacattgccattgttacaggtgctgaatttcaagccaaagatcttggccaactgatcgagcagacaacagtggagcagctcggcatagccaggaaggtgacaatctccgggtcatccacaaccataatagcagatgttgccaccaaggatgagatccaggctagaattgcgcagctgaagagagagctttctcagacagactcgacatatgattctgagaagctggcggagagaatagcaaagctctctggcggagttgctgtgatcaaaggtggagctgcaacagaaacggagcttgaggaccgcaagctccgcatagaggatgccaagaatgccacttttgcagccattgaggaaggtatagtacctggnaggtgggtgcggcctatgtcacctgtcgactc

SEQ ID NO: 45660 - DNA, 712 bp, Zea mays
  misc_feature: Ceres CLONE 1449896-F
  misc_feature: Encodes the peptide sequence at SEQ ID NO. 45661
tggagctccccgcggtggcggccgctctagaactagtggatcccccgggctgcaggaattcgcacgagaccattacctagaacatcctaatcgaaaaaccaaactctgctcctccctgcttccgtcacgcgagagcactccactcccacgcgaaccctagcagtggttctccctcggggccccgctaagcagcttggttccaagctgtagaagcatctccgatcccatccgcggcgggttgaggccatcagctccggtttctgcagccggatttgggatccgcgagatgtcttggtccgcgcccgacgacatcctcctctccacctccctcgccggcttcttggacaagaaacttattgtcctgctaagagatggacggaaactgcttggcaccctctgctcatttgatcagtttgcaaatgttgttcttcagggtgcttgtgaacgagtgattgtgggggaacaatattgtgatgttcctcttgggctgtacgtaatccggggagagaacgttgttttaatcggagaattggatcgcgaaaaggatgaactccctgctcacatgacctgtgtttcagaggcaaaaataaaaaaggctggaaaagcagaaacgggaagccatgagatctgaaagggacgatgaaggaaaccgatggagtttcctgaacttcaattaacaccgtcaccgcgccggtgcccctccccaatgggg

SEQ ID NO: 45661 - protein, 114 aa, Zea mays
  misc_feature: Ceres CLONE 1449896-F
  misc_feature (13)..(81): Pfam Name: LSM Pfam Description: LSM domain
MSWSAPDDILLSTSLAGFLDKKLIVLLRDGRKLLGTLCSFDQFANVVLQGACERVIVGEQYCDVPLGLYVIRGENVVLIGELDREKDELPAHMTCVSEAKIKKAGKAETGSHEI

SEQ ID NO: 45662 - DNA, 757 bp, Zea mays
  misc_feature: Ceres CLONE 1449899-F
  misc_feature: Encodes the peptide sequence at SEQ ID NO. 45663
atagctggagctccccgcggtggcggccgctctataactagtggatcccccgggctgcaggaattcgcacgagaccattacctagaacatcctaatcgaaaaacacggacgccataccctagattggagcgcaccacgggcgccggcggccggcggcccgccaccggtgattgacgccccctcctcggtccccagcgcggcgagcaggctatttgaggagatgccgtcattgtcatccttactctctggctccaatactgcgagtgctgagcttcctctaatcccttgcaagctctgcaatggggtggtgattgagcgggtctccaaacaaccagaaaccacgtcgaggaagttctaccggtgcagagacaagaaaacggatgggtcttaatgtgattttttccactggcaccccacctatgttgttttgttaatcgaggatgggtttgtcagtggtgatcgacgccttgagttgttaatgatcgcacttaatgatcatgggaaagccgttgaatctctaaccaattccatcagagagatgaagaaaaagctgtccaacctggagttagtgatgaaagagctggataacgtgaaaaatttgatgaaggcagccttgcttgaatttgaagaaaaaagaaatcgactgctgctgctttgaaactgatgggaaatgagctgcaaaacctgaaagggccaactaaggtgaaccctacgattatggcccagtgttttctgcctttgggattgattggggggt

SEQ ID NO: 45663 - protein, 59 aa, Zea mays
  misc_feature: Ceres CLONE 1449899-F
MIALNDHGKAVESLTNSIREMKKKLSNLELVMKELDNVKNLMKAALLEFEEKRNRLLLL

SEQ ID NO: 45664 - DNA, 749 bp, Zea mays
  misc_feature: Ceres CLONE 1449900-F
  misc_feature: Translation starting site: 236
  misc_feature (257)..(257): n is a, c, t, g, unknown, or other
  misc_feature (272)..(272): n is a, c, t, g, unknown, or other
  misc_feature (280)..(280): n is a, c, t, g, unknown, or other
  misc_feature (304)..(304): n is a, c, t, g, unknown, or other
  misc_feature (305)..(305): n is a, c, t, g, unknown, or other
  misc_feature (347)..(347): n is a, c, t, g, unknown, or other
  misc_feature (357)..(357): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (413)..(413): n is a, c, t, g, unknown, or other
  misc_feature (429)..(429): n is a, c, t, g, unknown, or other
  misc_feature (465)..(465): n is a, c, t, g, unknown, or other
  misc_feature (474)..(474): n is a, c, t, g, unknown, or other
  misc_feature (566)..(566): n is a, c, t, g, unknown, or other
  misc_feature (749)..(749): n is a, c, t, g, unknown, or other
aaagctggagctccccgcggtggcggccgctctagaactagtggatcccctgggctgcaggaattctcacgagaccattacctagaacatcctaatcgaaaaacaccactgccctcttctgcacaccactgccctcttctgcacaccactgccctcttctgcacaccactgccctcttctactctcgtcgcgccggtaactcccgtccctcctcccctctccgcgtcccggctccatgggcggcctgtcggtgatcncgccccccgcgcggnacacggcntcgccgcagcaccgccgcgcgagnngggctttcctcgtctccaactacctcatcgtgagttgcgcgnccgggtgcgnttttttcaccctcccccccgcggggggggggnnnnnaannntttcctcctcacccncctccacccacccaanaaggccttcgccccggtggggggcgcggtgcccccntccccgaanacccgcccggtcgttggatacccaccccattgttccccccctccttaatgcccaaccctattgaccccccctcaaaaattcctctccccccnaaattaaagtacccacgcccccccttcttacaacccaccccaatacttccccccccccccctctcgccgcccgtggccccacctcccgtaccccccttcacacaatcggacgcacggataaaacgcaacctcccccattctattcgtttttttcaccccgcacccctctctgcgggctccccn

SEQ ID NO: 45665 - DNA, 759 bp, Zea mays
  misc_feature: Ceres CLONE 1449907-F
  misc_feature: Encodes the peptide sequence at SEQ ID NO. 45666
  misc_feature (759)..(759): n is a, c, t, g, unknown, or other
aaagctggagctccccgcggtggcggccgctctagaactagtggatcccccgggctgcaggaattcgcacgagaccattacctagaacatcctaatcgaaaaccttcactctctggcttcccgatctcttctctctctctctcgtctctcacatctccagcccttcgccctcttctcggcccgacctcgacggtgttccaccatctcctaccctcttcttttcccgcccgcgccatccctttctccgctgtagccactgcaagccccgcgcgacgcacacggcagtggtccacgtcgaccaaatcgtccacagcatcgcgttctcctcggcgagggtctgtagcctgccggcgaggagctcgcagcgaagatccgtgcaagccaccctccagatcgtcacagctatgaatgactgcgacaaccaccattttcgccacaattcagcggatgcattgggttgttgggcattgatgattctatgcaggctatgcagcatgtagcagccagacaacaaccatgagtctcgcttgtcttgtatgccatggcatgagcagcccctcgcactctcttagaagctactcggtgtcaagctcagaggaagaaagccggtgtggagctggtgttgcctgcttagctcgaagagtacaccagctggacctctactagcgttggacatcgaaagtgaccccctttccacccgtgttgagtgatcaagtggtacaaagggcgctcctcgactccacgcagcggtgctgtgtn

SEQ ID NO: 45666 - protein, 49 aa, Zea mays
  misc_feature: Ceres CLONE 1449907-F
MSLACLVCHGMSSPSHSLRSYSVSSSEEESRCGAGVACLARRVHQLDLY

SEQ ID NO: 45667 - DNA, 742 bp, Zea mays
  misc_feature: Ceres CLONE 1449908-F
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaacttgctaaccctagccgctgaaatggcatatataggtcccatgaccgccgcctcttctctccgcacccccatctacgtagccgcctcttcccggggtcgttcctttctccccggcgccgtcaaagccatcggcagttctgcacatcctatcctctggtccctccgcatggccgtctcagcagctgttctcttcggagcaacatcaccgggagtggggtgtaccccctccgttcgtccgcccccggtcagtcgtctgagagtgatggtgttccaccaccacatcatcgcagacgcctcccgactcttcaagaaactgataatcaagactgcctgcctcgcgcgcgtaggtcgcgcagacgaagcgcgctcgcgcctgtccacagtcggatgtggagagagctacgtccgcctacctagacgctcacgttctgtacgtgcactgtaagatggacgaggcgatcgcagcatacaaagagcttgcgcagggaggaccccgccgactatggccttctgatctgtanggtggcgctgaacctcgcgcttgtaagggaggcggaatcggagtccatgctcgaggaatgcacggagtcggcggcaaacgttaattaagatccgtcatgcatataacgcgaaaatgaaa

SEQ ID NO: 45668 - DNA, 799 bp, Zea mays
  misc_feature: Ceres CLONE 1449910-F
  misc_feature: Encodes the peptide sequence at SEQ ID NO. 45669
  misc_feature (372)..(372): n is a, c, t, g, unknown, or other
  misc_feature (373)..(373): n is a, c, t, g, unknown, or other
  misc_feature (377)..(377): n is a, c, t, g, unknown, or other
  misc_feature (381)..(381): n is a, c, t, g, unknown, or other
aaagctggagctccccgcggtggcggccgctctagaactagtggatcccccgggctgcaggaattcgcacgagaccattacctagaacatcctaatcgaaaacaccaaactcacctctgcttcggtcgttacacgcgtgctcgtcaggagttcaggcgcggcgagcaggggggcgggggagaagcagccggactcgttagcccagtcggcagtcgccatgggcatcggctacgtagtgggcgtcctcggcggcgccatcctcgcccacgccgcctacgccaccatccagtaccgcgcggtgctcaagatcacggaggaggagttctcgcggccgcccatggatgtgatgatggagttgctcttaggggtggnnctgnacangagggcaggtcttgctgttcccactaaattccccccggggcttccactttctggatgagaataaggatcctcttccttcccggctaacctggcatttcatgatcttcaacccacgctgagaaaaccgctgccggtaaactccgacccggaaactccatacattaacagggcccgaaactccaaacatttattctctcatgttcgggaaggccttgtccgcctaattcctcaggaccacgcggactcaccgtgaagtggggagaaatcttcaaactgatctggctttgctttagaacaaaaacaaaacaaaatggttatggtatacccggcgacctctgtgggggggggcccccggaacccgatttcccggccctggattccggcgcgttcttctccctccctctccaccagacgctcc

SEQ ID NO: 45669 - protein, 73 aa, Zea mays
  misc_feature: Ceres CLONE 1449910-F
  misc_feature (52)..(52): Xaa is any aa, unknown, or other
  misc_feature (54)..(54): Xaa is any aa, unknown, or other
  misc_feature (55)..(55): Xaa is any aa, unknown, or other
MGIGYVVGVLGGAILAHAAYATIQYRAVLKITEEEFSRPPMDVMMELLLGVXLXXRAGLAVPTKFPPGLPLSG

SEQ ID NO: 45670 - DNA, 752 bp, Zea mays
  misc_feature: Ceres CLONE 1449913-F
  misc_feature: Encodes the peptide sequence at SEQ ID NO. 45671
  misc_feature (694)..(694): n is a, c, t, g, unknown, or other
aaagctggagctccccgcggtggcggccgctctagaactagtggatcccccgggctgcaggaattcgcacgagaccattacctagaacatcctaatcgaaaactggagctggagggcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtgggcggagctggagagcggggcgacgaccatcgcgttcacgccgctgcaccagcgggagacggacgagctgtcgggggcggtgcagctgccggactcgtcggccgccggccggggctccgtggaggtctgcttcgcctacgcggacgtcgacgccgcgtacaagcgcgccgtggacaaacgggcggtggccgtgagcgcgcccgaggacaagccctggggccagaagtccggcttcgtgcgggacatggacggcaacatcgtgcgcatcgcgagctacgtgcgagagtagtcgcattccgctgcatcaccatcgatcaatcgatcagcctttcccatgcatgtctcgtatactacacgtctacacgtgtaccaaaaaaaataatcgttgtgcangtcatgtaattgtgggaaggtaagaccgtggaagatgtaaatggaaccgtggagcatt

SEQ ID NO: 45671 - protein, 139 aa, Zea mays
  misc_feature: Ceres CLONE 1449913-F
  misc_feature (9)..(133): Pfam Name: Glyoxalase Pfam Description: Glyoxalase/Bleomycin resistance protein/Dioxygenase superfamily
MASGGPKPKLAYIILYVRDVEKAASFYDAAFGYTVRRLDQFRKWAELESGATTIAFTPLHQRETDELSGAVQLPDSSAAGRGSVEVCFAYADVDAAYKRAVDKRAVAVSAPEDKPWGQKSGFVRDMDGNIVRIASYVRE

SEQ ID NO: 45672 - DNA, 741 bp, Zea mays
  misc_feature: Ceres CLONE 1449917-F
  misc_feature: Encodes the peptide sequence at SEQ ID NO. 45673
  misc_feature (424)..(424): n is a, c, t, g, unknown, or other
  misc_feature (469)..(469): n is a, c, t, g, unknown, or other
  misc_feature (505)..(505): n is a, c, t, g, unknown, or other
  misc_feature (518)..(518): n is a, c, t, g, unknown, or other
  misc_feature (544)..(544): n is a, c, t, g, unknown, or other
  misc_feature (581)..(581): n is a, c, t, g, unknown, or other
  misc_feature (583)..(583): n is a, c, t, g, unknown, or other
  misc_feature (609)..(609): n is a, c, t, g, unknown, or other
  misc_feature (631)..(631): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
aagctggagctccccgcggtggcggccgctctagaactagtggatcccccgggctgcaggaattcgcacgagaccattacctagaacatcctaatcgaaaaattcactcctcgcgcctcgagatcccatccaaatcccgatcagtcgccgcccaagcctagcagatccgccggcgagcgcgcgggggcaatgggtgtcgtctcggcagcggcggacgcgattgtcgcggttttctccctcaccatcgtcgtcgcggcgccgctactcgacgcgcagtccgtcctcccgcataccctctacccggcgccgctcctggaactcaagcgctggtacgccgccgagtttggcgactacctcgtggcccagtcccccggcttcttccgtggccttgtttgcctcgagctcgccttccaatggccgctcngcgtcgccacactctacggcatcctcacccgccgccgctgggctngcaccacctccctcatggccggcgttggcaccctcnactccatgtctgncattctgggtgagatgttaggttcanggcaaatcacacaaaagttgcttcagatgtatgtccntnatgctgttttttgcttgtcattgggntaatttccaccgtgggggaagntttttttggggggnngnnnnnnnnnnnnnnnnnnnnnnnnnnnnnnnnnnnnnnnnnnnnnnnnnnnngnnnnnnnnnnnnnnnnnnnnnnnnnnnntnnnnnnnnnntt

SEQ ID NO: 45673 - protein, 140 aa, Zea mays
  misc_feature: Ceres CLONE 1449917-F
  misc_feature (79)..(79): Xaa is any aa, unknown, or other
  misc_feature (94)..(94): Xaa is any aa, unknown, or other
  misc_feature (106)..(106): Xaa is any aa, unknown, or other
  misc_feature (110)..(110): Xaa is any aa, unknown, or other
  misc_feature (119)..(119): Xaa is any aa, unknown, or other
  misc_feature (131)..(131): Xaa is any aa, unknown, or other
  misc_feature (132)..(132): Xaa is any aa, unknown, or other
MGVVSAAADAIVAVFSLTIVVAAPLLDAQSVLPHTLYPAPLLELKRWYAAEFGDYLVAQSPGFFRGLVCLELAFQWPLXVATLYGILTRRRWAXTTSLMAGVGTLXSMSXILGEMLGSXQITQKLLQMYVXXAVFCLSLG

SEQ ID NO: 45674 - DNA, 754 bp, Zea mays
  misc_feature: Ceres CLONE 1449924-F
  misc_feature: Encodes the peptide sequence at SEQ ID NO. 45675
  misc_feature (593)..(593): n is a, c, t, g, unknown, or other
  misc_feature (602)..(602): n is a, c, t, g, unknown, or other
  misc_feature (608)..(608): n is a, c, t, g, unknown, or other
  misc_feature (609)..(609): n is a, c, t, g, unknown, or other
  misc_feature (754)..(754): n is a, c, t, g, unknown, or other
ctggagctccccgcggtggcggccgctctagaactagtggatcccccgggctgcaggaattcgcacgagaccattacctagaacatcctaatcgaaaagtctaggtttaggcacccgaccgccgcagcgtccccgccgccacgaccacgagcgaaaggaggtcgccggaagagggggcgcggagatgagcgggagcgcgttcaacgcgttcaagtcgcgggtgccggtggcgtggagtccccggctgtacatcacgctggtgcggggcctccccgggacgcggcgcctccaccgccgcacgctcgaggccatgcgcctccgccgctgccaccgcaccgtcgagcaccgcaccacgccgtcgctcctcgggatgctcacccaggtgaagcgcctcgtcgccgtggagaccgaggagatgtacaacgcgcggaagcaggccgaagccggagaggcgcgcgcccagacccccgctcgtcgtctcccaccagccacagccgccggctccgaagccggcagccgccgccgcggtgggtgccgctaccactgcgcagtagcctccgggcatcagaagcctttcatcacagttcagcggncatatattngatttnngctgtgttgggtctgctggttttcagacgatcgctttgggtcttctttgctcacgagatctagcaacggatttgatcgatctttctcagatcgttgtgtggtgccacctgcattgaccctgtattttagattgttttatatgacn

SEQ ID NO: 45675 - protein, 190 aa, Zea mays
  misc_feature: Ceres CLONE 1449924-F
  misc_feature (20)..(71): Pfam Name: Ribosomal_L30 Pfam Description: Ribosomal protein L30p/L7e
  misc_feature (137)..(137): Xaa is any aa, unknown, or other
  misc_feature (140)..(140): Xaa is any aa, unknown, or other
  misc_feature (142)..(142): Xaa is any aa, unknown, or other
MSGSAFNAFKSRVPVAWSPRLYITLVRGLPGTRRLHRRTLEAMRLRRCHRTVEHRTTPSLLGMLTQVKRLVAVETEEMYNARKQAEAGEARAQTPARRLPPATAAGSEAGSRRRGGCRYHCAVASGHQKPFITVQRXYIXFXLCWVCWFSDDRFGSSLLTRSSNGFDRSFSDRCVVPPALTLYFRLFYMT

SEQ ID NO: 45676 - DNA, 671 bp, Zea mays
  misc_feature: Ceres CLONE 1449927-F
  misc_feature: Translation starting site: 129
  misc_feature: SWISSPROT Homolog: EC 2.3.1.110 Tyramine N-feruloyltransferase
  misc_feature (373)..(373): n is a, c, t, g, unknown, or other
  misc_feature (390)..(390): n is a, c, t, g, unknown, or other
  misc_feature (391)..(391): n is a, c, t, g, unknown, or other
  misc_feature (484)..(484): n is a, c, t, g, unknown, or other
aagctggagctccccgcggtggcggccgctctagaactagtggatcccccgggctgcaggaattcgcacgagaccattacctagaacatcctaatcgaaaacccgtttctctacacttcctgacccagatggcggcggcgccctgctctaccaccttctccggcgacgtgtgggcggagctgcgcctggcctccgctagcgatgtgccgcacatccaccgcctgatacaccagatggccgagttcgagctcctcaccgacctcttcgccgccaccgaagagctgctcacctccacgctcttcccctcgccgacgccgcctcccttcacctccttcacagccctcatcctcgacctatccccctcccccgtcgnccccgacccctcgtccnnacatcgctcccgccgcctcgacctctccgcgtccccgctcgcggaccccgaggccgccgccttcgcctccccgcgcggaagcgggcgcgtcancgccgggttcgtgatctgcttccccactactccaccttcctctcaaagccgggctctacgtagaggacatcttcgtgcgcgcgccctggcgccgccccgggctccgccggatgatgctgtccgccgtccccgggaggggcgccaaaactcgaattggccgggttggaaggttcccggccccaactga

SEQ ID NO: 45677 - DNA, 764 bp, Zea mays
  misc_feature: Ceres CLONE 1449929-F
  misc_feature: Encodes the peptide sequence at SEQ ID NO. 45678
  misc_feature (595)..(595): n is a, c, t, g, unknown, or other
  misc_feature (596)..(596): n is a, c, t, g, unknown, or other
  misc_feature (615)..(615): n is a, c, t, g, unknown, or other
aaagctggagctccccgcggtggcggccgctctataactagtggatcccccgggctgcaggaattcgcacgagaccattacctagaacatcctaatcgaaaaagaccccctctcgcttcgcccctcctcatcctctctcctctctcccccgccccgttcgtctccggcgagctagggtttgcccccccgccttgccaccccacggttcccgccatccttggatctccagccatgtacggcggagacgaggtttcggcaatcgtcatagatgtgggctcttacagctgcaaggcgggctacgcaggcgacgacacccccaaggccgtcttcccatcggttgttggttcaattgaacaaactgaagacacagatgaccccaagccagagaaggaagctgactctgcatcagattctaagaacggtgccaagcccatggatgtggacaaagccaagacaaaacgcagactttatgtaggccaagagttagagttcaggagggatcacatggaggtgatttcatctatgaaagatggaacggtaactgactgggatattgttgataatatatggaatcatgctttcagacgggaggtgnntgatcatcctgaagagcantctatgctcattgctgaaccatctacaaacactgcacagcaaagagagaacggacttatgtttgagaactacaaagtgccagcgctgtttctagccaaaatgcagtgctcacatcttttgcgtctggacgactacatctttggtgggtg

SEQ ID NO: 45678 - protein, 177 aa, Zea mays
  misc_feature: Ceres CLONE 1449929-F
  misc_feature (4)..(177): Pfam Name: Actin Pfam Description: Actin
  misc_feature: SWISSPROT Homolog: EC 2.7.10.2 Non-specific protein-tyrosine kinase
  misc_feature (122)..(122): Xaa is any aa, unknown, or other
  misc_feature (128)..(128): Xaa is any aa, unknown, or other
MYGGDEVSAIVIDVGSYSCKAGYAGDDTPKAVFPSVVGSIEQTEDTDDPKPEKEADSASDSKNGAKPMDVDKAKTKRRLYVGQELEFRRDHMEVISSMKDGTVTDWDIVDNIWNHAFRREVXDHPEEXSMLIAEPSTNTAQQRENGLMFENYKVPALFLAKMQCSHLLRLDDYIFGG

SEQ ID NO: 45679 - DNA, 758 bp, Zea mays
  misc_feature: Ceres CLONE 1449932-F
  misc_feature: Encodes the peptide sequence at SEQ ID NO. 45680
  misc_feature (419)..(419): n is a, c, t, g, unknown, or other
  misc_feature (493)..(493): n is a, c, t, g, unknown, or other
  misc_feature (499)..(499): n is a, c, t, g, unknown, or other
  misc_feature (530)..(530): n is a, c, t, g, unknown, or other
  misc_feature (531)..(531): n is a, c, t, g, unknown, or other
  misc_feature (615)..(615): n is a, c, t, g, unknown, or other
aaagctggagctccccgcggtggcggccgctctagaactagtggatcccccgggctgcaggaattcgcacgagaccattacctagaacatcctaatcgaaaatattccttcgcttccgtcaggtcgggtccgcagcctccccctctcgcagatccccacctgctccgccgccggccaccgcgttgctcccctcggcagccaggatgacagaagcaccatttctgccgcgtgagaggctcttcaagcagcaacattacttccagaacttgaccaagcacacctacctgaaagggcgctacgacgtgatcacatctgtcgccatcccccttgcactcgctgcctccagcatgttcatgattgggcgtggagtttataacatgtctcatggggttggggagaaagagtgatcttccactggntaactatttgttctgcttgtcatggaagtcataccgtcgagactgcgaagtcctcttcgcttgcaaaatatacngccaantaacaattcgactacattttcgcatcaattnnttctgttgatttgggggtgtgaagtggcagtaacttgaaatcagcactgtcactggtttggttaagtactccattccttcggcnttttgtgtcccctttcaaaagagcaagctgggcttgaacttcctccattcttttttttagttgtcacggtttagtccaaaaaaatgaactaccggccgacaattatttagttcaaaatgctctgttcataacatgcacctaac

SEQ ID NO: 45680 - protein, 67 aa, Zea mays
  misc_feature: Ceres CLONE 1449932-F
  misc_feature (9)..(62): Pfam Name: COX7a Pfam Description: Cytochrome c oxidase subunit VIIa
MTEAPFLPRERLFKQQHYFQNLTKHTYLKGRYDVITSVAIPLALAASSMFMIGRGVYNMSHGVGEKE

SEQ ID NO: 45681 - DNA, 725 bp, Zea mays
  misc_feature: Ceres CLONE 1449933-F
  misc_feature: Encodes the peptide sequence at SEQ ID NO. 45682
  misc_feature (389)..(389): n is a, c, t, g, unknown, or other
  misc_feature (397)..(397): n is a, c, t, g, unknown, or other
  misc_feature (415)..(415): n is a, c, t, g, unknown, or other
  misc_feature (459)..(459): n is a, c, t, g, unknown, or other
  misc_feature (462)..(462): n is a, c, t, g, unknown, or other
  misc_feature (687)..(687): n is a, c, t, g, unknown, or other
tggagctccccgcggtggcggccgctctagaactagtggatcccccgggctgcaggaattcgcacgagaccattacctagaacatcctaatcgaaaaaattcacatcgcactctcctccagcctccaggcttggcaagcgtgcttcacattaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcgaagctggcccgcgtgacgcgcgccatctcccccgcagcgagctcctcgcacgggcgccgcgaggtggcccgcatgatggacgaanctgacacnggaccgcgaacgcctccntgaacctcggcaaagtcaaggcgttccacgcccgcgcggcgggngcntggaaaagaccccgagctccccgcgccttcaagtctacaactcaaagggaacggcccttccaggggcccagcttggaaaggggccccccccatccgccagggcgaatcacccccaaggatcgcaagggaatgtcccggggttcaacccaaagggtggttgggttcaagacttaaaaaaaaaatggccccccacccaaaaccaaaaccggccccccggggggaaangaaacccccccaaaaaaaaaacctttctcaagggtctc

SEQ ID NO: 45682 - protein, 85 aa, Zea mays
  misc_feature: Ceres CLONE 1449933-F
  misc_feature (77)..(77): Xaa is any aa, unknown, or other
MSNSAASEKQSQQAGHRQRPPAASAADAEMQRVFCRIDADGDGRISASKLARVTRAISPAASSSHGRREVARMMDEXDTGPRTPP

SEQ ID NO: 45683 - DNA, 685 bp, Zea mays
  misc_feature: Ceres CLONE 1449934-F
  misc_feature: Encodes the peptide sequence at SEQ ID NO. 45684
aaagctggagctccccgcggtggcggccgctctagaactagtggatcccccgggctgcaggaattcgcacgagaccattacctagaacatcctaatcgaaaacttccaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaaagtcactgtccacccacttcatggaaacaatgtcgaccttgggactgccctgtggtaaatactttcgggtctgctgcctcaaccataatgatcctggggatcctgatatcctcaagactacacccgggtgaggcaataaagaaacccctgcaatagggggaaccttacgggcattggtccccccggcctggtaaacaacattttcccggccagaaaaccgagattttcccgaaaatttttcctttgatttgaaaaaaaaaaaaaaaaaaaaccttttccccccccc

SEQ ID NO: 45684 - protein, 86 aa, Zea mays
  misc_feature: Ceres CLONE 1449934-F
  misc_feature (12)..(85): Pfam Name: Ribosomal_L7Ae Pfam Description: Ribosomal protein L7Ae/L30e/S12e/Gadd45 family
MVATKKTKKSTDNINNKLQLVMKSGKYTLGYKTVLRTLRNSKSKLVIIANNCPPLRKSEIEYYAMLAKVTVHPLHGNNVDLGTALW

SEQ ID NO: 45685 - DNA, 754 bp, Zea mays
  misc_feature: Ceres CLONE 1449935-F
  misc_feature: Encodes the peptide sequence at SEQ ID NO. 45686
  misc_feature (477)..(477): n is a, c, t, g, unknown, or other
aagctggagctccccgcggtggcggccgctctagaactagtggatcccccgggctgcaggaattcgcacgagaccattacctagaacatcctaatcgaaaaactgcccacgcggacacgctctgcaccaccacctgccggccgttgccgggctcccggctcgccgccgccgttgcgccctcgcgctcacacctccgccagcccaggtccatcgagcggagaaacccatggccccctcgccgatcctcgtccggccgccggcgctggcgaaattcaccccttccgcctcctcgatgcgtggccgcggtagcagcggcgccgggcgttcagacggctcccggcgccccattctctaggctccgtaccaagtgtaggttcgccgcatcggatgtgagagaagactactcttctactccgacacatattgtcgctgatgttaagacggagaagatttgtgtgttaggacgaagtggatccnttggttctgcattttgcagagctgctgtatctaagggcattgaggttgtgagctccagcaggtcaggaagacccatctactctgatcccctggttgatcaagtcatttggctgccaagagatgttttctatgcaagatgggatgaaaagtattggtgggctaccgctgtttggcctacccttggagggtttggcatgaagaacaatgaaaaggataaatgggatgcaatgtctaacagtaacgctcaaaagaaatggagtccaaaattcttttatcc

SEQ ID NO: 45686 - protein, 250 aa, Zea mays
  misc_feature: Ceres CLONE 1449935-F
  misc_feature (159)..(159): Xaa is any aa, unknown, or other
AGAPRGGGRSRTSGSPGLQEFARDHYLEHPNRKTAHADTLCTTTCRPLPGSRLAAAVAPSRSHLRQPRSIERRNPWPPRRSSSGRRRWRNSPLPPPRCVAAVAAAPGVQTAPGAPFSRLRTKCRFAASDVREDYSSTPTHIVADVKTEKICVLGRSGSXGSAFCRAAVSKGIEVVSSSRSGRPIYSDPLVDQVIWLPRDVFYARWDEKYWWATAVWPTLGGFGMKNNEKDKWDAMSNSNAQKKWSPKFFY

SEQ ID NO: 45687 - DNA, 750 bp, Zea mays
  misc_feature: Ceres CLONE 1449937-F
  misc_feature: Encodes the peptide sequence at SEQ ID NO. 45688
  misc_feature (356)..(356): n is a, c, t, g, unknown, or other
  misc_feature (581)..(581): n is a, c, t, g, unknown, or other
  misc_feature (629)..(629): n is a, c, t, g, unknown, or other
  misc_feature (648)..(648): n is a, c, t, g, unknown, or other
ctggagctccccgcggtggcggccgctctagaactagtggatcccccgggctgcaggaattcgcacgagaccattacctagaacatcctaatcgaaaagaagtttcggcggcggcgtaggtagcggcggtgtgcttgtgatctcaatctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttncgatcactggtggcatgaaggttaaggctgatcgtgatgagtcgtctccttatgctgctatgctttgctgccaagatgttgcacagcgttgcaaggagctcggtatcacagcgctgcacattaagctccgtgccactggaggcaacaagaccaagacccctggacctggtgctcagtctgctctcagggctcttgctcgttctgggatgaaaatggacgcattgnagatgttaccccggttcccactgacagcactcccaaaaagggtggtangaggggaaagaagctttangcctgtatccttgctaattgccatcacttggcactggcctctgagtagtcctgtaattaatagcctcgccaaaggagtttaaatttgctcatttccctccag

SEQ ID NO: 45688 - protein, 177 aa, Zea mays
  misc_feature: Ceres CLONE 1449937-F
  misc_feature (28)..(133): Pfam Name: Ribosomal_S11 Pfam Description: Ribosomal protein S11
  misc_feature (54)..(54): Xaa is any aa, unknown, or other
  misc_feature (129)..(129): Xaa is any aa, unknown, or other
  misc_feature (145)..(145): Xaa is any aa, unknown, or other
  misc_feature (151)..(151): Xaa is any aa, unknown, or other
MSRRKTREPKEENVTLGPTVREGEFVFGVAHIFASFNDTFIHVTDLSGRETLVXITGGMKVKADRDESSPYAAMLCCQDVAQRCKELGITALHIKLRATGGNKTKTPGPGAQSALRALARSGMKMDALXMLPRFPLTALPKRVVXGERSFXPVSLLIAITWHWPLSSPVINSLAKGV

SEQ ID NO: 45689 - DNA, 756 bp, Zea mays
  misc_feature: Ceres CLONE 1449940-F
  misc_feature: Encodes the peptide sequence at SEQ ID NO. 45690
  misc_feature (299)..(299): n is a, c, t, g, unknown, or other
  misc_feature (368)..(368): n is a, c, t, g, unknown, or other
  misc_feature (583)..(583): n is a, c, t, g, unknown, or other
  misc_feature (738)..(738): n is a, c, t, g, unknown, or other
tggagctccccgcggtggcggccgctctagaactagtggatcccccgggctgcaggaattcgcacgagaccattacctagaacatcctaatcgaaaaaagccaggtgctgaggctttcgttggtctcttcgccggcgacgagcacccaccagggcacgggcctcaggatgcagtccttggtccggaatgtctgccgagccggaagccgtggagcggcggcgaggctcctggaggccgccgcggttcatccgggggcggcgcagctgtcctcggccgtcagacacctcaggcatccttgncggttcgctcgtccgatcggggtagatcaacccaagcctgtgcagcgccggaccattttgcgtgatggnggcccgcgtccggctgcccgctccggattcggtctctgcgcgaaagtctcgttgcgacgagggggtctgtcgacggcgggaaatgctgctgaagttgcctctgattcggacgattccacctctcctgcgggtgagcaccccccgcgcatcaagttcaagaggcctgacaggaccgctagacacattatgaatatccctgacaaagagggcggtcnaaaagtccgcctcgagaaggggattcctgatgtgccacctgaatgtatcattcagatgagattggaagtccctgaaacaaacggcgcaagtccacccctgaagggatttgtctagggagggcccacgctgggatcaaacaaccttcgattgcgtnaattaggggctggcgtgg

SEQ ID NO: 45690 - protein, 176 aa, Zea mays
  misc_feature: Ceres CLONE 1449940-F
  misc_feature (44)..(44): Xaa is any aa, unknown, or other
  misc_feature (139)..(139): Xaa is any aa, unknown, or other
MQSLVRNVCRAGSRGAAARLLEAAAVHPGAAQLSSAVRHLRHPXRFARPIGVDQPKPVQRRTILRDGGPRPAARSGFGLCAKVSLRRGGLSTAGNAAEVASDSDDSTSPAGEHPPRIKFKRPDRTARHIMNIPDKEGGXKVRLEKGIPDVPPECIIQMRLEVPETNGASPPLKGFV

SEQ ID NO: 45691 - DNA, 750 bp, Zea mays
  misc_feature: Ceres CLONE 1449941-F
  misc_feature: Translation starting site: 195
  misc_feature: SWISSPROT Homolog: EC 1.14.11.2 Procollagen-proline dioxygenase
  misc_feature (582)..(582): n is a, c, t, g, unknown, or other
  misc_feature (686)..(686): n is a, c, t, g, unknown, or other
  misc_feature (708)..(708): n is a, c, t, g, unknown, or other
ctggagctccccgcggtggcggccgctctagaactagtggatcccccgggctgcaggaattcgcacgagaccattacctagaacatcctaatcgaaaaactgacgccgtctctacaatctttttttaccaataaaaaggtagagaatataagaaaccgtcacgaccgcctccgccgtgctcttccatccgttccatggcgccgccgctcgccctgctccttctcgccgccatcgtgctctcgcgggccgtctcccacgcccacggcggcggcggcggcttctacgacccggcgagcgtcactcagctctcctcgcgccccagggcgttcctgtacagcggcttcctctcggacaccgagtgcgaccacctcgtcagcctggcgaaaggcagcatggagaagtcgatggtggcggataacgactccgggaagagtgtggcgagccaggcgcgcaccagctccggcaccttcttggccaagcgcgaggatgagatcgtgtctgcgattgagaaacgcgtagctgcttggacatttctccccgaagaaaacgcgaatcactccaggtcctgcgctacgaaaccgncagaagtatgacgcccacttcgactatttcacgacagaaacaacctgaaagctcgcggccagcgagttgcgaccgtccttatgtacctcacagatgtcaacaangggtggagagactgtatttccnaacgctgagggaagccatttacagtacaaggacgaaacttgt

SEQ ID NO: 45692 - DNA, 760 bp, Zea mays
  misc_feature: Ceres CLONE 1449942-F
  misc_feature: Encodes the peptide sequence at SEQ ID NO. 45693
  misc_feature (406)..(406): n is a, c, t, g, unknown, or other
  misc_feature (447)..(447): n is a, c, t, g, unknown, or other
tggagctccccgcggtggcggccgctctagaactagtggatcccccgggctgcaggaattcgcacgagaccattacctagaacatcctaatcgaaaaaacaaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccgtccatctccgtcggcgccgcggcgccgtcccgtgcagcgggcgtgagcacgaagaagagcgcggacgaggtggagctcctgcggcggcggaacgcggagctggagcgggaggtggcggcnctgcggctggagctgggcgcggcgcggccccgcgccgagancgcggaagaggccgaggagcggctgtgcgtgcagctcggcgacgccgagggtggagcgctcgagctcgcgcgcgcctaccaggcccacgtccacgagctcgccagggagctcgcccgcgcgcgcgcggccccggaacgcccggccagataggttctcgtgggctggtagtaggctactagtagctataccgtgcgggtcaccgggatggctgtggttccccgcgttgggtgggggtcagacgggaccccgcgccgccgtgccctttatttgctcgcgcccgcatcgccgtcttggctttttgctgggacgaag

SEQ ID NO: 45693 - protein, 106 aa, Zea mays
  misc_feature: Ceres CLONE 1449942-F
  misc_feature (57)..(57): Xaa is any aa, unknown, or other
MAPSISVGAAAPSRAAGVSTKKSADEVELLRRRNAELEREVAALRLELGAARPRAEXAEEAEERLCVQLGDAEGGALELARAYQAHVHELARELARARAAPERPAR

SEQ ID NO: 45694 - DNA, 844 bp, Zea mays
  misc_feature: Ceres CLONE 1449945-F
  misc_feature: Translation starting site: 138
aagctggagctccccgcggtggcggccgctctagaactagtggatcccccgggctgcaggaattcgcacgagaccattacctagaacatcctaatcgaaaagtctaagttaggctagggttcgaccagctagcggaaatggtggccttcaggttccatcagtaccaggtggtggggcgcgcgctgccgacgcccggcgatgagcaccccaagatctaccgcatgaagctctgggccaccacgaggtccgcgccaagagcaagttctggtacttcttgaggaagttgaagaaggttaagaagagcaacggccaggtcctggccaccaccgagatctttgagcgtaacccgacgacaatcaagaactacggcattcttcctccgctaccagagcaaaaccggctacaaaaaaatcccccccgcagaaccgcgacacaacccctgaactggcccttttgaagcaaatgtccccccaaaaaggcctccccacccaccggagtggagggcccccctggcattccagattcatcaagaactggggacgggggcacttttaaaagcttccggcaagaaccgaacaacactttaagcaatttccctccaccattgaaaataaaagtttccccgctccctcgccccgcaaaggtccaggcctccccaacccctggaagtctaaagaacccctgttttatggggcctttctaagaacaccacgctcgctccaccgcgaaattaaagctgtgggctcaccgcgctttcccctctatgaacatatccccctggggtttctccgtcctctactttaacattctggacgtcccgcacacaacacacccctagaccggt

SEQ ID NO: 45695 - DNA, 752 bp, Zea mays
  misc_feature: Ceres CLONE 1449948-F
  misc_feature: Encodes the peptide sequence at SEQ ID NO. 45696
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (493)..(493): n is a, c, t, g, unknown, or other
  misc_feature (618)..(618): n is a, c, t, g, unknown, or other
  misc_feature (619)..(619): n is a, c, t, g, unknown, or other
  misc_feature (663)..(663): n is a, c, t, g, unknown, or other
ggagctccccgcggtggcggccgctctagaactagtggatcccccgggctgcaggaattcgcacgagaccattacctagaacatcctaatcgaaaaatatagagacctgccactcgttccctttcccaggcgcaggcgcctctccttgccaggcgtgacacagacgaactggtgccgcctctgctggggcttggtcctcccagccgagcgcgcctcatccggatcttgcgacgacggtgcccaagctcccggcctccctttcgcatccctgctgcgagccgtcggtctccggaaagagttagagccgtcggtctccgtaaagaattggagccgccaggcgccttgagaagggttttgtcccgggatgtcgtcgtcggggaagatggaggggccgtctgccccggtggtgcnnncggatccctacgaggtgctcagcgttcccagagattcctccgaccaggagatcaagtccgcctaccggaagctcgcactncagtacccaccctgacagaatgctagcaacccagaagcatcggaactctttcaagaaagtgcatatttctatagcatcttgtcagatcctgagaaaagaaggcagtatgatactgctggttttgnnagagtagaaaatgaggaatggatatggaaattgatttgtcaatnctggactgtgaaacacatgtttgcagcactttttagcagcttgttgtcctatcaagacacatatctcctactgtgctggaagaagcatg

SEQ ID NO: 45696 - protein, 47 aa, Zea mays
  misc_feature: Ceres CLONE 1449948-F
  misc_feature (16)..(16): Xaa is any aa, unknown, or other
  misc_feature (17)..(17): Xaa is any aa, unknown, or other
MSSSGKMEGPSAPVVXXDPYEVLSVPRDSSDQEIKSAYRKLALQYPP

SEQ ID NO: 45697 - DNA, 712 bp, Zea mays
  misc_feature: Ceres CLONE 1449950-F
  misc_feature: Translation starting site: 402
  misc_feature: SWISSPROT Homolog: EC 3.6.3.14 H(+)-transporting two-sector ATPase
ctggagctccccgcggtggcggccgctctagaactagtggatcccccgggctgcaggaattcgcacgagaccattacctagaacatcctaatcgaaaaagaattcctgtcactgctcgaaatcgatccgatctccgctcgcgctgaagcctgatctccaccgggttcgcagcaggggcgcaggacctcgatcacgaggaggcaggggagcagcatccacaaccacaagccatggcgggggaggggccaacatccccactaacaactccgccctcatcgcaatcatcgccgacgaggacaccgtcactggcttcttgatgggcggcgttggcaatgttgatctgcgcaagaaaaccaactacctcctcgtcgacaacaagacgacagttaaacaaatcgaggatgcgttcaaagaatttactacgaggggaggatattgctattgtgctcatcagtcagtatattgccaacatgataaggtttctgggggatagctacaacaagcccgtccttgctattctggagatccatccaaggaccatccttatgatccaggcgcacgactctgtgctctctccagtgaaatatctggtcctctgcaaaatcgggggccttctgaaagccaataaaagcatcccttgcgtaaccaacccccttccgaagcatcttattttgttatgggatttaaaaaaaaaaatggccccttacccttt

SEQ ID NO: 45698 - DNA, 751 bp, Zea mays
  misc_feature: Ceres CLONE 1449954-F
  misc_feature: Encodes the peptide sequence at SEQ ID NO. 45699
  misc_feature (208)..(208): n is a, c, t, g, unknown, or other
  misc_feature (327)..(327): n is a, c, t, g, unknown, or other
  misc_feature (491)..(491): n is a, c, t, g, unknown, or other
  misc_feature (554)..(554): n is a, c, t, g, unknown, or other
ctccccgcggtggcggccgctctagaactagtggatcccccgggctgcaggaattcgcacgagaccattacctagaacatcctaatcgaaaagattcgaaacaggataccaaatgcatgatcgatcccacaagccgcagccggcggaggccggcaacggcgggccggctggcgagggcggcggcgggaacgtggatcgggtgctcttncagaactcgtcgagatggtgccgctcgtcgagtcgctcatggaccggagggtcaacccggcatactcgcgtcgcgcttcgctggtctacacgccggcgccgccccagaaggcaagcganttgaaaagtgtcaaattgccacagagcgtatcagccaaaaaagcgagagaccctggtgatatagccaagaagagcaccccaaattctaacgggcgacacggttcagttgtgccattatctctgtcaggtgctgaaaatatgcccaaggatgaggttgctgtgcntagcgagcagatcaatgacctacaaaagaagctgcttgagaaggaggaggcactgaggtctgncgagagctctgtgactgagatgaatgcagcatatgcaactatcgatgaactcagacgcctggtggctgacaaggaagctttgatcagatctaccaattctcagttgcatgatgcaaagattatgcttgcaaacaagcaggcgtctttagagaaactgtgatggaaggtgaattgtcaaataaaaaggccgagatctt

SEQ ID NO: 45699 - protein, 163 aa, Zea mays
  misc_feature: Ceres CLONE 1449954-F
  misc_feature (35)..(35): Xaa is any aa, unknown, or other
  misc_feature (90)..(90): Xaa is any aa, unknown, or other
  misc_feature (111)..(111): Xaa is any aa, unknown, or other
MVPLVESLMDRRVNPAYSRRASLVYTPAPPQKASXLKSVKLPQSVSAKKARDPGDIAKKSTPNSNGRHGSVVPLSLSGAENMPKDEVAVXSEQINDLQKKLLEKEEALRSXESSVTEMNAAYATIDELRRLVADKEALIRSTNSQLHDAKIMLANKQASLEKL

SEQ ID NO: 45700 - DNA, 767 bp, Zea mays
  misc_feature: Ceres CLONE 1449959-F
  misc_feature: Encodes the peptide sequence at SEQ ID NO. 45701
  misc_feature (371)..(371): n is a, c, t, g, unknown, or other
  misc_feature (377)..(377): n is a, c, t, g, unknown, or other
  misc_feature (611)..(611): n is a, c, t, g, unknown, or other
aagctggagctccccgcggtggcggccgctctagaactagtggatcccccgggctgcaggaattcgcacgagaccattacctagaacatcctaatcgaaaactctctctgaccttatccccttgcggcaaaaccttgcgcgcaacaatggccgcctccctcccgaccacggccgcgcgcctcgcggccccggccttcgcctaccggtcgcccaaggctccctccgccaccgccctcccgcgtgccgccgccttccctgcaatcgccgtcgcggcggcgcccctgcgcccgcgccgcgcgccgaggccggtggcggcccgggccgggggcgaggagcgggagacgatactgctccccgggtgcgactacaantattgnactaatcgtcatggagttcccccaggaccccgcgcccacccgcgagcaaatgatcgacacctacctcaacacactcgccaccgtcctcggcagcttggaggaagccaagaagaacttgtacgcattcagcacaaccacctacaccgggttccagtgcaccgtggaacaggaaacctcggaaaaattccagggtcctgctgggggagctgggggtgctccctgatccctaacttnaagggaaaaaacagggctacgggaggtgacaagtacgtgaacgcggaaaaaatcccccggcactaccccaacgtaccagccggagggatcggaagacgtcccaggtccgaaagcccggcggacacaagggccagaaaggaggggccccggggggca

SEQ ID NO: 45701 - protein, 207 aa, Zea mays
  misc_feature: Ceres CLONE 1449959-F
  misc_feature (75)..(75): Xaa is any aa, unknown, or other
  misc_feature (77)..(77): Xaa is any aa, unknown, or other
  misc_feature (155)..(155): Xaa is any aa, unknown, or other
MAASLPTTAARLAAPAFAYRSPKAPSATALPRAAAFPAIAVAAAPLRPRRAPRPVAARAGGEERETILLPGCDYXYXTNRHGVPPGPRAHPRANDRHLPQHTRHRPRQLGGSQEELVRIQHNHLHRVPVHRGTGNLGKIPGSCWGSWGCSLIPNXKGKNRATGGDKYVNAEKIPRHYPNVPAGGIGRRPRSESPADTRARKEGPRGA

SEQ ID NO: 45702 - DNA, 745 bp, Zea mays
  misc_feature: Ceres CLONE 1449963-F
  misc_feature: Encodes the peptide sequence at SEQ ID NO. 45703
  misc_feature (524)..(524): n is a, c, t, g, unknown, or other
  misc_feature (539)..(539): n is a, c, t, g, unknown, or other
  misc_feature (548)..(548): n is a, c, t, g, unknown, or other
aaagctggagctccccgcggtggcggccgctctagaactagtggatcccccgggctgcaggaattcgcacgagaccattacctagaacatcctaatcgaaaaatcccaatcgccgagaaggggaagccaaatcgatggcggcggcggcggccggcggcgagaacagcggcgcgggcgcgggcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggttttcgtatccccctccgtcctccgcgaggccaggaggatcatccaggagtccgatatcatgaaggaggacgacagcaactggcccgagcccgaccgcatcggccgacaggagctcgagatcgtcatgggcaacgagcacatttcattcaccacttccaagatcggctccctcgtcgatgtccagtccagncaggacccggagggnactcggatnctctactacctcgtccaggatctgaagtgcttcgtggtttcactcatcaccctccactttcagatcagccaatccagtcttgagctcatctcaagcctcatgcgactgtttttggagcgttttagagagaacttgtacatgttaaatactggtgagctgtgacgatgccaccgtaaaagaggaacttttttttttgg

SEQ ID NO: 45703 - protein, 191 aa, Zea mays
  misc_feature: Ceres CLONE 1449963-F
  misc_feature (21)..(163): Pfam Name: Mago_nashi Pfam Description: Mago nashi protein
  misc_feature (130)..(130): Xaa is any aa, unknown, or other
  misc_feature (138)..(138): Xaa is any aa, unknown, or other
MAAAAAGGENSGAGAGAGEGEFYLRYYVGHKGKFGHEFLEFEFRPDGKLRYANNSNYKNDTMIRKEVFVSPSVLREARRIIQESDIMKEDDSNWPEPDRIGRQELEIVMGNEHISFTTSKIGSLVDVQSXQDPEGTRXLYYLVQDLKCFVVSLITLHFQISQSSLELISSLMRLFLERFRENLYMLNTGEL

SEQ ID NO: 45704 - DNA, 779 bp, Zea mays
  misc_feature: Ceres CLONE 1449968-F
  misc_feature: Encodes the peptide sequence at SEQ ID NO. 45705
aagctggagctccccgcggtggcggccgctctagaactagtggatcccccgggctgcaggaattcgcacgagaccattacctagaacatcctaatcgaaaacaccgcagccctagcgcgccgccaccttcaccttcgcagccctagccgccgccgccgcctccattgctgctatacccgcaaccatgggtcccgtgctgaagcgcccgaccccgggcacagtgcagtgtttcgggcgcaagaggacggccgtgggcgtggcctacacgaagcccaggcgaaggatgatcagggtgacgggcgtcccgatcgagctgctccgtcccgagatgctgcgggtcaagggcatggaacccgtgctgctgggggggccggcccaggttcaaggaatcaaactgcggatcccgggcgccgccccgggaaaaactcaatattttacccttccccacgggcttcccaagggtctctgggctattccccaaattccctcaaaaaggcggaaaaaagagaaaaaagggattttttttggggttaaaggccccctttctggcgcaaacccccgccgttggaaacaaaaatttggggggcggcgcccccccccggtttaaaaaactcctccctgaccccccccccccccaaaaacgtgggggccccttttttccccttttttaaacactttaaaaacggggggggggggccacgcccccccccctttttttttttttttttattgggggggggccccaaagaagggggggggggccccataaattattacaa

SEQ ID NO: 45705 - protein, 140 aa, Zea mays
  misc_feature: Ceres CLONE 1449968-F
  misc_feature (17)..(136): Pfam Name: Ribosomal_S9 Pfam Description: Ribosomal protein S9/S16
MGPVLKRPTPGTVQCFGRKRTAVGVAYTKPRRRMIRVTGVPIELLRPEMLRVKGMEPVLLGGPAQVQGIKLRIPGAAPGKTQYFTLPHGLPKGLWAIPQIPSKRRKKEKKGIFFGVKGPLSGANPRRWKQKFGGRRPPPV

SEQ ID NO: 45706 - DNA, 802 bp, Zea mays
  misc_feature: Ceres CLONE 1449971-F
  misc_feature: Pfam Name: DAGK_acc Pfam Description: Diacylglycerol kinase accessory domain
  misc_feature (30)..(30): n is a, c, t, g, unknown, or other
  misc_feature (38)..(38): n is a, c, t, g, unknown, or other
  misc_feature (422)..(422): n is a, c, t, g, unknown, or other
  misc_feature (424)..(424): n is a, c, t, g, unknown, or other
  misc_feature (524)..(524): n is a, c, t, g, unknown, or other
  misc_feature (587)..(587): n is a, c, t, g, unknown, or other
tctctttttctaacccatccttctcctccncccctganaaattaaaaaggtaaactccccgcgggggcggccgctctagaactagtggatcccccgggctgcaggaattcgcacgagaccattacctagaacatcctaatcgaaaataaatttatacaattatggcagtggaaggcatccatggggtgatctaagacctgagtatctcgaaaagaaaggctttgttgaagcccattcagatgatggcttgcttgaaatatttggtctgaaggaaggttggcatgcttcatttgtcatggccgagcttatcaaagcaaagcacattgcccaggctgcggctatcaagttcgaaatgaggggtggcgagtggaaccgagcatatgttcagatggacggagagccgtggaaacaaccgttgttananaagcactcaaccatcgtggaaataaacaaagttccgtatcattctctcatgataaacggggagtaatgagatttttactccgtcaaccacattgaaccanggttgcattcatagatcgttaggatcgtgtacagttcaagagcagcgggcactagatccttanaactgggtcggacggactgcaaccaggatggcatgcatgttcgttggccttttgtcctgctatggtcgaagccatggccggagcgggatgtggcaccatgcattgttgtattcgtaccataatatgtgcgttggtgtatcctaaattctttttgaaggaaacatgaatgatttgtttgtcataaaaaccatactcaaacaaaacaaacttattgt

SEQ ID NO: 45707 - DNA, 789 bp, Zea mays
  misc_feature: Ceres CLONE 1449973-F
  misc_feature: Encodes the peptide sequence at SEQ ID NO. 45708
  misc_feature (159)..(159): n is a, c, t, g, unknown, or other
  misc_feature (217)..(217): n is a, c, t, g, unknown, or other
  misc_feature (280)..(280): n is a, c, t, g, unknown, or other
  misc_feature (300)..(300): n is a, c, t, g, unknown, or other
  misc_feature (322)..(322): n is a, c, t, g, unknown, or other
  misc_feature (497)..(497): n is a, c, t, g, unknown, or other
  misc_feature (536)..(536): n is a, c, t, g, unknown, or other
  misc_feature (576)..(576): n is a, c, t, g, unknown, or other
tggagctccccgcggtggcggccgctctagaactagtggatcccccgggctgcaggaattcgcacgagaccattacctagaacatcctaatcgaaaaatcaaccgcagtacacggcgtatcattcccagcgaccacgagagactagctagccaagtgcnatgcaccagccatgcaggccgggaagacggcagtggaggcgacgaaaggaggccgcgnccaacgtcggggcctcggcgaacgcgggcatgcagaagacccgtgccgcccgtgcaggccagntggagaagggcacggcgcgncacgcgtcggacaaggtcgcgnccgaggagcgccagcgggagcgcgtgcgcgccccggagcttgagaagcaggacgccgtgcgcgccaacgcggccgcgaaaggacgcgccattggggggcgcggccacgtaccagcaccagcacccgtcgcaggccgcgcccgggatccgcgcccaacaggagtatgggcggcggnaaatcccccccgcgggcgggcacctcaaggccggggttnggcaaaacccgtcccttcccttaggggcacgggaacgggnggggcccaagggcccgaaaaaacgcgtttggggggaggcgaatttttcggaggccgcgcggcacccggggaaaataccagtgaagcggctcccccccggaacttccccctaactttggaattttcttggggtgtaaaaaaggcttttcccccaaggggccccccggggaatattctctcgcaaaaaaaatggccccccaaaggggtttaaaaa

SEQ ID NO: 45708 - protein, 208 aa, Zea mays
  misc_feature: Ceres CLONE 1449973-F
  misc_feature (20)..(20): Xaa is any aa, unknown, or other
  misc_feature (41)..(41): Xaa is any aa, unknown, or other
  misc_feature (55)..(55): Xaa is any aa, unknown, or other
  misc_feature (113)..(113): Xaa is any aa, unknown, or other
  misc_feature (126)..(126): Xaa is any aa, unknown, or other
MHQPCRPGRRQWRRRKEAAXNVGASANAGMQKTRAARAGQXEKGTARHASDKVAXEERQRERVRAPELEKQDAVRANAAAKGRAIGGRGHVPAPAPVAGRARDPRPTGVWAAXNPPRGRAPQGRGXAKPVPSLRGTGTGGAQGPEKTRLGGGEFFGGRAAPGENTSEAAPPRNFPLTLEFSWGVKKAFPPRGPPGNILSQKKWPPKGV

SEQ ID NO: 45709 - DNA, 718 bp, Zea mays
  misc_feature: Ceres CLONE 1449978-F
  misc_feature: Encodes the peptide sequence at SEQ ID NO. 45710
tggagctccccgcggtggcggccgctctagaactagtggatcccccgggctgcaggaattcgcacgagaccattacctagaacatcctaatcgaaaaaactctataactcggtcaccacacctcgctcgaaaacaaaactgatcaacagcattgttggtgacgatgagctcgacgtggctagcgtttgcatgggcggcgtccgccctcgtcgtggcggcgtccacggcccacgccccgcaccacccgtcgtcgctgcaggtcggtttctacaagcactcgtgcccacaggccgaggacatcgtgcgcaacgccgtccgccgcggcctggcccgcgacccgggcatcggcgcgggactcatccggatgcacttccacgactgcttcgtccggggctgcgacgcctcaatcctcatcaactccacgccgggcaacctagccgagaaggactccgtggccaacaaccccagcatgcgcggcttcgacgtcatcgacgacgccaaggccgtccctcgagcgcactgcccgcgcaccgtctcctgcgccgacatcgtcgcgtttcgcgcccgcgacagcgcctgctccgccggcggcctcgagtacgaggtcccctcggggcgccgcgacggccgagtttcagaacagacgaagtgctcgacaacatgtccccacaccaaccgacgacgtcgccgagctcatcgagagcttcagcgcaagggc

SEQ ID NO: 45710 - protein, 185 aa, Zea mays
  misc_feature: Ceres CLONE 1449978-F
  misc_feature (47)..(184): Pfam Name: peroxidase Pfam Description: Peroxidase
  misc_feature: SWISSPROT Homolog: EC 1.11.1.7 Peroxidase
MSSTWLAFAWAASALVVAASTAHAPHHPSSLQVGFYKHSCPQAEDIVRNAVRRGLARDPGIGAGLIRMHFHDCFVRGCDASILINSTPGNLAEKDSVANNPSMRGFDVIDDAKAVPRAHCPRTVSCADIVAFRARDSACSAGGLEYEVPSGRRDGRVSEQTKCSTTCPHTNRRRRRAHRELQRKG

SEQ ID NO: 45711 - DNA, 608 bp, Zea mays
  misc_feature: Ceres CLONE 1449979-F
  misc_feature: Encodes the peptide sequence at SEQ ID NO. 45712
  misc_feature (252)..(252): n is a, c, t, g, unknown, or other
ggagctccccgcggtggcggccgctctagaactagtggatcccccgggctgcaggaattcgcacgagaccattacctagaacatcctaatcgaaaactattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccnagatccatggacaggaagggatcccgccgggacagcagcggctgatctttgccgggagcagctggaagatggccgcacccttgcggactataacatccaaaaagggagtctacgctcccctcgtgctcagctccgcggtggatcattgaccccccctggaggggctcgtccaagtccacccggaacaatggactgccccaatgtttgcccggctcccccctaggcttgccacttgcccaaaaagaagggggccccccacccgcgttagggccaaaaaaaaaatcaaaaccgggggggtgcctccaacccttttctggaaaattttttttggttttaaacccgtgttttttcaacaa

SEQ ID NO: 45712 - protein, 77 aa, Zea mays
  misc_feature: Ceres CLONE 1449979-F
  misc_feature (6)..(76): Pfam Name: ubiquitin Pfam Description: Ubiquitin family
  misc_feature (29)..(29): Xaa is any aa, unknown, or other
MQIFVKTLTGKTITLEVESSDTIDNVKAXIHGQEGIPPGQQRLIFAGSSWKMAAPLRTITSKKGVYAPLVLSSAVDH

SEQ ID NO: 45713 - DNA, 751 bp, Zea mays
  misc_feature: Ceres CLONE 1449980-F
  misc_feature: Encodes the peptide sequence at SEQ ID NO. 45714
  misc_feature (411)..(411): n is a, c, t, g, unknown, or other
ctggagctccccgcggtggcggccgctctagaactagtggatcccccgggctgcaggaattcgcacgagaccattacctagaacatcctaatcgaaaaacgccgttcactctctctctagtctctccctttccttctccacgcttccgctcccactcgtgaagccctagcgccagcaccacccgcccaaactcccggagagagagagagagaggaggaggccttcaccgccgctgttaccgtcggccgaggcgccaggatgttcgggtaccagaagggcctcgacgtcgaggcggggacatccggagccgccgccactggcggcgcgcgccagctctacccggggatgcaggagagccccgagctgcgctgggcgctcatccgcaagatctacgtcattctctccctccanctgctcccctcacgcgtcgtcgccgcagtcgtcgtcaagggtcgcgccatcccgcacttcttcaccaccaccagcgccggcctcggcctctacatcttcctcatcatcctcccctttatcgtgctgtgcccgctgtacttctaccacgagaagcacccagtcaacctgatcctgctcggcctcttcaccgttgccatcagctttgctgtgggcatgacatgtgccttcaccagtgcaagggtcattctggagtctgcaattctgaaaacggtggtcgtgctcagccttaccgatacactttctggggcgggaataggggcaaagacttcagcttctgggt

SEQ ID NO: 45714 - protein, 164 aa, Zea mays
  misc_feature: Ceres CLONE 1449980-F
  misc_feature (51)..(51): Xaa is any aa, unknown, or other
MFGYQKGLDVEAGTSGAAATGGARQLYPGMQESPELRWALIRKIYVILSLXLLPSRVVAAVVVKGRAIPHFFTTTSAGLGLYIFLIILPFIVLCPLYFYHEKHPVNLILLGLFTVAISFAVGMTCAFTSARVILESAILKTVVVLSLTDTLSGAGIGAKTSASG

SEQ ID NO: 45715 - DNA, 747 bp, Zea mays
  misc_feature: Ceres CLONE 1449982-F
  misc_feature: Encodes the peptide sequence at SEQ ID NO. 45716
  misc_feature (656)..(656): n is a, c, t, g, unknown, or other
  misc_feature (663)..(663): n is a, c, t, g, unknown, or other
  misc_feature (664)..(664): n is a, c, t, g, unknown, or other
tggagctccccgcggtggcggccgctctagaactagtggatcccccgggctgcaggaattcgcacgagaccattacctagaacatcctaatcgaaaagagcattgtatgtagaagtgccgatgtagctgttagggttgaaagtcaactcaaacttgtcatcaggcctatgtattcaaaccctcctcttcatggtgcctctatcgtggctaccatactcagggacagcgagatgttcaacgaatggactctggaactgaaggccatggctgataggatcattaacatgaggcaacaactatttgatgctctgaaatccagaggaacccctggagattggagccatatcattaagcaaattgggatgtttactttcactgggctgaatagcgaacaagtggcattcatgaggcaggaataccacatttatatgacatctgatgggaggatcagcatggccggtttgagcatgaggactgtgccccatcttgcagatgccatacacgctgcagttactcaactgaaaatgagatagtatcgcagctttcgtgaataaacctgaaatcaccacatcaaatgtctaagtactcagccagtggtatttactgggtgacctactgtagtttgcgtcggaatagatatgtttttttttactctngtcgggnngcagttttgtactggtggattcaataagactctgaataatggtgccgtcggaacttataataatagcacatgaaattttgctc

SEQ ID NO: 45716 - protein, 121 aa, Zea mays
  misc_feature: Ceres CLONE 1449982-F
  misc_feature: SWISSPROT Homolog: EC 2.6.1.1 Aspartate transaminase
MYSNPPLHGASIVATILRDSEMFNEWTLELKAMADRIINMRQQLFDALKSRGTPGDWSHIIKQIGMFTFTGLNSEQVAFMRQEYHIYMTSDGRISMAGLSMRTVPHLADAIHAAVTQLKMR

SEQ ID NO: 45717 - DNA, 806 bp, Zea mays
  misc_feature: Ceres CLONE 1449983-F
  misc_feature (261)..(261): n is a, c, t, g, unknown, or other
  misc_feature (262)..(262): n is a, c, t, g, unknown, or other
  misc_feature (286)..(286): n is a, c, t, g, unknown, or other
  misc_feature (288)..(288): n is a, c, t, g, unknown, or other
  misc_feature (294)..(294): n is a, c, t, g, unknown, or other
  misc_feature (295)..(295): n is a, c, t, g, unknown, or other
  misc_feature (370)..(370): n is a, c, t, g, unknown, or other
ctggagctccccgcggtggcggccgctctagaactagtggatcccccgggctgcaggaattcgcacgagaccattacctagaacatcctaatcgaaaactctccgccggcccgctcactctccctggtctctcgtctcctccactccaagagaacaggcgccggcgaaaggcgggagcagcgcgctacccattcaccgccccctgatttcttgggagttgcggatcggtctccggggcagcgtggaacggctgggcccctnncgatcgcggagatgctgccctacncnacggcnngcgaagcggaagtggcccttggccggccatgacgcccgccgaggcgctgtggttccgtaccccgcaggggggtcngactaccacctcactggtgaaaatcccttcccccttcgcggtttaaggggggcccctttccaatggggtccttaaggctcgggcccgggcccgggtttcgccgataaaatgggaacccggggggggggttccacggggcaaatttcccccggtggaaaaggaagatcccccggatttttttccctcgtaatgggccgccccagtttttttctccaaccgggggaaaaattggggggaaaaccaaaaatatgcctttcccccccctggggggggggggccacccctgggtgggttcttcttgggggaggcccccatttttggggcccccggttttccccggggggggggggggagaaaaaaaccccggggttccaaaaatagttccgccaaaaaaaatctccccccccctcccccgggggggggggtggggctaacc

SEQ ID NO: 45718 - DNA, 756 bp, Zea mays
  misc_feature: Ceres CLONE 1449985-F
  misc_feature: Encodes the peptide sequence at SEQ ID NO. 45719
  misc_feature (666)..(666): n is a, c, t, g, unknown, or other
tggagctccccgcggtggcggccgctctagaactagtggatcccccgggctgcaggaattcgcacgagaccattacctagaacatcctaatcgaaaacctttctgtcctgtcagctactacccactggccactgcactagccgtctgccgagccgagtgttcctttctagccttcacttctcagcgcggcagccttcgatcccccgactgcagccgccagccgcaccatggagcaagccgccatgccgcaggttccccgcgtcaagctcggcatccaggggcttgaggtgtcgaagctggggttcgggtgcatggggctcacgggcacctacaacgcgccgctcggcgacgaggccgtcgcccgcgtcgtcgcgcacgccttccgccgcgggatcaccttcttcgacacctccgatgcctacgggccccgcaccaacgagaccctcctgggggaggcgctcaagcagctgccgaaggagcaggtgcaggtggccaccaagttcggggatagccagggcgccgctggcatgaccgtgtgcggcacgcccgagtacgtacgcgcctgctgcgaggcagcctgcgccgcctcgacgccggctacatcgactctactaccagcaccgcgtcgacaccaccgccctatcgaggatacgatggtgagctcanaaattggtggaagaggggaaagttcagtacatcggcttgtcagaggccagcccagaccattcgccgggcgcacgcgggcatcccatcacc

SEQ ID NO: 45719 - protein, 176 aa, Zea mays
  misc_feature: Ceres CLONE 1449985-F
  misc_feature: SWISSPROT Homolog: EC 1.1.1.107 Pyridoxal 4-dehydrogenase
  misc_feature (147)..(147): Xaa is any aa, unknown, or other
MEQAAMPQVPRVKLGIQGLEVSKLGFGCMGLTGTYNAPLGDEAVARVVAHAFRRGITFFDTSDAYGPRTNETLLGEALKQLPKEQVQVATKFGDSQGAAGMTVCGTPEYVRACCEAACAASTPATSTLLPAPRRHHRPIEDTMVSSXIGGRGESSVHRLVRGQPRPFAGRTRASHH

SEQ ID NO: 45720 - DNA, 950 bp, Zea mays
  misc_feature: Ceres CLONE 1449990-F
  misc_feature: Encodes the peptide sequence at SEQ ID NO. 45721
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (36)..(36): n is a, c, t, g, unknown, or other
  misc_feature (601)..(601): n is a, c, t, g, unknown, or other
tcccttgtctcactctagnnnnannnnccccccccncaaaactgggctcccctcggaggcggccgctctttactagtggatcccccgggctgcaggtattcgcacgagaccattaccagaacatcctaatcgaaaaaaaatctgcacgagagacttacaacgagatggccgatgccgaggacgccgccgccgcgcgccgacgggccgccataaccgactaccgcaagaagctgctcaactgcagggagctcgagtcgcgcgtcggccccgtgagagaaagccttaaaatgcaaagagggtttttaccaagactgaagacgacttgaaatctctgcatagcgtgggggcaataattggagaggttctccaacctctggataatgaacgcttttattgtgaagggtagggggggacccccgatttgtgtgtccggttccccaaactaaattaaaaaagggcccccccccaacctccgggaacttcggggttgtctcttggggcgtggcccaaccctcggaccaaaaattggcgcaatctctttcccaggggggagggtgggatatcctggtgggtttttattaatctttgttctcttattganagagtgcccggggaaagggggtccaggttatcttgcctcggttgtcaccgccgtcttttgtctcttatttcccgcatttgggggatcttcccgtggggagtcctcgttttgcagttaccccacttttttgtgaagcccccggtaatctctttttctttgtgggggggggaaatttctaggccctccctaaggtggtggtgtttcccgttcgtgcggtgtcctccctgggaaactgggtggttacacctttattcggctagggtggtatctggtccgttaccctcccttctgtcatattttttttacacggttttgtctctgggcgtcttcttattgctgatcttcattg

SEQ ID NO: 45721 - protein, 53 aa, Zea mays
  misc_feature: Ceres CLONE 1449990-F
MADAEDAAAARRRAAITDYRKKLLNCRELESRVGPVRESLKMQRGFLPRLKTT

SEQ ID NO: 45722 - DNA, 757 bp, Zea mays
  misc_feature: Ceres CLONE 1449992-F
  misc_feature: Encodes the peptide sequence at SEQ ID NO. 45723
  misc_feature (527)..(527): n is a, c, t, g, unknown, or other
  misc_feature (535)..(535): n is a, c, t, g, unknown, or other
  misc_feature (554)..(554): n is a, c, t, g, unknown, or other
aagctggagctccccgcggtggcggccgctctagaactagtggatcccccgggctgcaggaattcgcacgagaccattacctagaacatcctaatcgaaaaccactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaaatatgattcgtctggtctggcgcgcgtgagtccagctcgtgtgtcgtgcgtgtctctgtgtgaagtgtccgcgggcgtgtgtgtatgtatggagtcggccncgggcgcngccgaggaagaagtgtgcnctttgtgggtggtacgtgcttcgacgcgccactgtttgtcgcggcgatcatgtactaccctgctgcgtttttctggtatcaatgagatgatttatttgattccaaaaaaaaaaaaaaaagctaatcgataccgtcgacctcgaggggggggccgggtacccaattcgccctaaaatgagtcgaattacccgcggctcctgggc

SEQ ID NO: 45723 - protein, 57 aa, Zea mays; identical to SEQ ID NO: 43282
  misc_feature: Ceres CLONE 1449992-F

SEQ ID NO: 45724 - DNA, 735 bp, Zea mays
  misc_feature: Ceres CLONE 1449995-F
  misc_feature: Encodes the peptide sequence at SEQ ID NO. 45725
  misc_feature (252)..(252): n is a, c, t, g, unknown, or other
  misc_feature (280)..(280): n is a, c, t, g, unknown, or other
  misc_feature (352)..(352): n is a, c, t, g, unknown, or other
  misc_feature (394)..(394): n is a, c, t, g, unknown, or other
  misc_feature (438)..(438): n is a, c, t, g, unknown, or other
  misc_feature (464)..(464): n is a, c, t, g, unknown, or other
  misc_feature (555)..(555): n is a, c, t, g, unknown, or other
  misc_feature (558)..(558): n is a, c, t, g, unknown, or other
  misc_feature (565)..(565): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
ctggagctccccgcggtggcggccgctctagaactagtggatcccccgggctgcaggaattcgcacgagaccattacctagaacatcctaatcgaaaatacttccggcagccatgcaccctcatgtccagcatatcgacgcagagtcgcagtcgcagcacacactgaattctctttagctagctaagagagggtagccacaccaagacaggatgcagacagcgaaggtgaaggcgaaggacatggtgagctncgcgaaggagaaggtgaaggaggggtcngcaaagatgcaggccaagacgggcgaggcgacggcggccacgcacggcgagaaggagatgggccaagaggcngcccgcgccaagaaggaccagggccacgccgaacagcaccangagaaaggcgaccaccgagcggacgccggcactgggcaccacgnaacgcgcgtgcccctcaccggcccgnacggcaccacggcgctggggcggcgtcgaccccgcgtacccgtcctccggaacacgtaccccgggtcggcaaatacatctaggtgactgcntcngatggcnagggcagggtcgtggtcccacttgcgtttttgggtacgtagcgaccaagagatcgatcctggctgtacgcctgcagtaccggaccaactggtatttgagagggtatgcggggccacttgccgtgcccccaatctctgataaaagccatgtnnnnnnnnnnntgggggggg

SEQ ID NO: 45725 - protein, 112 aa, Zea mays
  misc_feature: Ceres CLONE 1449995-F
  misc_feature (1)..(73): Pfam Name: LEA_1 Pfam Description: Late embryogenesis abundant (LEA) group 1
  misc_feature (14)..(14): Xaa is any aa, unknown, or other
  misc_feature (61)..(61): Xaa is any aa, unknown, or other
  misc_feature (76)..(76): Xaa is any aa, unknown, or other
  misc_feature (85)..(85): Xaa is any aa, unknown, or other
MQTAKVKAKDMVSXAKEKVKEGSAKMQAKTGEATAATHGEKEMGQEAARAKKDQGHAEQHXEKGDHRADAGTGHHXTRVPLTGPXGTTALGRRRPRVPVLRNTYPGSANTSR

SEQ ID NO: 45726 - DNA, 764 bp, Zea mays
  misc_feature: Ceres CLONE 1449996-F
  misc_feature: Translation starting site: 163
  misc_feature (265)..(265): n is a, c, t, g, unknown, or other
  misc_feature (322)..(322): n is a, c, t, g, unknown, or other
  misc_feature (323)..(323): n is a, c, t, g, unknown, or other
  misc_feature (337)..(337): n is a, c, t, g, unknown, or other
  misc_feature (340)..(340): n is a, c, t, g, unknown, or other
  misc_feature (348)..(348): n is a, c, t, g, unknown, or other
aagctggagctccccgcggtggcggccgctctagaactagtggatcccccgggctgcaggaattcgcacgagaccattacctagaacatcctaatcgaaaaaaggaaacagtcacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcgcccgctgcntgggcggtggacccgatccctgacgtgagcgactcgcacatcccagagctaggcggnntgggcgctgggcangcnaaacaccnaaagctggcgccgaacggctgccgttccccgcgtggtgcgccgcaagcacaagtcttgcccggattaactacccctttactttaaaccccccaaccccgccggcgaacgtgccctaattccccctttgtacaaaagggttggacccaaacccccaattccctcctttaacggggccccccgcccccttaaacataaccacccgggggggccaaaacactttcccccaatttcgggcaaaaaaacaaaaaaggggcccaaaaaaaaaaaaagggtccccccggcccatggggcctataaaaaaaccgggatttgggggggaaaaaaaacccctttttctctctcggggggaaaaaaaaccctctttaaaaacaccccccaaagggcgccctcttttttttttccaccccacccccca

SEQ ID NO: 45727 - DNA, 729 bp, Zea mays
  misc_feature: Ceres CLONE 1450004-F
  misc_feature: Encodes the peptide sequence at SEQ ID NO. 45728
  misc_feature (382)..(382): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
ggagctccccgcggtggcggccgctctatcactagtggatcccccgggctgcaggaattcgcacgagaccattacctagaacatcctaatcgaaaactccatcaaaagaaggcagggaaagatctgatctggggggtgagagagcaggaggagaaagccaagccattgccctcccctcttgaaggcttggagcttggttctacatcctcttctcttcccctccgtctctctctctctctctatttggtttgcttgcttgcctctactagactctagtcgtcgggtccggccatggccaccatcctggagaacatccagaaggcgaggttcctgccgaccaggccgctcaaggacgagctgcccaccttccagggcggcggcnagagcaaggaggagagccacctaccgcccctgaagaagcggctgtccagcttctccggaaagatcagcccatctcttcgcgttcgccgccgagtggccgtcccgccgctccaagtcggcccttcctcggcgccccttttgcccgggggggggccccctaagcatgggggcagggggctccgctggctcttttccaaaacccgggtctcgcggaaaccttaaaaaaaagggaagcgccccctcctgggctcctcaataaggtaattttggacccccctcctaaaaaagaatttactttaccttttcctcgtccgcacgacacgcctaccacaattaacgcannnnnnn

SEQ ID NO: 45728 - protein, 103 aa, Zea mays
  misc_feature: Ceres CLONE 1450004-F
  misc_feature (31)..(31): Xaa is any aa, unknown, or other
MATILENIQKARFLPTRPLKDELPTFQGGGXSKEESHLPPLKKRLSSFSGKISPSLRVRRRVAVPPLQVGPSSAPLLPGGGPPKHGGRGLRWLFSKTRVSRKP

SEQ ID NO: 45729 - DNA, 766 bp, Zea mays
  misc_feature: Ceres CLONE 1450005-F
  misc_feature: Encodes the peptide sequence at SEQ ID NO. 45730
  misc_feature (320)..(320): n is a, c, t, g, unknown, or other
  misc_feature (321)..(321): n is a, c, t, g, unknown, or other
  misc_feature (392)..(392): n is a, c, t, g, unknown, or other
  misc_feature (405)..(405): n is a, c, t, g, unknown, or other
  misc_feature (412)..(412): n is a, c, t, g, unknown, or other
  misc_feature (423)..(423): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (439)..(439): n is a, c, t, g, unknown, or other
tggagctccccgcggtggcggccgctctagaactagtggatcccccgggctgcaggaattcgcacgagaccattacctagaacatcctaatcgaaaaaaaaatcgaaaaccactcgaacacaaactcaggcaaggcaaaaggaacccgcaccatccgaggctcaagcagagaagtgatcatcatcatcagaagaagatgtgcccaaccaagaaggggatgaccggagagccgagctcgccatgcaggtcggcatcagcctcgaccttaccggagcaccaccagacggtgtggacgtcgcccgcgaagcggccagcggggnngggccgggaaaaccccaaagggttttccccgggggaaaaaacgcggcacccggtgttccgcggcgtccggncgccggggcagcnccgggcngtggggtgtgncaagtgcccnnncccngggaggcccggctgcaggctctggggtcgcacccttcaaaccggcgaaagggggggcccgggggcacaacccccccatggtcccccctccccgggccgggcccttggtgccctaatttcccaaatcggcctgggtccctcggggcccgggctttgggccacccctccaaagtcccccccggttccccgaacccggggagaaatctcccccccccaagggggccccggaagaaaaacccctttggggcaccccttttttctttcttcagaaaaagggacacccctttaggggggggagccccccttttttttcccccccccccggggg

SEQ ID NO: 45730 - protein, 176 aa, Zea mays
  misc_feature: Ceres CLONE 1450005-F
  misc_feature (42)..(42): Xaa is any aa, unknown, or other
  misc_feature (66)..(66): Xaa is any aa, unknown, or other
  misc_feature (70)..(70): Xaa is any aa, unknown, or other
  misc_feature (76)..(76): Xaa is any aa, unknown, or other
  misc_feature (80)..(80): Xaa is any aa, unknown, or other
MCPTKKGMTGEPSSPCRSASASTLPEHHQTVWTSPAKRPAGXGRENPKGFSPGEKTRHPVFRGVRXPGQXRAVGCXKCPXPGRPGCRLWGRTLQTGERGGPGAQPPHGPPSPGRALGALISQIGLGPSGPGLWATPPKSPPVPRTRGEISPPQGGPGRKTPLGHPFFLSSEKGTPL

SEQ ID NO: 45731 - DNA, 767 bp, Zea mays
  misc_feature: Ceres CLONE 1450020-F
  misc_feature: Encodes the peptide sequence at SEQ ID NO. 45732
  misc_feature (394)..(394): n is a, c, t, g, unknown, or other
aaagctggagctccccgcggtggcggccgctctatcactagtggatcccccgggctgcaggaattcgcacgagaccattacctagaacatcctaatcgaaaacttccaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcttaagtgtgaaattgagtactatgctatgctngccaaggtcactgtccccacaacccaccgaaacaatgtccaaccttggaactgcctgtggtaaatacttcccggcctgctgcctcagaaattattgatccgggtggttcttgatatcctcaagactacaccggggagagcagtaaaaaagcccctggccaaagggggaacctacctgacattggtcctcggtccttgggaaaaaaagatttacctgcataggaaacctaggcatgggaaaaaatgtcctcgaaatcaactttttgctaccgggcgctgcccccctaacaacggaacagaaaaacctgaatgccacccctccacactcaggggggtcccccgtgccccaatttttcctctccacgagatcgtac

SEQ ID NO: 45732 - protein, 86 aa, Zea mays
  misc_feature: Ceres CLONE 1450020-F
  misc_feature (12)..(86): Pfam Name: Ribosomal_L7Ae Pfam Description: Ribosomal protein L7Ae/L30e/S12e/Gadd45 family
MVATKKTKKSTDNINNKLQLVMKSGKYTLGYKTVLRTLRNSKSKLVIIANNCPPLLKCEIEYYAMLAKVTVPTTHRNNVQPWNCLW

SEQ ID NO: 45733 - DNA, 746 bp, Zea mays
  misc_feature: Ceres CLONE 1450033-F
  misc_feature: Encodes the peptide sequence at SEQ ID NO. 45734
  misc_feature (364)..(364): n is a, c, t, g, unknown, or other
  misc_feature (385)..(385): n is a, c, t, g, unknown, or other
  misc_feature (412)..(412): n is a, c, t, g, unknown, or other
  misc_feature (449)..(449): n is a, c, t, g, unknown, or other
  misc_feature (451)..(451): n is a, c, t, g, unknown, or other
  misc_feature (453)..(453): n is a, c, t, g, unknown, or other
  misc_feature (520)..(520): n is a, c, t, g, unknown, or other
ctggagctccccgcggtggcggccgctctagaactagtggatcccccgggctgcaggaattcgcacgagaccattacctagaacatcctaatcgaaaaaagtccactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacngcggggtgcagtgcggcggcnactgccagtgcgaccccctgcactgcngcaagtgagctaggtgctccaccctgcaggcccgccngnangaagctagctatttattataagctaaataaggtttagcgggcttccctgtgggggtttccaaggcanccagtccagttaattgcgggccctgggctggcattgccttaaacctaaaaaaaatttaaaacccccgaggggggggcccctggcctttgaacccccccccgcccccccccggggttttttgggggaaaaaaatttgtttttttttttttttttttggggggcaacaaaaaaaaaaaagaacaaccattgccgccgctgggttttgttcccaccaccccatatttat

SEQ ID NO: 45734 - protein, 82 aa, Zea mays
  misc_feature: Ceres CLONE 1450033-F
  misc_feature (1)..(80): Pfam Name: Metallothio_2 Pfam Description: Metallothionein
  misc_feature (65)..(65): Xaa is any aa, unknown, or other
  misc_feature (72)..(72): Xaa is any aa, unknown, or other
  misc_feature (81)..(81): Xaa is any aa, unknown, or other
MSCCGGNCGCGSGCKCGNGCGGCSKMYPDMAEQVTTTTQALIMGVAPSKGHAEGGFEAAAGAENXGVQCGGXCQCDPLHCXK

SEQ ID NO: 45735 - DNA, 721 bp, Zea mays
  misc_feature: Ceres CLONE 1450035-F
  misc_feature: Encodes the peptide sequence at SEQ ID NO. 45736
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
ggagctcaccgcggtggcggccgctctagaactagtggatcccccgggctgcaggaattcgcacgagaccattacctagaacatcctaatcgaaaaaacataccactgcactacagcaggttgcccagttctgcacccccttcttccttctctcacttgcattgcacaccgaaaacctcttcttcgtcaggcaggcatgaagcttggaggacaagggaggcagatggggaggctcaacagggccttcagggagaaaagggcaaggttctacattttccgccgctgcgtcgtcatgctgcttcgctggagcgattagatattggtctccatgggagatgacttcccctccattctagatgttttttatttttttggtttggagctagtatccattttggtagagttttagaatttaggcgtagttgctcacttgctctgtacaggatggccggccgtgtgctggttcgagtggcaatcttttttgttttctttgcttgcatgttgtttcaggcaagggtgactgatccagctctgtggtctgagattgccataatttgtactgctgaaagaagattggtatgaaaaatatgttgttgttaacggtnnnnnnnnnnnnnnnnnnnnnnnnnnnnnnnnnnnnnnnnnnnnnnnnnnnnnnnnnnttnnnnnnaaaaaaaaaaagcttatcgataccgtcaacctcgagggggggcccgttacc

SEQ ID NO: 45736 - protein, 39 aa, Zea mays
  misc_feature: Ceres CLONE 1450035-F
  misc_feature (18)..(36): Pfam Name: DVL Pfam Description: DVL family
MKLGGQGRQMGRLNRAFREKRARFYIFRRCVVMLLRWSD

SEQ ID NO: 45737 - DNA, 799 bp, Zea mays
  misc_feature: Ceres CLONE 1450039-F
  misc_feature: Translation starting site: 190
  misc_feature (371)..(371): n is a, c, t, g, unknown, or other
  misc_feature (390)..(390): n is a, c, t, g, unknown, or other
  misc_feature (412)..(412): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (721)..(721): n is a, c, t, g, unknown, or other
  misc_feature (736)..(736): n is a, c, t, g, unknown, or other
  misc_feature (738)..(738): n is a, c, t, g, unknown, or other
  misc_feature (739)..(739): n is a, c, t, g, unknown, or other
aagctggagctccccgcggtggcggccgctctagaactagtggatcccccgggctgcaggaattcgcacgagaccattacctagaacatcctaatcgaaaaactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaggccgggcggtgcatgggcctgtgcatgatgtgctgncgcaagtgccaggcctgcntgccgtcggggccgtacgccancaggaaaagtgcccctgctacagggactggaagccccccaaaaaccagccccccaagtgcccctaggccttaccgctcctaaggaaggaggatgaccccgaatttcccttcagaaccctggcagctctctagtttggaagcggaatttacccccccccaactctcaaaattgccacaggtctccccgggggggggggggggggttttcccccggggcgtgtataaccaaaaaaaacacccccccggggtttgggggggtgttttttttnnnnnnccccccgggggggggggcgcccgcccacccccccnagggggggaaaaaanannaaaaatttttttctcccccccgcgggggggggggcccccccccccttctttttttttttt

SEQ ID NO: 45738 - DNA, 704 bp, Zea mays
  misc_feature: Ceres CLONE 1450042-F
  misc_feature: Encodes the peptide sequence at SEQ ID NO. 45739
  misc_feature (404)..(404): n is a, c, t, g, unknown, or other
tccccgcggtggcggccgctctagaactagtggatcccccgggctgcaggaattcgcacgagaccattacctagaacatcctaatcgaaaaagtagtcctctcctcccatccatgcttcggtccacgcacccacccagccccaccagcggcagctccgcggcgccggcgtccagctccgacgccgcggcgatggtcgggggcggcgcggcggcgggcagcggcggcgcaccgagcggcgccaagctgctgcagatcctcaacgtgcgggtcgtgggcagcggcgaccgcgtggtggtgctgtcccacgggttcggcacggaccagtcggcgtggagccgcgtgctcccctacctcacccgcgaccaccgcgtggtgctctacgaccttcgtcctgcgccggganagcgtcaacccggagcacttcgacttcccgccgctacgacacgcttcgattcgtaggtcgacgaacctcctcggcatcccttgaggcgtttccgaatcggggggtggggcctttggtggggcaattcggtttccgcaaggaatgggaatcttcgcctccctccgcgggccccgaagtttttcccaaagtttggttctttgggggggggccccccaggtttcggaaaaacccccaaacaccacggggggtttaaaggcctcggaaaaaaccccagggggtttcaacccagggggggcccaa

SEQ ID NO: 45739 - protein, 115 aa, Zea mays
  misc_feature: Ceres CLONE 1450042-F
  misc_feature (98)..(98): Xaa is any aa, unknown, or other
MLRSTHPPSPTSGSSAAPASSSDAAAMVGGGAAAGSGGAPSGAKLLQILNVRVVGSGDRVVVLSHGFGTDQSAWSRVLPYLTRDHRVVLYDLRPAPGXRQPGALRLPAATTRFDS

SEQ ID NO: 45740 - DNA, 692 bp, Zea mays
  misc_feature: Ceres CLONE 1450046-F
  misc_feature: Encodes the peptide sequence at SEQ ID NO. 45741
  misc_feature (485)..(485): n is a, c, t, g, unknown, or other
  misc_feature (509)..(509): n is a, c, t, g, unknown, or other
  misc_feature (510)..(510): n is a, c, t, g, unknown, or other
ggagctccccgcggtggcggccgctctagaactagtggatcccccgggctgcaggaattcgcacgagaccattacctagaacatcctaatcgaaaaatcctctccgtgtaggccgcgggattccgtgtccctctccaatccggcgtagccatcgtcgccggatacaggatccggtccccgcgatggagccctcaccaacctcctcctcgccggctgtggcgcgccggttgtcgccggaggtaaggagggtgccgaagcgggcgctggaggagttgttggagcaggtccagcgggctgttgagatgctgcgcgatgccgacgctgatctcgccatctctctctcggaggagaccgcagcagcctcgccggaggccgaggaccgcaaggacgatgttggtgtcgatggagatggcatggcgacgtcgtcggttgcgagtgactccgattacgagacgacgcagatgtgtgaccttcttaaatctaangttggatcactcgagttccttcannaagctcatggtattcagaagtcagtagatcagaattgtgcagttgaatctgatacatcatgggatataataaagtccgatttgtgggagaatgtgactcaaatgatggaaatgttcttggtaaacagaaaatggggttgaaggaaccctttccttagggccggcagccgggaatacctaaaa

SEQ ID NO: 45741 - protein, 155 aa, Zea mays
  misc_feature: Ceres CLONE 1450046-F
  misc_feature (101)..(101): Xaa is any aa, unknown, or other
  misc_feature (109)..(109): Xaa is any aa, unknown, or other
  misc_feature (110)..(110): Xaa is any aa, unknown, or other
MEPSPTSSSPAVARRLSPEVRRVPKRALEELLEQVQRAVEMLRDADADLAISLSEETAAASPEAEDRKDDVGVDGDGMATSSVASDSDYETTQMCDLLKSXVGSLEFLXXAHGIQKSVDQNCAVESDTSWDIIKSDLWENVTQMMEMFLVNRKWG

SEQ ID NO: 45742 - DNA, 796 bp, Zea mays
  misc_feature: Ceres CLONE 1450051-F
  misc_feature: Encodes the peptide sequence at SEQ ID NO. 45743
  misc_feature (420)..(420): n is a, c, t, g, unknown, or other
ggagctccccgcggtggcggccgctctagtactagtggatcccccgggctgcaggaattcgcacgagaccattacctagaacatcctaatcgaaaacccaacattacgagacgcctcgccggccgcgccgcgcccaactcctctgatcctcttccttgtccccaccctcttctccgatggcgacgctgcagctcaaccacatcgcgcgggagacctccgacgtggcccgactcgccgccttctacgaggccgtgctggggttcgagcgcatcccttcgcccacctactcgggcttccaggtcgcatggctccgcctcccgagctcccccgacgtcgcgctccacctcatcgagcgggacctcgccgcggcacccgtcgcggttggcgccgagggcgcgccgtcgtccccacccgcccggngccaccacctcgccttctccgtcgctgactacgacgggttcctgacccggctgaaggcgcgcggcaccgacctgttcaaaaagtcccacccggaggggcgcacgcgccaggtctttctttttcgaccctgaacgccaatgccctaaagggtaactaaccctggggccagggaatgaaaaggggaaaaaaaacccgggatttgcggctcaccttttgtgtttttcggggaaaactcctacaaaccctggcccactgatttcgatttgaaaccggaaaaattttccggggcaaaactttctttcggaaaataataaaaacccccaagccttttaaaagtcttcaaacctccccctcttttttttaaaaacaaggcctg

SEQ ID NO: 45743 - protein, 124 aa, Zea mays
  misc_feature: Ceres CLONE 1450051-F
  misc_feature: SWISSPROT Homolog: EC 5.1.99.1 Methylmalonyl-CoA epimerase
  misc_feature (82)..(82): Xaa is any aa, unknown, or other
MATLQLNHIARETSDVARLAAFYEAVLGFERIPSPTYSGFQVAWLRLPSSPDVALHLIERDLAAAPVAVGAEGAPSSPPARXHHLAFSVADYDGFLTRLKARGTDLFKKSHPEGRTRQVFLFRP

SEQ ID NO: 45744 - DNA, 692 bp, Zea mays
  misc_feature: Ceres CLONE 1450053-F
  misc_feature: Encodes the peptide sequence at SEQ ID NO. 45745
acccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgtcgtgtcctcccctggcctcctggggcgcttctggcgagcagtgtgttgtgttgtgtgggtgccgcacgctagcaggctagccatgtgccctgctgtgttgtgtcaccatccatctataatcttatcc

SEQ ID NO: 45745 - protein, 82 aa, Zea mays; identical to SEQ ID NO: 43085
  misc_feature: Ceres CLONE 1450053-F
  misc_feature (1)..(80): Pfam Name: Metallothio_2 Pfam Description: Metallothionein

SEQ ID NO: 45746 - DNA, 767 bp, Zea mays
  misc_feature: Ceres CLONE 1450071-F
  misc_feature: Encodes the peptide sequence at SEQ ID NO. 45747
  misc_feature (675)..(675): n is a, c, t, g, unknown, or other
  misc_feature (710)..(710): n is a, c, t, g, unknown, or other
  misc_feature (726)..(726): n is a, c, t, g, unknown, or other
ggagctccccgcggtggcggccgctctataactagtggatcccccgggctgcaggaattcgcacgagaccattacctagaacatcctaatcgaaaaatcccgtgcccagtgccctcgccgtcgccgacctaccacacccgtttccgggaggagagagagggcgggggcgaaggggatggcaaagcgccggcgccacgagttggcgccggtcgtggaggagctgatttcgccgatgaacagcctggacgacggctgcctcatgcacatcttcagcttcctgagcccaatcccagataggtataacaccgccctcgtttgccacagatggcgcttccttgcatgccaccctcggctatggctgcgtgtcgagaggccaatcagagatgcgatggagcctggagtttatccagatctcgaggctgctgtttctgctgctaggccgggtgacaccattcttattgcggctggtggttcccatgttgcatgtaacatccaaataaagaagcctatttgcataattggcgggggcgatcttcctgatgacactgtattgacctgctcacgtggtttcgacaacgcactggagtttctatcaacatgcaagattgcaaatctgactattagagcagaactcggatgctgcttgctgcatcgaggcggtagattgaccatccnagagtgtctgctgcagtgcgagcaaaccctttggnaccactgtccttcccnatatcagcacagcgatagagtacgatccattctcatccctc

SEQ ID NO: 45747 - protein, 197 aa, Zea mays
  misc_feature: Ceres CLONE 1450071-F
  misc_feature (18)..(66): Pfam Name: F-box Pfam Description: F-box domain
  misc_feature (167)..(167): Xaa is any aa, unknown, or other
  misc_feature (179)..(179): Xaa is any aa, unknown, or other
  misc_feature (184)..(184): Xaa is any aa, unknown, or other
MAKRRRHELAPVVEELISPMNSLDDGCLMHIFSFLSPIPDRYNTALVCHRWRFLACHPRLWLRVERPIRDAMEPGVYPDLEAAVSAARPGDTILIAAGGSHVACNIQIKKPICIIGGGDLPDDTVLTCSRGFDNALEFLSTCKIANLTIRAELGCCLLHRGGRLTIXECLLQCEQTLWXHCPSXYQHSDRVRSILIP

SEQ ID NO: 45748 - DNA, 749 bp, Zea mays
  misc_feature: Ceres CLONE 1450073-F
  misc_feature (411)..(411): n is a, c, t, g, unknown, or other
  misc_feature (476)..(476): n is a, c, t, g, unknown, or other
  misc_feature (514)..(514): n is a, c, t, g, unknown, or other
tggagctccccgcggtggcggccgctctagaactagtggatcccccgggctgcaggaattcgcacgagaccattacctagaacatcctaatcgagaacaaggatgatttttttgattccctctctagtggaacatttggacgtggaggaccaaatggaaggggcagaccttctgaacggcgcagagtagatacagagacttttggcgaatttccacggcacaggcaaccctaccgtggtggcgcccgaggttaccgtggcggtggacgttcccgaggttcatattatggtggcagaggctatggaaacacagggaccggaggctatggaaacacagggacatgtggccctggaaattcttatttctcacggggctatgggagagatttgatatagcagaaatgtgcaggcnaccatactttgtgggtggtgtagtcttttaccacatgtatgatgtatcccctactactggtgcancggtgaaaagtcgtttccccactgagccaagccaaggnttaatggggctcaaattttacctatgaaattttaggatggattaagatccgactctaaaaaaaaaaaaaaaagcttatcgatccggccaaccccaggggggggcccggaccccaatccgcttaatgggggccgaattacccgcgccccggggccgctttttaaccgctggagggggaaaaccccggggttccccatttaatcgctgtggggaatccccctttccccggggggaaa

SEQ ID NO: 45749 - DNA, 713 bp, Zea mays
  misc_feature: Ceres CLONE 1450077-F
  misc_feature: Encodes the peptide sequence at SEQ ID NO. 45750
  misc_feature (508)..(508): n is a, c, t, g, unknown, or other
aagctggagctccccgcggtggcggccgctctagaactagtggatcccccgggctgcaggaattcgcacgagaccattacctagaacatcctaatcgaaaaatcgagtctacgctcttcgtctttctccggtccgaattccccaatcggactctcctcttcttgccggatctccacaccccattccaccccgcccatgggtgcccccacccctcgccgctgacctgtgggtacactgccccctgctcccccgccccgctcccgctcgcccacgcgaaccctaggcagctaggctttgctgctagaagagctccagcgaccgacgaggagaggagaataaagctcaaatcttggatgcgcccgaaccgatggcgacacctgccgcagagaagccggaagatgtagagatccgtgaggtttgggcggacaacctcgagacagagttcgccgtgatccgcgacatcgtcgacgactatccgtatgtggctatggacactgagtttccgggncgtgtgtgtcgtccgctcggcactttacagtcggcggccgaagttcactacgccactcttaaagctaacgtggacatgctgaagcttaatcagctcgggcttcactttgtcccacaaccatggtgggctgccggccttaggccaaaacggtcccccctgcctctgggaattcaatttccaaggatttgaccctcggactgggggg

SEQ ID NO: 45750 - protein, 109 aa, Zea mays
  misc_feature: Ceres CLONE 1450077-F
  misc_feature: SWISSPROT Homolog: EC 3.1.13.4 Poly(A)-specific ribonuclease
MATPAAEKPEDVEIREVWADNLETEFAVIRDIVDDYPYVAMDTEFPGRVCRPLGTLQSAAEVHYATLKANVDMLKLNQLGLHFVPQPWWAAGLRPKRSPLPLGIQFPRI

SEQ ID NO: 45751 - DNA, 708 bp, Zea mays
  misc_feature: Ceres CLONE 1450088-F
  misc_feature: Encodes the peptide sequence at SEQ ID NO. 45752
aagctggagctccccgcggtggcggccgctctagaactagtggatcccccgggctgcaggaattcgcacgagaccattacctagaacatcctaatcgaaaacggccaggcggagcgcgagctggcgttccaggccccgccggcgttgaacgccttcgacatcatctccatgtcccccgggctggacctgtcgggcctgttcggcgagggcaggcgccgccgcgagaagcggttcatgacgacggcgtccccggagcgggcggtggagcggctcgcgcaggccggcgcgaggctcggctacttcattgtggggaagaagggggccgagcgcctgccgctgggcgtcctgccgggcctcgtggccatgtcgatggagatgtcggaggtgtcgccggagctgatgctggtggagctgaagctggagggcggccacggcgacgaggacgaagcgttcgggtgggaggagctccggggtgagctgggggacgtggtaacagcatggcacgtgagtgaagaaagttaaaaattcgcagaaggaatgcaaagaacgatttgcaagtggtatcagtgtaacagggaaaaccccgaataccaggggggccttcccttctcgtggacgtgaaattaattggttaagaacaaaaaacaaccggggaaggttgggaaataacccaaacggggggttttcccaccaaaggggggaggtttg

SEQ ID NO: 45752 - protein, 117 aa, Zea mays
  misc_feature: Ceres CLONE 1450088-F
  misc_feature (1)..(49): Pfam Name: NAF Pfam Description: NAF domain
  misc_feature: SWISSPROT Homolog: EC 2.7.11.1 Non-specific serine/threonine protein kinase
MSPGLDLSGLFGEGRRRREKRFMTTASPERAVERLAQAGARLGYFIVGKKGAERLPLGVLPGLVAMSMEMSEVSPELMLVELKLEGGHGDEDEAFGWEELRGELGDVVTAWHVSEES

SEQ ID NO: 45753 - DNA, 776 bp, Zea mays
  misc_feature: Ceres CLONE 1450095-F
  misc_feature: Translation starting site: 154
  misc_feature (348)..(348): n is a, c, t, g, unknown, or other
tggagctccccgcggtggcggccgctctagaactagtggatcccccgggctgcaggaattcgcacgagaccattacctagaacatcctaatcgaaaaaaacgacagccagagccaccacctatgagaggctggaagcaacggtgccgccggagatggagacggaaaaggaggcggcagcggcgaggcaggcgaaggagtccctggagctggcgttccagatgtcccagatcctcgaaaccggcctcgaccgccacaccctgtcgctgctcatggcgctctgcgaccgcgggcgccaccccgaggccctgggcgccctcgtcggcgactctccctcactgctccccaancgccgccgaagctcccttccccgggacaacgcccgcgcgggggccgcccccggaaaagggccatgttccctccggccttccgcgcccaaggggtggggaggcccttttttccccgggaaaaacgttgcctttatccaaaaaatcccccaaaggcccccccccgtggaggcccaaaaagaaagttttctttttttaaaaaatttgcgcccccaaaaaatgggttcaccaagcgcatattaccccttcggagaaagggcgccccccctttttgaaaaaaaacaaaaaagggggggggtggggaaaaaaaaaacccccccgcgggttctaaaaaaaaaaaaaaaaatttttcttccccccccgggggggggggggccccctcccccctttaataataaaatccccccccccccgcgttttattattaaaac

SEQ ID NO: 45754 - DNA, 739 bp, Zea mays
  misc_feature: Ceres CLONE 1450096-F
  misc_feature: Encodes the peptide sequence at SEQ ID NO. 45755
agctccccgcggtggcggccgctctagaactagtggatcccccgggctgcaggaattcgcacgagaccattacctagaacatcctaatcgaaaagattcctttcccgaggagctcagctcgctcggctagctaggcaccgggttcctgttcctgccgcgaggcgcgtctcacacgcggcggtcggtgcgcgcatgcagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccaggcccaggccctgaagccgcaggccagtaacgccccgcccaagctcggccgcccccgccccggccccgccgacgaccactccccaacgggagggaagaagttcctgagctacttccggtgttgtatcaaggcctgaagaggtgctgctctagtgcctgcagtccctgtgtttttttttcgcagcagaacacttgtgagcaatcaggcctcggttttgttaagtaccccgtgtccaaaaacgtgtaatatatttgtccttatggatcagtcgttgggcctgtatgaagaacagaccagtttatggggtagcaacgttctttttgacacatacatcaccatcgatttgc

SEQ ID NO: 45755 - protein, 111 aa, Zea mays
  misc_feature: Ceres CLONE 1450096-F
MQQRGHDAAGANAWMTVPAFGDWDTKNGALPDYSMDFSKIREMRKQNKKELSRASLGGDDDLLAHAQAQALKPQASNAPPKLGRPRPGPADDHSPTGGKKFLSYFRCCIKA

SEQ ID NO: 45756 - DNA, 702 bp, Zea mays
  misc_feature: Ceres CLONE 1450097-F
  misc_feature: Encodes the peptide sequence at SEQ ID NO. 45757
ggagctcaccgcggtggcggccgctctattttagtggatcccccgggctgcaggaattcgcacgagaccattacctagaacatcctaatcgaaaacctgacttgtgcgccatcacacacaagacacaaccccactcacccggcagggaggccctcttcgtcggcggaggccatggtttccctcaagccgcaaaagaggctcgccgcgggagtcctaaaatgtggcaaggggaaggtgtggcttgaccccaacgaggtctacgagatctcgatggctaactcgcgtcagaacattcgtaagctggtgaaggatggattcataattaagaagccacagaaaatccactcaaggtcccgggcaaggagggtctatgaggccaagcataaggggaggcactctggttacagtacccctccccctaccagggaggctaggctccccaccaagatcctttggatgcccaggatgcgtgtcctcaggcgtctgctgcgcaagtatcgtgaagcaaagaaaatccacaaacacatgtaccacgatctgtatatgagagtaaacggaaacgtgttttaaaataaaagggtactcatggacagcatccacaagtcaaaggccgaaaggccagacagaagactctctcggatcagtttgaggccaagcgagccaagagcaaggcttcccgtgagagaaaattggcagcaagga

SEQ ID NO: 45757 - protein, 132 aa, Zea mays
  misc_feature: Ceres CLONE 1450097-F
  misc_feature (2)..(133): Pfam Name: Ribosomal_L19e Pfam Description: Ribosomal protein L19e
MVSLKPQKRLAAGVLKCGKGKVWLDPNEVYEISMANSRQNIRKLVKDGFIIKKPQKIHSRSRARRVYEAKHKGRHSGYSTPPPTREARLPTKILWMPRMRVLRRLLRKYREAKKIHKHMYHDLYMRVNGNVF

SEQ ID NO: 45758 - DNA, 522 bp, Zea mays
  misc_feature: Ceres CLONE 1450099-F
  misc_feature (51)..(51): n is a, c, t, g, unknown, or other
  misc_feature (96)..(96): n is a, c, t, g, unknown, or other
  misc_feature (108)..(108): n is a, c, t, g, unknown, or other
  misc_feature (243)..(243): n is a, c, t, g, unknown, or other
  misc_feature (247)..(247): n is a, c, t, g, unknown, or other
  misc_feature (262)..(262): n is a, c, t, g, unknown, or other
  misc_feature (273)..(273): n is a, c, t, g, unknown, or other
  misc_feature (295)..(295): n is a, c, t, g, unknown, or other
aagctggagctccccgcggtggcggccgctctagaactagtggatcccccngggctgcaggaattcgcacgagaccattacctagaacatcctaantcgaaaaacacnacagtacgtacaagcctcatcagctcgctagcatagcagcaaccagctatggactccaccaagttatccgcgctgctggcgctcgccatgctcgcgctctcctcgtcgccgctcgctctcgcgtgggagaaagcngaanccggagtgccactcngtgcgagtccnggctcgccgcccctcggacggncgtcccccctgccccccaatcagcatacggtcagtcccacttgccccctgtcagtaataccgtcgtccccaatcccaccgggtcacccaagttgccccccaatcgtcggaaatgccccccggggaaccccttcccccccattccgaaatcattggaaagaaaccccccccccaaaaaaagggcccccccgaaagggggggggccccccccccccctcccggtttccc

SEQ ID NO: 45759 - DNA, 736 bp, Zea mays
  misc_feature: Ceres CLONE 1450100-F
  misc_feature: Encodes the peptide sequence at SEQ ID NO. 45760
ggagctccccgcggtggcggccgctctagaactagtggatcccccgggctgcaggaattcgcacgagaccattacctagaacatcctaatcgaaaattcgtcctcctcgatcgtcccaacaaccgcaatggcgcagcagaggcttctcgctctcctcctggtggcggccctcctcgtgctctcctgctcgcaagggctggtggaagcgcggaaggtgcaggtgcggcgcgcgcccctcggcggcggccgcctgcttccggaggcgatgatggcgtacacgacgacggactacgggccccccactgccaacaccaacacccacggcggcatggtcccgtcgccggacgacccctcctcgccgccgacgcactgaccggccagtcgatctcaccggcaacaactgtcttgttctttgggattggagctttggaagagaaaattggaggataggatcggaagaagctggtggtcgtgttcttctccctttttgggcgcgcgtgttgtgtgctgctgtgtctgtgtactccagctgtagctgctgctgtgcttagctgattgaagtttgaactgtagtgggtccacagtattatgcatgttttgtttggtgagacgtcagaacccatcattgaatcttgtctgaatctagtcagctctatgtaaagtggaagcgatacatgaatgtacgtagtaaaatggaacagaattcgtcgccagtccaggctgcagtgctcccctc

SEQ ID NO: 45760 - protein, 81 aa, Zea mays; identical to SEQ ID NO: 44574
  misc_feature: Ceres CLONE 1450100-F

SEQ ID NO: 45761 - DNA, 868 bp, Zea mays
  misc_feature: Ceres CLONE 1450108-F
  misc_feature (1)..(1): n is a, c, t, g, unknown, or other
  misc_feature (426)..(426): n is a, c, t, g, unknown, or other
  misc_feature (427)..(427): n is a, c, t, g, unknown, or other
  misc_feature (517)..(517): n is a, c, t, g, unknown, or other
nttccccgccgggcgccctatatataaaaaacaacacccccctcattattatacaaaactggagctccccgcggaggcggccgctctataatagagggtcccccgggctgcaggaattcgcacgagaccattacctagaacatcctaatcgaaaagaaagaccacccctcggctccccacggaggccgtcctctcctctcctctgcgtccgcctctgcccaccgctcgcccgcgcgcgctccattacctcggcgggcgataggacgacctaccgaacaccggcttcacctagcacgagcaccgcccccgccttagagcatcagctaggctggtcggtcgacaagcagctagctagctggagctccttgatggaggtacattatcactccccttgtcaagcgacggcagagagattggaagtcattnnagaacgttccaaacaccccccttgtagtacgtagcctctagccatgtataaaaaaagcccccccccgcgggccgtattgtccgcgccccnaggtacccagacgagttcacggcttccccggtaccccaggtcgtgtacaggtcccactctcacaaactggctgcctagtatgggacccccctctcttctacctctagggtcctgcacgtagtccttggggcactgccggaatgcgctccgctaacagcttcccgtgcagcggtaacaagacaaaagagaactccacttaactaccagaactgtatttaatgttctgcaagcattaccttaccagcactagaaaactcccccaagtgtatcgttgctctgctcttatcacccgatgacatttggaggagtgttagtatcatcttttctctctgattggggtgaattcgctcg

SEQ ID NO: 45762 - DNA, 727 bp, Zea mays
  misc_feature: Ceres CLONE 1450115-F
  misc_feature: Encodes the peptide sequence at SEQ ID NO. 45763
  misc_feature (727)..(727): n is a, c, t, g, unknown, or other
aagctggagctccccgcggtggcggccgctctagaactagtggatcccccgggctgcaggaattcgcacgagaccattacctagaacatcctaatcgaaaaaaaactcgcgacccagcgtccatacacacagcagcctttttgttctccccgcgagcgctctctttctctatcgactggcgacgactccgccaccgccgccgctctacgcgagacgcccaggtcttcgccaacgacgagcatccgtggatgtaattaggcctggaacaactgttgaactgaggaacgcaaagatcgacatgttcaagggttcgatgcggcttgcagtggacaagtggggaattgtgaaagctgctgaaagctcagctgagtggacagtcaaggaggacaacaacctgtccttaattgagtttgagctggtgaccgtgacggagtgaaaaccgccattgcttaggagtattgttggtttgctgtgttgttgaacctaatcatcatcgccaatcaataaggactcgtggttgatgttctcggcatcggagttgcgtattgctgtaccgttgcttgcttactgtgcgttgtggctacttttgactgctatcgaataataataaattggtgtcatgaagtggaaaatgccatgcgatgatggctactttctgcagcagcgcctgttgttccaaaaaaaaaaaaaaaaaagcttatcgataccgtcgacctcgagggggggn

SEQ ID NO: 45763 - protein, 45 aa, Zea mays
  misc_feature: Ceres CLONE 1450115-F
MFKGSMRLAVDKWGIVKAAESSAEWTVKEDNNLSLIEFELVTVTE

SEQ ID NO: 45764 - DNA, 680 bp, Zea mays
  misc_feature: Ceres CLONE 1450132-F
  misc_feature: Translation starting site: 136
  misc_feature: Pfam Name: P16-Arc Pfam Description: ARP2/3 complex 16 kDa subunit (p16-Arc)
  misc_feature (411)..(411): n is a, c, t, g, unknown, or other
tccccgcggtggcggccgctctagaactagtggatcccccgggctgcaggaattcgcacgagaccattacctagaacatcctaatcgaaaaacagaaaagctaaacccgacctccgctcgccggcgcccggcaggatggcttcgtcggcggcgtaccctgatgcggacgagaacctggaggccatcatcacccgcatagagcagaagtcccgaaagatcgagacccttctcaagcagtcgaagccggtggaggccctaaagacggcgctcgaggggtcaccgctcaagacccgcgacgagcgatgcaagtcggcgaactggatcgtggtgcaccgcgcgttgatggcgattagggacgtaaacggcatgttcaactccctggatcccgagtactacgacatcctcatcaantacctttatagaggttttatctacaggggataggccaacatgtgaccagtgcctcaaaattcatgaaaaactgactgagaaggcaggcctaggctgtatattgcgatcccttgctgatactgtaaacactgtatgaactttgtctctgctggctgaggggggaattgcaaagttctctcctgctctttacaatccatcaggcaaactacctggtagtggaaaaaaaaaaaaaaaagcttatccataccgtcaacctcaagggggggccc

SEQ ID NO: 45765 - DNA, 651 bp, Zea mays
  misc_feature: Ceres CLONE 1450134-F
  misc_feature: Encodes the peptide sequence at SEQ ID NO. 45766
gctctatactagtggatcccccgggctgcaggaattcgcacgagaccattacctagaacatcctaatcgaaaaacagagtgaaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaaaaccacccacccggtgacgatggggacgaggatggtgactttggggaggagggtgaagaggacgtctcagaaggggagggatatgacaaccccaagggcaatgagaccaagaagcaaagaggtgatcctgaggaaaatggtgaggaagatgaggaagaaccagaagatcagggagggtggcggccgaccacgatgatgacgacgatgacgatgatgagaaacgggatgacgaaggactaccaccatgggggaatgacgatgagggg

SEQ ID NO: 45766 - protein, 142 aa, Zea mays
  misc_feature: Ceres CLONE 1450134-F
MDTAAPLQLKACAGDAAEKLLLAVAAEGPICGVPDFKMRGKKSDELEPVDAGDENHPPGDDGDEDGDFGEEGEEDVSEGEGYDNPKGNETKKQRGDPEENGEEDEEEPEDQGGWRPTTMMTTMTMMRNGMTKDYHHGGMTMR

SEQ ID NO: 45767 - DNA, 669 bp, Zea mays
  misc_feature: Ceres CLONE 1450167-F
  misc_feature: Encodes the peptide sequence at SEQ ID NO. 45768
ggagctccccgcggtggcggccgctctagtactagtggatcccccgggctgcaggaattcgcacgagaccattacctagaacatcctaatcgaaaactgacgaaactccgaccggtcgcgggaggatctgtgccgcgatggccacgtccaacaccgcgcggatggatgacgggcgccgcgacctgagaagcaccatcaagaactggaacgtcgtctaccccgtctacctcctctccaagaagacggtcgccgagggccgccgcatcgacgctgccgaggcctgcccggaccccacctgcaacgagatcgctgactgctgctcgcacctcacgatcccccacgccttctagttggataaggaaaaccctctcgatttcttcccggtggggaaggccgggtgcagcttaagaacaagacggctgccccgtcatccctgcttttaaaagaagaagcagggatgacccaggagcccacctccttcccaattatccggaggggcaaaaaaacagaacccccccccaatcccggtggccggtccaagaaaaccaaagggcgggaaaataaaaaaggagagccctagccattggggttggttttttctcagggccgggcccctaacccaaaagctcttctgtaaaaaaggaaaaactctctggacccttttttttt

SEQ ID NO: 45768 - protein, 70 aa, Zea mays
  misc_feature: Ceres CLONE 1450167-F
MATSNTARMDDGRRDLRSTIKNWNVVYPVYLLSKKTVAEGRRIDAAEACPDPTCNEIADCCSHLTIPHAF

SEQ ID NO: 45769 - DNA, 668 bp, Zea mays
  misc_feature: Ceres CLONE 1450170-F
  misc_feature: Encodes the peptide sequence at SEQ ID NO. 45770
gctctgaactagtggatcccccgggctgcaggaattcgcacgagaccattacctagaacatcctaatcgaaaaattaattaacctctctccttcctcgccccttcccctccacgactccactaccaccaccttcaccttgtctcccacaaccgccgcgcgcaagccctagcccgatctcgccggcgacagacaccagatctcgccgcccgttgcgcgccgatacgcgccccgccggattcaccgctcctcgcgctgcagcacgcccgggcctgggttactgcgtgacatgtagtattgtataattggaggttgtcaccatcaccacaaagcatatgttgtgatttgtcaatggcgaggagatgaaacaggtgtaggggcggagcaccaaggacatgacagccatgccgcatccgcgccaccgaggcgctgctaagaagcccatgtggatcatagggctattgtctttggtttgtggtgcagcttatgggggcctatggcttcccaccacggggctactccggatgctactttctttgcttcgagtgtccggtaccccggttcaaggattgggctaccctgctgtttgctcggggagctaaactggatgaaagaagataagttttccacccgggggggtaaataaggggaaccttcccgtttccaagag

SEQ ID NO: 45770 - protein, 68 aa, Zea mays
  misc_feature: Ceres CLONE 1450170-F
MTAMPHPRHRGAAKKPMWIIGLLSLVCGAAYGGLWLPTTGLLRMLLSLLRVSGTPVQGLGYPAVCSGS

SEQ ID NO: 45771 - DNA, 718 bp, Zea mays
  misc_feature: Ceres CLONE 1450179-F
  misc_feature: Encodes the peptide sequence at SEQ ID NO. 45772
  misc_feature (718)..(718): n is a, c, t, g, unknown, or other
tggagctccccgcggtggcggccgctctagaactagtggatcccccgggctgcaggaattcgcacgagaccattacctagaacatcctaatcgaaaagccctgcccctcctccgccgtttcgcctctctccactttccccgtccttcgccgtcgcggccgcgtcctagtctagtctgatggccagccgctgggtccgacccgaggtgtacccgctgttcgcggcgatgggagttgccgttggcatctgcgggtttcagctcttccggaacatcaccggcaacccggaagtcagggtaaacaaggcagggagggcagccggcgtgcttgagaaccatgaggaggggaggcgttacgccatgcatggcctcagaagctttgtgcacgacaagacccccgagatcatgccagctatcaacaagttctttactgaccccaagtgaagcaaagcagctttggttggccgctgatgacgatggttctgctactagttgcccttggggattgtgtaccctttttatggcaattcgatatgtgaatgagttcgacggtccctgtttgttcctcgtactcacctgtcatgtggatttgatgcacttaagtgataaaactgtcagccaacgttcattacaagtggatttttgcaaactggttatgtaaaggataagtaattgtaatttacaagtgttttagactttggtctttatgctgtttaagaan

SEQ ID NO: 45772 - protein, 87 aa, Zea mays; identical to SEQ ID NO: 40041
  misc_feature: Ceres CLONE 1450179-F
  misc_feature (2)..(88): Pfam Name: B12D Pfam Description: B12D protein

SEQ ID NO: 45773 - DNA, 762 bp, Zea mays
  misc_feature: Ceres CLONE 1450180-F
  misc_feature: Translation starting site: 206
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcccccaccccctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgccaacacggcgcggcaggcgttccagcgcaccccggactacgtggaggaggcgcaccgcaggatggcggaagccgccgcgcacgcgggccacaagaccgcgcaggcaggccaggcccatcagggcagggcgcaggaagcccggcgccggggggagtgcaagtgccggcgcttgcggccgcggcagggcttctc

SEQ ID NO: 45774 - DNA, 766 bp, Zea mays
  misc_feature: Ceres CLONE 1450182-F
  misc_feature: Encodes the peptide sequence at SEQ ID NO. 45775
aagctggagctccccgcggtggcggccgctctagaactagtggatcccccgggctgcaggaattcgcacgagaccattacctagaacatcctaatcgaaaaaaaacccacacccgaacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccagaagaggaactccaatccagtgtggaaccgagtactgcagctctcagtaacacatcctaacgaagcagtgcaccttggagtttttgatggagacaagttcaccgccaaacgacagcctgggtggttgctaaaatcaaccttaccgaaattttccaatgctcccaaacttggcctgaaaccacccttctgaaggggcaggggttcaaacaatcttccctgtgggagaaaaacccccctgcccgcaaaacccctttttattggaagggtggcaagggggtccccaactttttttttaaacctaagaaaaggcccaaagggcgcccttttgggggccccccgggggggggtcctttttcctccgggggaaaatttaaaggccccctcttcaataaggggggataaagggccccccatttgcggggcccccccttttttttttttttgtttaaaaaaatatccccacaaccgggggttatccccgcgttaaaagagggt

SEQ ID NO: 45775 - protein, 113 aa, Zea mays
  misc_feature: Ceres CLONE 1450182-F
  misc_feature (13)..(94): Pfam Name: C2 Pfam Description: C2 domain
  misc_feature: SWISSPROT Homolog: EC 3.1.4.4 Phospholipase D
MASASKEEVIGKLNVRVVRGNNLVIADPLTHTSDPYVVLQYGAQKVKTSVQKRNSNPVWNRVLQLSVTHPNEAVHLGVFDGDKFTAKRQPGWLLKSTLPKFSNAPKLGLKPPF

SEQ ID NO: 45776 - DNA, 825 bp, Zea mays
  misc_feature: Ceres CLONE 1450191-F
  misc_feature: Encodes the peptide sequence at SEQ ID NO. 45777
  misc_feature (296)..(296): n is a, c, t, g, unknown, or other
  misc_feature (311)..(311): n is a, c, t, g, unknown, or other
  misc_feature (402)..(402): n is a, c, t, g, unknown, or other
  misc_feature (428)..(428): n is a, c, t, g, unknown, or other
  misc_feature (435)..(435): n is a, c, t, g, unknown, or other
acagctggagctccccgcggtggcggccgctctagaactagtggatcccccgggctgcaggaattcgcacgagaccattacctagaacatcctaatcgaaaaagtctccgtgtccagtcgagtctcagcaaggaagatgtgggggaaaggaaagaagcgtttcggcggtggcggcagcggtgagcccgcggccaagcgccaggccgcgagggacgatggcccctccgaatccgctgaagacggtaccgtcgtagccgagatatcggagaacaagaaggtgtccgttaggagctggnaaaggcaggtcttcntcgacttacgcgagttctacttccaggaccgcaagactctccccccccgcattggatatccctcccagtgggggggggggagatacctganggaaaaaattttccccccccccccanggaaatnaaggaaaatacattgattgggaccccccaagccatccacgtggccggggcgagccttttgcttccttccccggtttgagggcccggatgttcccggaaagtaattttttttgttgccccatttgccgcgccgggggggctttttgtccccttttacccccccccccttgtttacggggcgcccccctgcgcccaaaagggtttgggttttccccccccccgcgcctctggtcaaccttaaaactcccgcccggaggagcggggaccttctcggccaattaaaccttccaccccaaaaccactcgtggaagggaggtcgaaacctccaactttgcgcgccaccaggttcccgcttccttttctctttgttaacaacaaagacaaaccaccg

SEQ ID NO: 45777 - protein, 104 aa, Zea mays
  misc_feature: Ceres CLONE 1450191-F
  misc_feature (54)..(54): Xaa is any aa, unknown, or other
  misc_feature (59)..(59): Xaa is any aa, unknown, or other
  misc_feature (89)..(89): Xaa is any aa, unknown, or other
  misc_feature (98)..(98): Xaa is any aa, unknown, or other
  misc_feature (100)..(100): Xaa is any aa, unknown, or other
MWGKGKKRFGGGGSGEPAAKRQAARDDGPSESAEDGTVVAEISENKKVSVRSWXRQVFXDLREFYFQDRKTLPPRIGYPSQWGGGRYLXEKIFPPPPXKXRKIH

SEQ ID NO: 45778 - DNA, 664 bp, Zea mays
  misc_feature: Ceres CLONE 1450194-F
  misc_feature: Encodes the peptide sequence at SEQ ID NO. 45779
  misc_feature (493)..(493): n is a, c, t, g, unknown, or other
  misc_feature (504)..(504): n is a, c, t, g, unknown, or other
  misc_feature (542)..(542): n is a, c, t, g, unknown, or other
  misc_feature (614)..(614): n is a, c, t, g, unknown, or other
ggagctccccgcggtggcggccgctctagaactagtggatcccccgggctgcaggaattcgcacgagaccattacctagaacatcctaatcgaaaaagccgatttcgtgtccctgcagccacggccaccgcccaatctccacttctttatcttctccgaggtgagagagcccaggcgatccaattccaccctcgttctcaggcactgtcacacagacacagctgacctgccactgccaggaaagtaggtcgaggatgccccgcagcggcttctcggggtccttcaggtcgcccaagattgacgtcgtcatcgacatgggaaaccccttcctcaaccgcaccgtcgacggcttcctcaagatcggcgccgtcggcgcctgcaaggtggctgccgaggagaccttcgagtgcctccacaggggggatgtttcgaaagcacaggttgagcatgccctgaggaagatgtgcaaggagggcgcatattggggcactgntgctggagttnatgtgggcatggtgtacggcgtgaaaagggtccgtggncccagtgactgaaaaacgcgatgatcgggggcgccttgtccggcgcctgatctccggggccgcaacgcgacngaagcaaggtcgtcaggacgcatcacggccgggcggtaccaaaaccgtca

SEQ ID NO: 45779 - protein, 99 aa, Zea mays
  misc_feature: Ceres CLONE 1450194-F
  misc_feature (18)..(100): Pfam Name: Tim17 Pfam Description: Tim17/Tim22/Tim23 family
  misc_feature (80)..(80): Xaa is any aa, unknown, or other
  misc_feature (84)..(84): Xaa is any aa, unknown, or other
MPRSGFSGSFRSPKIDVVIDMGNPFLNRTVDGFLKIGAVGACKVAAEETFECLHRGDVSKAQVEHALRKMCKEGAYWGTXAGVXVGMVYGVKRVRGPSD

SEQ ID NO: 45780 - DNA, 873 bp, Zea mays
  misc_feature: Ceres CLONE 1450195-R
  misc_feature: Pfam Name: Per1 Pfam Description: Per1-like
  misc_feature (461)..(461): n is a, c, t, g, unknown, or other
accgggccccccctcgaggtcgacggtatcgataagcttttttttttttttttttaacccatggtaacaatcttctgagattatagttgatgagcacgagcctaccaagtggcagttgctgtataaattaaagaataaaagtggccccttaaacaacatggccttctgaactgggacaagaacatcggggaacaaaaataaaacggtaattcacatgctaagttagtagttacctaaaattacaagtgaaacttttatctttacaatggctgggcgcaggcttgaaattatcacacaggcgacttgttaacgtgccttcttcaggattgctgacgttcgcatctccgcatcttccttggcaaagctccaccaaaggtacgaaagggggatagccacagcaaggcatatagcacggccatccacatatcccccatcggcggaggaatgtcaaaaccttccangaaataccccagccgccccctccgatgggaaacaaattatgatctttcagcccgtgaaaggatgccccagttcatggacgccccccaggggccccattgggaaaaccctgagccattggttttttccccggttcaaaccctttcatggtttcagggcctgcccaatttttacaaggggtaacccccccgtaaagccccctaaaaaacggggcctacccccccaaagggcccaagggttttaaaaaaggtggagggttcacctttccaaaaacaaaaaaaaaaaaggttgtttttaattttccctctttaaacaaccggggctccaagggtttaaccctgttcctttaaaaaaaacatgttttttttttttttttgggaaaacttgggaaaaaaaaatcccttttccgccttt

SEQ ID NO: 45781 - DNA, 790 bp, Zea mays
  misc_feature: Ceres CLONE 1450195-R2
gagatttagttgatgagcacgagcctaccaagtggcagttgctgtataaattaaagaatagaagtggccccttaaacaacatggccttctgaactgggacaagaacatcgtggaacaaaaataagacggtaattcacatgctaagttagtagttacctaagattacaagtgaaacttttatctttacaatggctgggcgcaggcatgaaattatcacacaggcgacttgttaacgtgccttcttcaggattgctgacgttcgcatctccgcatcttccttggcaaagctccaccaaaggtacgaaagggggatagccacagcaaggcatatagcacggccatccacatatccccatcgcggaggaatgtcagaagcttccagaagtaccgcagccgcacctccgatggcaacaaatatgatcttcagccgtgaaggatgccgagtcatgacagcccacagtgcccataggagacactgagcaatgattatcacagtacaaaccttcatgttcaggcctgcagattttacaagcgtaaccgcgtaagccactaatacgtgctactccctatgtcctagtatataagatgtaagttacattcaaaaacaaaaaaaaatgtatttaattctctctatactactgcatcaatgtatacatgtctagaaagagcatgtcttatattatgaaactagaataaaaatcgttacgtctttatgtactaggatagagccatggagggagacatccattcgctgttaatctccatatccatggaaacaggaaagaaatgt

SEQ ID NO: 45782 - DNA, 795 bp, Zea mays
  misc_feature: Ceres CLONE 1450198-F
  misc_feature: Encodes the peptide sequence at SEQ ID NO. 45783
aagctggagctccccgcggtggcggccgctctagaactagtggatcccccgggctgcaggaattcgcacgagaccattacctagaacatcctaatcgaaaaactcatccacccggaggcacctcacacacacacacacactctctctccactggctgacgccgcgaccgccccaacccaacctcccttttcggagatctcgctgcctccgccgtcgacttccgtcgcccccctatcccgcgtccgggcttacccgatggcacggctgcactggcttgaggctgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacaatcctccgggcactagggtattgatcaacctcaaacttttctggatgttgacgaaccttcgttcaaaacaaccgaagtaccgctctttttgtttccggaccaattgaaacccaaacattggttggtttgcttttgaaaatcaacaggtccgaaaaaaaaccggattctaacttctgttaaattgaaaaaagccaaaacctttggcaaaatgggttagcccaattttttccccccaaaaaaaaaaaaaaaaaaatttttcttaccccgccccccccaggggggggcccgggacccaattcccccaaaaaggggaggaaaaaccccgccccccgggggcggtttttttaaaagccgggggggg

SEQ ID NO: 45783 - protein, 64 aa, Zea mays
  misc_feature: Ceres CLONE 1450198-F
MARLHWLEAVLPLGIIGGMLCIMGNAQYFIHKAAHGRPKHIGNDMWDVAMERRDKKLVEQSSGH

SEQ ID NO: 45784 - DNA, 782 bp, Zea mays
  misc_feature: Ceres CLONE 1450200-F
  misc_feature (358)..(358): n is a, c, t, g, unknown, or other
  misc_feature (360)..(360): n is a, c, t, g, unknown, or other
  misc_feature (401)..(401): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (413)..(413): n is a, c, t, g, unknown, or other
  misc_feature (414)..(414): n is a, c, t, g, unknown, or other
  misc_feature (686)..(686): n is a, c, t, g, unknown, or other
aagctggggctccccgcggtggcggccgctctagaactagtggatcccccgggctgcaggaattcgcacgagaccattacctagaacatcctaatcgaaaaacactctcactgcgattccgctctcacccacctcctcttcctctcccctcccgggatcacgaggcgacgccacccgcgagattgacgggagccgatagatctgcgcggctacgctacgcagtcacactgcgctcacctgacctgactccgctctgttcatgccgcggaggtagagtccgcgggccggcggtggccacggccagcctcctcggccgtcgggatgaattcgcggaggttcggctacggctacggctacngntacttttttttccccccccccgaggggaaagaaagggggcnncnnnnnctccnncctctcccccaccggcctgatcctaacaaataacccagggcccccccacgcggcgggacccccccgccggcggcggccggtcgccgagcataaaactggcgcgaggcccgggggagagcgaagaagaccccccttccccccggggcaacccgaggggcgccgtttgctgacttccgcggaacctccccacccctcacagctccccccggaaggccctccccacgccggcgcccggaacgcgaagtcggccctccggccggcgaacttccggnggcgacgtcggggccgccagatgccgggagcacgcccgcgatcccccccgggcggcgcagccctgtgtgccgcctccgctcgccctctctccaacc

SEQ ID NO: 45785 - DNA, 701 bp, Zea mays
  misc_feature: Ceres CLONE 1450202-F
  misc_feature: Encodes the peptide sequence at SEQ ID NO. 45786
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaaaccgtgctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccatgctcggcgctgtccccgaacgctactcatggactggaggagagattgggtttgacacctacttctccatggccaggggcaacgccactgtccctgctatggagatgaccaagtggtttgacaccaactaccactttattgtccctgaattgggcccaaacaccaagttctcctatgcttctcacaaggctgttaacgaatataaggaggctaaggcgctcggtgttgataccgtgccagtacttgttggaccagtctcgtacctgttgctctcaagcctggccaggntgtggagaagggattccctc

SEQ ID NO: 45786 - protein, 176 aa, Zea mays
  misc_feature: Ceres CLONE 1450202-F
  misc_feature (2)..(176): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (170)..(170): Xaa is any aa, unknown, or other
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEAKALGVDTVPVLVGPVSYLLLSSLARXWRRDSL

SEQ ID NO: 45787 - DNA, 720 bp, Zea mays
  misc_feature: Ceres CLONE 1450206-F
  misc_feature: Encodes the peptide sequence at SEQ ID NO. 45788
  misc_feature (540)..(540): n is a, c, t, g, unknown, or other
  misc_feature (589)..(589): n is a, c, t, g, unknown, or other
  misc_feature (719)..(719): n is a, c, t, g, unknown, or other
tggagctccccgcggtggcggccgctctagaactagtggatcccccgggctgcaggaattcgcacgagaccattacctagaacatcctaatcgaaaaatacccactctcccatccacgagaccacaagccacaccaaacccgcgttcatcgacggacgagctcgccggcgagagagcgactgagatggaggcggcggcagcggcggccggcgtggagctgggctcctcgaagccccagatcgcgacgcaggcggagatggcggaggcccgggtgccgctcgcctaccgcgatcagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagacctaggtcaagggcggcgcctccattggcctcatcccggccacccgccagctcgcctgatacgggtcccagaccgatccgcttgattnaggtctgcctggtggctatagcagcgtccagaggcgttgcgccgtgcanggatcctcaatgggttgtgtgtgaaagagatacgcgtttgatttggcataaagtaactgggtgcttctttttcccctccctctctctccatctcctggctgatggctatcttcaggttccatttgatgang

SEQ ID NO: 45788 - protein, 90 aa, Zea mays
  misc_feature: Ceres CLONE 1450206-F
  misc_feature (1)..(89): Pfam Name: NDUF_B7 Pfam Description: NADH-ubiquinone oxidoreductase B18 subunit (NDUFB7)
MEAAAAAAGVELGSSKPQIATQAEMAEARVPLAYRDQCAHLLIPLNKCRVAEFYLPWKCEPERHAYEKCQYELVMERMLQMQKIREAQET

SEQ ID NO: 45789 - DNA, 808 bp, Zea mays
  misc_feature: Ceres CLONE 1450207-R
  misc_feature (1)..(1): n is a, c, t, g, unknown, or other
ncgattgggtacgcgcgcgccctgcgaagacgacggcatcgataaggttttttttttttttttttgagcggccgccaccgcggaggagctcctgctttcgccccccttttcgagggttaattagtttaaactagtaaaactgtcttaaagaggaccttgatacagcaaccgcaagacttttcataaataagtagcatacataagggctagacataaaagcccccgtttcatcaaattgctcacaccaaaattgccccagtcctttactaccaaatccagggggggactgagcttatcccctgcttgtttttccaaaagggcgtttcccaaaaaacaaatgctttggttttaaagggggaaaaacacgatcagcctctccacaacaagcttccttgttcctgttcctagaagcggcctttgctttcttgaaagcctttttcttctgcccaaagcccttgaatccttctccaggaaggacttcctcaggagcccgggacctaaacctaaaccttgatgtccgacccaacttcttgttgctttgctggccatctatctccataccgcaaccatccggtggagttctgctcattgacctctcacgcttgcgacccctaaacgggctgcgaatttttttcgtgggaggccttgggaccatccccctggattaaaaagtgggggcccatcccaaaaggttggggaaattccccaactttggccaaacttttccgggggaaaaaagggacggggtttttctgcaggatcctccctcctcattcccagggtccctggggaaaaagaaaaaacgccc

SEQ ID NO: 45790 - DNA, 773 bp, Zea mays
  misc_feature: Ceres CLONE 1450212-F
  misc_feature: Encodes the peptide sequence at SEQ ID NO. 45791
  misc_feature (372)..(372): n is a, c, t, g, unknown, or other
aagctggagctccccgcggtggcggccgctctagaactagtggatcccccgggctgcaggaattcgcacgagaccattacctagaacatcctaatcgaaaatgcccattatgttccctttttctgcaatactaaagaagctggatttgcaatacactttcctcaccactgaggaccattgccagctcattgcaaaatgcccgaacttactagttctcgcggtgaggaatgtgattggagatagaggattaggagttgttgcggatacgtgcaagaagctccaaaggctcagaatagagcgaggagatgatgaaggaggtgtgcaagaagagcagggaggggtctctcaagtgggcttgacgggtatagccgnacgttgccgtgagctggaatatatagctgcctatgccccccatataaccaatggggccttggaatctatcgggacattctgcaaaaaactatacgacttccggcttgttctacttgatagagaagagaggataacagacttgccactggacaatggtgtccgagctttgttgaggggctgcaccaagcttcggaagtttgctctgtacttgagaccaggagggctctcagatgcaggtctcggctacattggacagtgcagcggaaacatccagtacaggcttctcggtaaatgttgggaaactgatgatggattgatcagcttcgcattgggtggcgtaaacctgcgaaaacttgactcaagaggtgctggcttcaccaagcgagcactgggcccttgca

SEQ ID NO: 45791 - protein, 224 aa, Zea mays
  misc_feature: Ceres CLONE 1450212-F
  misc_feature (91)..(91): Xaa is any aa, unknown, or other
MPIMFPFSAILKKLDLQYTFLTTEDHCQLIAKCPNLLVLAVRNVIGDRGLGVVADTCKKLQRLRIERGDDEGGVQEEQGGVSQVGLTGIAXRCRELEYIAAYAPHITNGALESIGTFCKKLYDFRLVLLDREERITDLPLDNGVRALLRGCTKLRKFALYLRPGGLSDAGLGYIGQCSGNIQYRLLGKCWETDDGLISFALGGVNLRKLDSRGAGFTKRALGPC

SEQ ID NO: 45792 - DNA, 692 bp, Zea mays
  misc_feature: Ceres CLONE 1450213-F
  misc_feature: Encodes the peptide sequence at SEQ ID NO. 45793
  misc_feature (444)..(444): n is a, c, t, g, unknown, or other
  misc_feature (551)..(551): n is a, c, t, g, unknown, or other
acccgcggtggcggccgctctagaactagtggatcccccgggctgcaggaattcgcacgagaccattacctagaacatcctaatcgaaaaaccaaattggcacttccgtaccccgaccccggccaccgtgtggaaacagaaacagcaatggcggggaggctggtgccgagcacgaagaaggcgatggagcaccgggaggagaagcccaaggtgccgtcgagcgacccgggctccgacctcgacctggtgcagctggtggccgggcagcagccgcccaacatctcggagatgaagccgctgacgcgggaggcgtacggcggcgggatgtacgcggccgaggaggagggcggccggcggaggggccccgcgcggccgcgcgcgagcgccacgcagagcgccgacgggcccgaggagcagcgcgctggcgcgaggcccagccatccngcgcccgctgtcaccggcgaccgcgacctcgacatcaccggccagtcctacatccagtagccgcatgtgccggctgccgagcgccgcgcttgggcgttgggcattgncgttgtgtgtgtgtacacagtacagtacagtaggtacttgctagtatacttggttgtgtacttgccaaagtgtccttgtacacgtcgcttttgttagatgtgtacgtacgtactatttgcccacgaataaaggtttggact

SEQ ID NO: 45793 - protein, 118 aa, Zea mays
  misc_feature: Ceres CLONE 1450213-F
MAGRLVPSTKKAMEHREEKPKVPSSDPGSDLDLVQLVAGQQPPNISEMKPLTREAYGGGMYAAEEEGGRRRGPARPRASATQSADGPEEQRAGARPSHPAPAVTGDRDLDITGQSYIQ

SEQ ID NO: 45794 - DNA, 758 bp, Zea mays
  misc_feature: Ceres CLONE 1450219-F
  misc_feature: Translation starting site: 176
  misc_feature: SWISSPROT Homolog: EC 3.2.1.23 Beta-galactosidase
  misc_feature (754)..(754): n is a, c, t, g, unknown, or other
aagctggagctccccgcggtggcggccgctctagaactagtggatcccccgggctgcaggaattcgcacgagaccattacctagaacatcctaatcgaaaaagactacacccccatcccgcagcagccaaaacctacctagccgccgccgcaggcggccccccatcgccgccaagatgcagatctttgtggtggttttagaggcggatacggagggggatacagtcgtggcccagctgctgctgctccatccattgaagatcaagctcagttcccaagccttggtgggaagtgaagggcgcccagctgctgctgtcaccgagcgttgtgttgtctgctgttgtcatatttaaattttgtccgacgttacatttctgtgccacggtttaaacggaacaaataatggtgttgcatgtggctatctttggttatgtggtacttgacgttgaataccggagttgttgtttatcaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaaagttgcgcagcctgaatggcgaatggaaatttgtagcgttaatattttgttaaacttcgcngtaa

SEQ ID NO: 45795 - DNA, 678 bp, Zea mays
  misc_feature: Ceres CLONE 1450226-F
  misc_feature: Encodes the peptide sequence at SEQ ID NO. 45796
  misc_feature (624)..(624): n is a, c, t, g, unknown, or other
tggagctccccgcggtggcggccgctctagaactagtggatcccccgggctgcaggaattcgcacgagaccattacctagaacatcctaatcgaaaacaacacggcccccttcgcgcagcggttcgcggagacgctggactactacgcggccatcttcgagtccatcgacctggcgctgcccaggggcgacagggagcggatcaacatcgagcagcactgcctggctcgggagatcgtcaacctggtggcctgcgagggcgaggagcgggtggagcggcacgaggtgttcggcaagtggaaggcgcgcctcatgatggccgggttcaggccgtccccgctcagcgcgctggtcaacgccaccatcaagacgctgctgcagagctactcgccggactacaagctcgccgagagggaaggcgtgctctacctcggctggaagaacaggcccctcattgtttcatcggcatggcactagtgttggcctcgtggagaatgttggcctcgtggagaatgtttcttgtgactttctacctcgttgttagtatagatatgcttggctgagcactaaaactatatataggaagcctgtggtggtactgagtttgtacacacctataacctantaacctgatgttgtgaattgtgatggcagtcactaccagcctgataatgtgtag

SEQ ID NO: 45796 - protein, 54 aa, Zea mays
  misc_feature: Ceres CLONE 1450226-F
  misc_feature: The sequence is a functional homolog of SEQ ID NO 474 in the 10/666,642 US patent application
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
MMAGFRPSPLSALVNATIKTLLQSYSPDYKLAEREGVLYLGWKNRPLIVSSAWH

SEQ ID NO: 45797 - DNA, 760 bp, Zea mays
  misc_feature: Ceres CLONE 1450235-F
  misc_feature: Encodes the peptide sequence at SEQ ID NO. 45798
  misc_feature (375)..(375): n is a, c, t, g, unknown, or other
  misc_feature (408)..(408): n is a, c, t, g, unknown, or other
  misc_feature (413)..(413): n is a, c, t, g, unknown, or other
aagctggagctccccgcggtggcggccgctctataactagtggatcccccgggctgcaggtaattcgcacgagaccattacctagaacatcctaatcgaaaaaccaagaaagaatcacacaacagcagctcaaaaacctaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccnggcgacgtcaaggagctcccgggcgcgtacgcngtccnggtggacatgccggggctgggcacgggcgaccatcaggtgcagggtggagaaccagcgggtgcctgggatcaaccgcaagcggccccgggagagcccaggaaccccaattcctgccaatggaacggggaaggggaatttcatggcaaatttcggggtgccggaaaccccaaagggaaaaatttcccgggtgttaaggaaagggtttccccccgggccccaaagaggtccccccccccgccccaaaacccaaaaccccgggggggggccccgggggggagaattccccacctggtcttttaaaagggggcgcccccccctggggggaccctcctctggggggtgaggg

SEQ ID NO: 45798 - protein, 170 aa, Zea mays
  misc_feature: Ceres CLONE 1450235-F
  misc_feature (71)..(71): Xaa is any aa, unknown, or other
MDGRMFGLETPLMVALQHLLDVPDGDAGAGGDKASGAAAGGGPTRTYVRDARAMAATPGDVKELPGAYAVXVDMPGLGTGDHQVQGGEPAGAWDQPQAAPGEPRNPNSCQWNGEGEFHGKFRGAGNPKGKNFPGVKERVSPRAPKRSPPPPQNPKPRGGAPGGRIPHLVF

SEQ ID NO: 45799 - DNA, 729 bp, Zea mays
  misc_feature: Ceres CLONE 1450237-F
  misc_feature: Encodes the peptide sequence at SEQ ID NO. 45800
  misc_feature (384)..(384): n is a, c, t, g, unknown, or other
  misc_feature (404)..(404): n is a, c, t, g, unknown, or other
  misc_feature (416)..(416): n is a, c, t, g, unknown, or other
  misc_feature (417)..(417): n is a, c, t, g, unknown, or other
  misc_feature (448)..(448): n is a, c, t, g, unknown, or other
acccgcggtggcggccgctctataactagtggatcccccgggctgcaggaattcgcacgagaccattacctagaacatcctaatcgaaaaattatccgaagttccgaacccacgccaagccccagggtccgaccgcagaaccgacccaaaatgtcgcccgcctctcccatgctcaccgccgtgtcgctctcctccccgttcccagccccgcgcctccgcgccgccgccgccgcctccttcgctccgccgcgccgcgcggcagtcgcactcgtcgtgcgcgcggcgtccgcatcttccaagtcccctgccacggcggaggcggccccaaagaagaagagggcgaccggcatcacccagccgaagtccgtgtcgccggcgctgcangcaatcgtgggcgacccggntattccccgcanncgagtccctcagcgcctctggggctatatcnaggagcataacctccaggatccctctgataaaaaggtggtggtttgtgatgaaaaactgaaggtcctgtttcccggggcggaaacaagtcgaatccctcaaaatcgctaaatttcttaacccttatttctggaagggaggaagaccaggcccctttcccggaaaccaggtaactttggggtgggtccttgggggggggcccaaaaaaaaggggcccggcgctttggtttttggaacccagagatggccccccccactttacaaaagggttttgttaccttt

SEQ ID NO: 45800 - protein, 135 aa, Zea mays
  misc_feature: Ceres CLONE 1450237-F
  misc_feature (67)..(135): Pfam Name: SWIB Pfam Description: SWIB/MDM2 domain
  misc_feature (78)..(78): Xaa is any aa, unknown, or other
  misc_feature (85)..(85): Xaa is any aa, unknown, or other
  misc_feature (89)..(89): Xaa is any aa, unknown, or other
  misc_feature (100)..(100): Xaa is any aa, unknown, or other
MSPASPMLTAVSLSSPFPAPRLRAAAAASFAPPRRAAVALVVRAASASSKSPATAEAAPKKKRATGITQPKSVSPALXAIVGDPXIPRXRVPQRLWGYIXEHNLQDPSDKKVVVCDEKLKVLFPGAETSRIPQNR

SEQ ID NO: 45801 - DNA, 753 bp, Zea mays
  misc_feature: Ceres CLONE 1450240-F
  misc_feature: Encodes the peptide sequence at SEQ ID NO. 45802
aagctggagctccccgcggtggcggccgctctagaactagtggatcccccgggctgcaggaattcgcacgagaccattacctagaacatcctaatcgaaaaacgagacaaagggcctcacgctttccacatcgacacaaaaccaaccgccgccacctccatccgctcgcgctagctgtgtgcgtgccttgtctgccacaactccagcacttggagtcttcgaccaccacgacgacggcaggggaggagaaacaggcaggcgggtcatccttggagacggaggaagagacgacgcccaaggcgaagaagcggccgcagtcgctgctcgggagcctgcgggaggcgatcaccaaggtccggttcctgatctcctccagcgcgacgcgggggatgctgctcaagtccctggcccacgccccccccgcgggggggggcccctgggcggggcctctacttcaacacttggaccggccccgcttgaaacattctcagcggcgccagacatctcctcccggagctccgagacctcatgagggtcctccctgggcccggtgactaccccgacacttgaccggagcatctccccgacaacgccagaacgtcctaaaaagggctcatctgacttcggggggcccagcccacgaagccggtcccatggtattaaaccccgaccatccgcgctgaccttctcttccaaattctaaaaaaactggtgataggaatgcaaacctcgttgcttatgggttccccccgg

SEQ ID NO: 45802 - protein, 183 aa, Zea mays
  misc_feature: Ceres CLONE 1450240-F
AGAPRGGGRSRTSGSPGLQEFARDHYLEHPNRKTRQRASRFPHRHKTNRRHLHPLALAVCVPCLPQLQHLESSTTTTTAGEEKQAGGSSLETEEETTPKAKKRPQSLLGSLREAITKVRFLISSSATRGMLLKSLAHAPPAGGGPWAGPLLQHLDRPRLKHSQRRQTSPPGAPRPHEGPPWAR

SEQ ID NO: 45803 - DNA, 800 bp, Zea mays
  misc_feature: Ceres CLONE 1450242-F
  misc_feature: Encodes the peptide sequence at SEQ ID NO. 45804
  misc_feature (356)..(356): n is a, c, t, g, unknown, or other
  misc_feature (362)..(362): n is a, c, t, g, unknown, or other
tggagctccccgcggtggcggccgctctataactagtggatcccccgggctgcaggaattcgcacgagaccattacctagaacatcctaatcgaaaacagatccctacgtacgccgcccgccagccatggcccgctcctcctcgcagtcgcagtcctccgttggcgctggcgccggcgccggcgcgcgcccggccaccgtggggccgcgcggcacggccgcggcggccgccgggatgcgccgccgccgcgccaccgcgtccggcgggggtggcggattctcggggggcggcgggagcaacatgctccgctttctacacgacgaagcgccggggctccggctctcgcctaccatggngctcgncatgtccctctggctcatcgggttcgtcaccgcccttccaaatcttcggaaaagctctaccgcttccgggagggccgggggcccccgcgggaatccaatccaaatccagacgcttttgctccccaactttggaaataaaaaaaaaaaatcaaagggggaaagtttttgttttttggggagaaaaattttgatttcgcaaaaccccccaacttgttgggggcccccacattttgggggggccccttttttccccccggaaaagaaaacccccaaagggggggaaattttgggccctttttttttgaaaaaaaaaaaaaaaaaaattttcttcccccccccccctcggggggggggggcggcccccccctccctccctaaagagagagaaataatacccccgcccgccggcgacttttttttaagggggtggggaaggaa

SEQ ID NO: 45804 - protein, 224 aa, Zea mays
  misc_feature: Ceres CLONE 1450242-F
  misc_feature (53)..(98): Pfam Name: Sec61_beta Pfam Description: Sec61beta family
  misc_feature (77)..(77): Xaa is any aa, unknown, or other
  misc_feature (79)..(79): Xaa is any aa, unknown, or other
MARSSSQSQSSVGAGAGAGARPATVGPRGTAAAAAGMRRRRATASGGGGGFSGGGGSNMLRFLHDEAPGLRLSPTMXLXMSLWLIGFVTALPNLRKSSTASGRAGGPRGNPIQIQTLLLPNFGNKKKKSKGESFCFLGRKILISQNPPTCWGPPHFGGAPFFPPEKKTPKGGEILGPFFLKKKKKKIFFPPPPRGGGAAPPSLPKEREIIPPPAGDFFLRGWGR

SEQ ID NO: 45805 - DNA, 836 bp, Zea mays
  misc_feature: Ceres CLONE 1450243-F
  misc_feature: Encodes the peptide sequence at SEQ ID NO. 45806
  misc_feature (372)..(372): n is a, c, t, g, unknown, or other
  misc_feature (388)..(388): n is a, c, t, g, unknown, or other
  misc_feature (419)..(419): n is a, c, t, g, unknown, or other
  misc_feature (450)..(450): n is a, c, t, g, unknown, or other
  misc_feature (498)..(498): n is a, c, t, g, unknown, or other
  misc_feature (514)..(514): n is a, c, t, g, unknown, or other
  misc_feature (515)..(515): n is a, c, t, g, unknown, or other
  misc_feature (522)..(522): n is a, c, t, g, unknown, or other
  misc_feature (523)..(523): n is a, c, t, g, unknown, or other
  misc_feature (528)..(528): n is a, c, t, g, unknown, or other
  misc_feature (529)..(529): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (632)..(632): n is a, c, t, g, unknown, or other
  misc_feature (633)..(633): n is a, c, t, g, unknown, or other
  misc_feature (674)..(674): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (721)..(721): n is a, c, t, g, unknown, or other
  misc_feature (788)..(788): n is a, c, t, g, unknown, or other
  misc_feature (790)..(790): n is a, c, t, g, unknown, or other
  misc_feature (791)..(791): n is a, c, t, g, unknown, or other
  misc_feature (811)..(811): n is a, c, t, g, unknown, or other
aaagctggagctccccgcggtggcggccgctctataactagtggatcccccgggctgcaggaattcgcacgagaccattacctagaacatcctaatcgaaaaaacacaagctcgacggaactgtgactagaactagtagatccaatccaacactcgggacgaaattaaaggagacgacgcatcatccggccggcaggcatcgcacggtcaccaccatggcggcgcaggagggcggcatgaggctggtgtcgcacccgatcgcggcgcacgacgggcggctgccgcggcagtacacggcgaaggggcagggcgccaagaaggacatgtcgcccgcgctggagtggtacggcgtgcccgagggcgcgcgtttgntgggcctccctggtgnaggaaatctaacgcgaacccggttttggccnggaaccccctggggggggtggcaaaatcccnccccccccccggggcgcccccccaaagggtttcccccgccccccccgngcccgggggccggggnngggcccnnaaccnntctcggcgcccctctagaggggggatcaaacacatgggaaaaaannnnggggtggggggggggggggaggggcccccccccggggccccgcccttcccctttnnactctctctcccctccccacacaaaggggcgctctctcctncccaagtgcgcccccggggaannnattattaaagaatccatacccgngcgccctttttgtaaaaaaacatcaatatttcccccccgtcttcccccgcgggccccccccccccancnnctacccacaccccctgcaanatcttctccctggggggtatttctc

SEQ ID NO: 45806 - protein, 207 aa, Zea mays
  misc_feature: Ceres CLONE 1450243-F
  misc_feature (53)..(53): Xaa is any aa, unknown, or other
  misc_feature (58)..(58): Xaa is any aa, unknown, or other
  misc_feature (79)..(79): Xaa is any aa, unknown, or other
  misc_feature (95)..(95): Xaa is any aa, unknown, or other
  misc_feature (100)..(100): Xaa is any aa, unknown, or other
  misc_feature (103)..(103): Xaa is any aa, unknown, or other
  misc_feature (105)..(105): Xaa is any aa, unknown, or other
  misc_feature (120)..(120): Xaa is any aa, unknown, or other
  misc_feature (121)..(121): Xaa is any aa, unknown, or other
  misc_feature (139)..(139): Xaa is any aa, unknown, or other
  misc_feature (140)..(140): Xaa is any aa, unknown, or other
  misc_feature (161)..(161): Xaa is any aa, unknown, or other
  misc_feature (169)..(169): Xaa is any aa, unknown, or other
  misc_feature (191)..(191): Xaa is any aa, unknown, or other
  misc_feature (192)..(192): Xaa is any aa, unknown, or other
  misc_feature (199)..(199): Xaa is any aa, unknown, or other
MAAQEGGMRLVSHPIAAHDGRLPRQYTAKGQGAKKDMSPALEWYGVPEGARLXGLPGXGNLTRTRFWPGTPWGGWQNPXPPPGRPPKGFPPPPPXPGAGXGPXTXLGAPLEGGSNTWEKXXGWGGGGRGPPPGPRPSPXXSLSPPHTKGRSLLPKCAPGEXIIKESIPXRPFCKKTSIFPPRLPPRAPPPXXLPTPPAXSSPWGVFL

SEQ ID NO: 45807 - DNA, 697 bp, Zea mays
  misc_feature: Ceres CLONE 1450250-F
  misc_feature: Encodes the peptide sequence at SEQ ID NO. 45808
  misc_feature (603)..(603): n is a, c, t, g, unknown, or other
  misc_feature (665)..(665): n is a, c, t, g, unknown, or other
gcggtggcggccgctctagaactagtggatcccccgggctgcaggaattcgcacgagaccattacctagaacatcctaatcgaaagggttgagttgggtccaaggtttttatcgtcacgcgtcatcacaagcatactccatccagtacaatactgttggtctagccggcggcggccgcgtccctcatccagtcatcccctttccgcgatcaaaaccgagctagggttttaggtgcgggggagagggtgaggagcggacggaggcgcgccatggacaaccccgagatgcagcggttccttcagcaagagcagcaaaaggcgatgatgaacgagatggttggcaagctaacgagcgtgtgctgggacaagtgcatcactagcgctcccgggagcaagttcagttccggggaatcaacctgcctgaccaactgcgcccagagttttctcgacatgagcgtgatgattgccaaacgctttgagatgaagtgaggcgtcgacgccgaaagcttgtacctagtcaatcaccctgagttttttaaccctttgatttgaggttccattgagcacttcgaacgattcaacagagtttaatggactttctatnatggatctactgccctcgtgggcaacgtgttaagtgtgatttgagccgggtgaaactgaatnatgtacaccttctgtcctgagttaaactaagg

SEQ ID NO: 45808 - protein, 72 aa, Zea mays
  misc_feature: Ceres CLONE 1450250-F
  misc_feature (7)..(72): Pfam Name: zf-Tim10_DDP Pfam Description: Tim10/DDP family zinc finger
MDNPEMQRFLQQEQQKAMMNEMVGKLTSVCWDKCITSAPGSKFSSGESTCLTNCAQSFLDMSVMIAKRFEMK

SEQ ID NO: 45809 - DNA, 780 bp, Zea mays
  misc_feature: Ceres CLONE 1450252-F
  misc_feature (316)..(316): n is a, c, t, g, unknown, or other
  misc_feature (317)..(317): n is a, c, t, g, unknown, or other
tggagctccccgcggtggcggccgctctagaactagtggatcccccgggctgcaggaattcgcacgagaccattacctagaacatcctaatcgaaaagtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggactagatcaccgagaagttccacggcggggactcgtcgtcgtcgtcgtctgactcggacgacaagagaaggggtcctcgnntgcgtcggcggcggaagccatgaagggcaaaatctaccggccttttcggccgggaaagggccgtccaattcaatacggtcaacctccaggggggggccccggaacccaatttccccttaaagggggcccaattaaccgccgttccctgggccgctttttttaaacccgcctgggtgggggaaaacctcgggggtttccccaatttaatcccccttggaaaaaattccccctttttccccggggggagaaaaaaaaaaaaaaagccccccccatattcccctttcccaaaattttgccccccctgggggggggagggaaattaatttccccccaaatattttttaaaaaccccccggaaatttttttggaaacccccctttttttttttaaaagggggggaaggggggaattcctcttttttaaaaaaaaaaacccgcggggggggggggtttctttcttttca

SEQ ID NO: 45810 - DNA, 772 bp, Zea mays
  misc_feature: Ceres CLONE 1450253-F
  misc_feature: Encodes the peptide sequence at SEQ ID NO. 45811
  misc_feature (338)..(338): n is a, c, t, g, unknown, or other
  misc_feature (411)..(411): n is a, c, t, g, unknown, or other
  misc_feature (416)..(416): n is a, c, t, g, unknown, or other
ggagctccccgcggtggcggccgctctagaactagtggatcccccgggctgcaggaattcgcacgagaccattacctagaacatcctaatcgaaaaatcggggacgagggactgggagccaggatacttctgccgcgcggcgaccggtcgagcgaaatcgatctaccccaggtgcggcaggcgcggctttattctcaagattttttctgtgttctttagagagcagccatggacgagtggattcgccaaaccgaggtgtgggtgcaccaaaccgacagctggatccggcagcagcccccggagcagatctatgtagcgggcgcggtgggtgccgtcancatcctggtgcttatcgtagcatcttgtctgaaatcgtctagaccaaacaacatagtcctatctggggctaangggcngtgggcaaaccactatttactaccaggcttcgggatgggatcttcccatccaggaaatgtgttactttccatggaaaaaaaacaggggaaccctttttgggcctgcttccgggcccagaaggggaaaaaaaaggaaaaccggggcgcaatttattagggttcccgggggcggcggggcgccacacccccacctttgaggaaaacccccccacaaaacgcgggggggggggtttttttgggtgagagcccaaaaatttttttttataaaaggaaaagggtgtgaaaaaactctttttttaattttttttaaaaaggcctttttgtaaaaaaaaaaagcccttcgtgttttttatttc

SEQ ID NO: 45811 - protein, 114 aa, Zea mays
  misc_feature: Ceres CLONE 1450253-F
  misc_feature (37)..(37): Xaa is any aa, unknown, or other
  misc_feature (61)..(61): Xaa is any aa, unknown, or other
  misc_feature (63)..(63): Xaa is any aa, unknown, or other
MDEWIRQTEVWVHQTDSWIRQQPPEQIYVAGAVGAVXILVLIVASCLKSSRPNNIVLSGAXGXWANHYLLPGFGMGSSHPGNVLLSMEKKQGNPFWACFRAQKGKKKENRGAIY

SEQ ID NO: 45812 - DNA, 706 bp, Zea mays
  misc_feature: Ceres CLONE 1450257-F
  misc_feature: Encodes the peptide sequence at SEQ ID NO. 45813
  misc_feature (245)..(245): n is a, c, t, g, unknown, or other
  misc_feature (300)..(300): n is a, c, t, g, unknown, or other
  misc_feature (366)..(366): n is a, c, t, g, unknown, or other
  misc_feature (372)..(372): n is a, c, t, g, unknown, or other
  misc_feature (380)..(380): n is a, c, t, g, unknown, or other
  misc_feature (395)..(395): n is a, c, t, g, unknown, or other
aagctggagctccccgcggtggcggccgctctagaactagtggatcccccgggctgcaggaattcgcacgagaccattacctagaacatcctaatcgaaaagaggaaacgtctcgaatggtcgaacagtagtttgctcgctattatccatggcgacttctacggctgctgccactgcactgctccgccccaggccggcagttccagccaagttggcgcagaggaggtgcctccatgcggttgctnggtggacgacgatgaggaggaggggagctgcaggggtcgtgcgagctttcttcanccctctcggggatgagcgcatcctccgagaagcatcagggagcagtagcatcatgggtgtgtgttngctggnctcttgangcttgacctgatgangatctctcaggaatggattaatccgacagtggaagcttctgaataactgaagaaaacgctttgagaatccagggagcaaatcaaatatgccccctccccaattgaaatggagggggggcattgcccatttttggccattggcccttttccctggaacttatcccgaaaaatggaaacccggattcccccgggtgtttaaaaaaaaaggggccctaaaacgttttattttaaaatttgggtcccccccaaaaaaaaaccccggggcgcccgtgtttttttacacccctcttgtttaaaaagagcccccctcc

SEQ ID NO: 45813 - protein, 76 aa, Zea mays
  misc_feature: Ceres CLONE 1450257-F
  misc_feature (33)..(33): Xaa is any aa, unknown, or other
  misc_feature (51)..(51): Xaa is any aa, unknown, or other
  misc_feature (73)..(73): Xaa is any aa, unknown, or other
  misc_feature (75)..(75): Xaa is any aa, unknown, or other
MATSTAAATALLRPRPAVPAKLAQRRCLHAVAXWTTMRRRGAAGVVRAFFXPLGDERILREASGSSSIMGVCXLXS

SEQ ID NO: 45814 - DNA, 704 bp, Zea mays
  misc_feature: Ceres CLONE 1450260-F
  misc_feature: Encodes the peptide sequence at SEQ ID NO. 45815
agagctggagctccccgcggtggcggccgctctagaactagtggatcccccgggctgcaggaattcgcacgagaccattacctagaacatcctaatcgaaaaacgacgactcttcaccccaccctctcctcctccaactagtcaggctgctagtgctacctttcaaaaaacccctacatcctgccatacatccatccgccgccgccgccgccgccatctcctcccactctcttcccactccgacgaaaccctattcagtatccatctctccatccatggcgtggcgcggccccgccacccgggccgtcctcgccgccgtccgccgcccggcagcggccgcgcgcctccacgccccgcgccgccgcgtcccgcccgccttcgccaccacctcctccccgctcccgtccgcgcggcctctggcggcgttgatggggtccccggtgacggtggccgccgtgatggcgcgtctcacggcgcatcccggcgccagcgcgcgcgcgtgctgcgagctttcccagggtacttgaatctgttgtgtagatcccatcctttcgaaaggataaatgatgtgtcttttgggggaataaaagctattatggcatttcttccacagcaaagttcgaagaaattacccaacaatagctagtttcctcgttaggatttcgagaagacttaataattttaacgttacatggcatggtttt

SEQ ID NO: 45815 - protein, 32 aa, Zea mays
  misc_feature: Ceres CLONE 1450260-F
MGSPVTVAAVMARLTAHPGASARACCELSQGT

SEQ ID NO: 45816 - DNA, 713 bp, Zea mays
  misc_feature: Ceres CLONE 1450272-F
  misc_feature: Encodes the peptide sequence at SEQ ID NO. 45817
  misc_feature (713)..(713): n is a, c, t, g, unknown, or other
agagctggagctccccgcggtggcggccgctctagaactagtggatcccccgggctgcaggaattcgcacgagaccattacctagaacatcctaatcgaaaaagtcgcccccatccgttcctcatctcaccagaagcgaagccggaggagggaggaaggagatcgcgagcagccggagccggaggccgagaggatgaagacgttcgacccgtggccggtcttcttccgccgggagtggaagcgcaactggccctttctcacggggttcgccatcaccggcttcatcatcaccaagatgacggccaacttcaccgaggaagacctcaagaactccaagttcgtccaggaacacaagaagcgctgaccaaccgggtggagtcgtccgaatcgcctgcggatgaaaaattagccccctatttttcttgtcttttttttatctagatgcgtgcactctattgtaataatgtaataagaggcaattggattgatccaacagcaaccggcttctgattttgatccgcttcgctgacatatgcatgcagcaaacgaatatgtgccttttttttcttgatgttggattgcatctaatcctgttgaattggtgagctgggtcctctgtgatttcatctttccctgataaagtcctgaagatagattggtcttgtttgaaaaaaaaaaaaaaaaagaaaaaaaaaaaaaaaaagcttatcgan

SEQ ID NO: 45817 - protein, 56 aa, Zea mays; identical to SEQ ID NO: 5462
  misc_feature: Ceres CLONE 1450272-F

SEQ ID NO: 45818 - DNA, 717 bp, Zea mays
  misc_feature: Ceres CLONE 1450275-F
  misc_feature: Encodes the peptide sequence at SEQ ID NO. 45819
  misc_feature (413)..(413): n is a, c, t, g, unknown, or other
aagctggagctccccgcggtggcggccgctctagaactagtggatcccccgggctgcaggaattcgcacgagaccattacctagaacatcctaatcgaaaaactgcggctagagccgtcgtgtgtgagtctttgcacgaggagagataggcgaccggcgaccgcaagcaggactagccatcatcaagcagtcaggaaagcaagcgagaagtcgtcgcgctactcttcgttgcctatatactccgcctccgcctccggtggttggttggtccctctaccatccccagatcgcctgccttccctgctctccccatctgctcaccgcgcgccccaaatctccccgtccaaaggcgacccaagcatcgcatcggatccggcctgcgctttgccgcctgccactgcagaaccgacccnacaatggcccagccttccatgcttacgccgacaagaacgccgtcttccgccgtctcaaggccaagcccgagaacaagacgtgcttcgactgccacgcctagaaccccacctgcgcctccgtcacctactgaatctacctctgcctcaactgctccgctgcccatcgtaccctcggggtccacatcacctctcgcatgtccacgaagctctactcatggactctagacccgctgaggatgatggcattcacgagctacagcctcgcacatgcattcgtcacgcagcatgtatggaccgatggcaa

SEQ ID NO: 45819 - protein, 36 aa, Zea mays
  misc_feature: Ceres CLONE 1450275-F
MSTKLYSWTLDPLRMMAFTSYSLAHAFVTQHVWTDG

SEQ ID NO: 45820 - DNA, 697 bp, Zea mays
  misc_feature: Ceres CLONE 1450276-F
  misc_feature: Encodes the peptide sequence at SEQ ID NO. 45821
aaagctggagctcaccgcggtggcggccgctctagaactagtggatcccccgggctgcaggaattcgcacgagaccattacctagaacatcctaatcgaaaagaactgatcctattctgtcctattctagcgcgctctgacggaggcgtcgcgttcgatcctcacaatgcagtgaaatcactctgctctcctctgcttccttctataaatctaatagaataactccgtcaagaagcaacgagcatagaacaattcaacagaggaagaatcaggcagggagctctcccattcgcatcccaggccaacctcaaccccaatccaatccgttgcaggtcgcaggatggctccgcgtgagcaccaccagccccaggaggaggaggacgaggacaccgcaggcgtcgtcaagctcaccacccccgagggcttcgaattcgtcgtcgacaagaaggccgccatggtctccaacaccctacgcaacatgctcacatcgccaggcggtttctccgagacgcgccacggcgaggttcgcttcccggagatccccaccaatatcctcgagaagatctgccagtacttctattggtctctccatcactccagtggcaaggaaacagcagagtttctgatcgaaccccagatcaccctggaagctgatgaaggccgcaaactaccctggacacttgatgaaggagcctga

SEQ ID NO: 45821 - protein, 118 aa, Zea mays
  misc_feature: Ceres CLONE 1450276-F
MAPREHHQPQEEEDEDTAGVVKLTTPEGFEFVVDKKAAMVSNTLRNMLTSPGGFSETRHGEVRFPEIPTNILEKICQYFYWSLHHSSGKETAEFLIEPQITLEADEGRKLPWTLDEGA

SEQ ID NO: 45822 - DNA, 761 bp, Zea mays
  misc_feature: Ceres CLONE 1450284-F
  misc_feature (408)..(408): n is a, c, t, g, unknown, or other
  misc_feature (422)..(422): n is a, c, t, g, unknown, or other
  misc_feature (423)..(423): n is a, c, t, g, unknown, or other
caagctggagctcaccgcggtggcggccgctctagaactagtggatcccccgggctgcaggaattcgcacgagaccattacctagaacatcctaatcgaaaatacaaacaatacaaggggtgcttcctcagaatctatcaatgctttgcctacatataaattcaaaatcaagaaacgtcgccatggttcaggcagtgaaactgaaggtcaggaaggagggatattggctgcaggaactgacaaggagcgatcactctctgctgaagacgcagtttgctgcatctgtctcgcaaaatatgcgtacaatgatgagctccctgaacttccatgtgcacactgttcccacaacgactgggttgataaatgggtcaagataaatacacttcgccctctgtgcaaatctaaaanaccccccccggccnnaacttcaaaagaccgccaagcagaccagaacaccgcaccctgggcggagatccaaaggcgttaaagttgatcagttcccctagtttttcctcatacggagccgtctgatccgcggggtatcaatccccccgcgctaaggcggtagacggatgttatcgggtgcagcacccctaaacgtgatgatttccacaagcgaccctgcttacccgggaagaggacacgttttgtcccctgcacgggcgacccaacaagagggcaggacccaatggtcccccccgcgctgataccccgcttgcgaatcgcgtcacgcacatgggctccggccgggcgctgattgg

SEQ ID NO: 45823 - DNA, 677 bp, Zea mays
  misc_feature: Ceres CLONE 1450286-F
  misc_feature: Encodes the peptide sequence at SEQ ID NO. 45824
ggagctccccgcggtggcggccgctctagaactagtggatcccccgggctgcaggaattcgcacgagaccattacctagaacatcctaatcgaaaacccactcgagccagccagccagccagaaagccgcttgggcgccatctcgctagagcttcgtaccctctgacatagatccggcgcggcccaataaacacccggcttactacagactcgcacatggccggcctcacgatgaagttcgtctccgtcgccgccatggcctccgcgctcgtggcgtcctccgcagccgccgaggcccccgccccggctcccgcgtcctactccgcggccgccgtacccctcgccgcgacctccctcgccgccgccgccttcggatacctcttctgctagatccgcactggatacttggttcctgctccaaaatatcattcccctggactggcccgcatgagtcccgctcctgtgtctcgcgtatctctgagtgaggtgtcggcgggcctgtgtgtatgtatcgactctgccgcgccagcaacggaagaggacgtgtgacgcgtgctggatggtacgtgcttccacgctccactggttgtcgcggagatcatgtctaccctgctgcgttttctggttatcaatgacgatgactcatttgattagataaaaagaaacaaaaacttatc

SEQ ID NO: 45824 - protein, 57 aa, Zea mays
  misc_feature: Ceres CLONE 1450286-F
MAGLTMKFVSVAAMASALVASSAAAEAPAPAPASYSAAAVPLAATSLAAAAFGYLFC

SEQ ID NO: 45825 - DNA, 706 bp, Zea mays
  misc_feature: Ceres CLONE 1450295-F
  misc_feature: Encodes the peptide sequence at SEQ ID NO. 45826
  misc_feature (419)..(419): n is a, c, t, g, unknown, or other
tagagctggagctccccgcggtggcggccgctctagaactagtggatcccccgggctgcaggaattcgcacgagaccattacctagaacatcctaatcgaaaagtccattcccttttgctcgcgcacgcgctcgtctctccaagcctcgaaccgcatctccggcggcctagtggaacgcgaagatggcgacggcgctcggcctcggtgcgcgctccggcctccgactcctgtccgcaggcgccgaggccgcctcagcaacgtcttctcgtgcattccattctactggcacaaggaggatgggggcgcacgctcatgatgagccatactacgtccacgccaagcacatgtacaacctgcacaggatgaagcaccagcagcttaaggtgtgcctcgctgtgctggctgcggtgggcacccncactggagtccctgtgtatgctggtgttttccagcagaagaagactgcatctgcattatctgaaaacgcgaagcggcacgacatgaaaacatgcctgccccgtgaaatttctttttccatttcccacctaaccatttgagaagtttcaggctggagcttcagttttgcttggcccattcccccccccaaaatttttttcccccctggcgccgggttacccggcccttggaattttgcaatgggaaaccgaatgctggtaaaaaaaccaatggtcttgaactgccaaa

SEQ ID NO: 45826 - protein, 124 aa, Zea mays
  misc_feature: Ceres CLONE 1450295-F
  misc_feature (79)..(79): Xaa is any aa, unknown, or other
MATALGLGARSGLRLLSAGAEAASATSSRAFHSTGTRRMGAHAHDEPYYVHAKHMYNLHRMKHQQLKVCLAVLAAVGTXTGVPVYAGVFQQKKTASALSENAKRHDMKTCLPREISFSISHLTI

SEQ ID NO: 45827 - DNA, 696 bp, Zea mays
  misc_feature: Ceres CLONE 1450297-F
  misc_feature: Encodes the peptide sequence at SEQ ID NO. 45828
aagctggagctccccgcggtggcggccgctctagaactagtggatcccccgggctgcaggaattcgcacgagaccattacctagaacatcctaatcgaaaaacgagatggctccggggaagcgaggcaaggccaaaggggcggcggcgccgctgcccaccgcggcggcgagtaccggagctgtagggttccctggctgcctccgcctgatgccgccgtcgaccgtggccatatctatacacgccaagcccggctccaaggtcgccaccatcacagagattggggacgaggcggtgggcgtgcagatcgacgcgccggcgagggatggcgaagccaacgccgcgcttgtcgactttatcagctcggtacttggggtgaagaaaagagaagtgtctataggctcgggttctaaatcgagggaaaaggttgtgctggtacaagatgcgactcttgaaggtgtctacgatgctctgaagaagtcttgtaattgtgcatgaggtatgtacggtaatcctggagttaacttgaatgggcagggcatatgaatgcttttctgatacgtaacctatttgcgatgtgatcctgttccagcttgcaaacacaagtttgaaaatgaagtgagacgtggctgaattgttcgttctcttccttaagctgtcagaataataatgcatatatgtcaatgcgatgatggcaa

SEQ ID NO: 45828 - protein, 129 aa, Zea mays
  misc_feature: Ceres CLONE 1450297-F
  misc_feature (38)..(112): Pfam Name: DUF167 Pfam Description: Uncharacterised ACR, YggU family COG1872
MAPGKRGKAKGAAAPLPTAAASTGAVGFPGCLRLMPPSTVAISIHAKPGSKVATITEIGDEAVGVQIDAPARDGEANAALVDFISSVLGVKKREVSIGSGSKSREKVVLVQDATLEGVYDALKKSCNCA

SEQ ID NO: 45829 - DNA, 712 bp, Zea mays
  misc_feature: Ceres CLONE 1450300-F
aaagctggagctccccgcggtggcggccgctctagaactagtggatcccccgggctgcaggaattcgcacgagaccattacctagaacatcctaatcgaaaattttggagtttggacgggctcgcctcggccgctctggcgcttgtgcggtgggtgaagcgcgggtgctggtgcgggaagcctcgccagacctagcgctgccgactgccgagctgggtgcgggcgcgaggagtcgacgggaagacaagggtgaggaattatgagtgaaacagggcacactgtacaagtcactaacctctcgagcagagtatctgaaagtgatcttcatgagttcttttcgttctctggtcctattgagcatatagaacttatcagatcagaaggatacggtgccactgcttatgtgacattcaccgaacgctttgccttggaaactgcagtattgctcagtggggctactattgtggatcagccagtatgcataacctattggggacaacctgagggaacttttatttctgggacaggccaacttgggaggttgaagaggaaatcgatacaggaactaccaacatgccagtacacactactccgcaggaagcttttacagtggctcaagatatcatgaagacgatgctaaaaaaggggtacgtgctccacaaggatgctttggcttaagctagagcttttgataagccctatggaataaccg

SEQ ID NO: 45830 - DNA, 690 bp, Zea mays
  misc_feature: Ceres CLONE 1450308-F
  misc_feature: Encodes the peptide sequence at SEQ ID NO. 45831
ctggagctccccgcggtggcggccgctctagaactagtggatcccccgggctgcaggaattcgcacgagaccattacctagaacatcctaatcgaaaaattcgcgtttgtggagctggcgagaccgtgagggcgaggctgcgcttgcgcgcgagcgagcggcggccgaggggctgtgcggcggcgggcagccggctggggcactcgcgtaggcgcacgtagtactcgcgcagcggctcaggcgcggacggggcttgctttggcggtgctgctggcgtgctgctgctaggcgctcggcgccggcggctcgtcgcctcagcggtgcgctggtgctggcgtgctgctgctaggcgctagcaggggcgcgagggtgctgtgttgctgctcggcgcttagagattgaagtgactcaggtgaggaacggaggattaagttgctcctttgttgtcgacagattaattcagcacggcgctgcagaagggagcaaacaaagggagatgaagctcagagtcgtgtgcaggaagctgtatgactatgtgcggtatgacctcaaggagatagccttcccgtcgtcactgccggaccctcctcacatcaagaagcggcccaagctctcatggcatgaacgctggtgcatcctcaaggaggccacccggctgtacggcgcgtcatgggtccgggacatcggccc

SEQ ID NO: 45831 - protein, 64 aa, Zea mays
  misc_feature: Ceres CLONE 1450308-F
MKLRVVCRKLYDYVRYDLKEIAFPSSLPDPPHIKKRPKLSWHERWCILKEATRLYGASWVRDIG

SEQ ID NO: 45832 - DNA, 701 bp, Zea mays
  misc_feature: Ceres CLONE 1450312-F
  misc_feature: Encodes the peptide sequence at SEQ ID NO. 45833
  misc_feature (472)..(472): n is a, c, t, g, unknown, or other
  misc_feature (555)..(555): n is a, c, t, g, unknown, or other
  misc_feature (589)..(589): n is a, c, t, g, unknown, or other
cagagctggagctccccgcggtggcggccgctctagaactagtggatcccccgggctgcaggaattcgcacgagaccattacctagaacatcctaatcgaaaatgaatccatcgtccttcattgtacctttcctcttgtctggtttaggtgaccattacgacgtgaaaatgccttgccatttgattctatcaaagctagcagacaagtgcccatccgccgtccttgctgtcctggactccatagttgaaccaatcgagaaaactataagccacaaacccaagggggatgcagtgaagcaggaggttgatcggaacgaggacatgatccgcagcgctctcagggctatatcttctctaagccgcataagcggcagcgactacagcatacggttcaagaatctgatgaacaagataacgaccacccccgcgctcgccgagaagtacaactcggtgcgcggcgaatgagacctgngttcttgtacatggtagaggaataggttaaagacccagagttgtcgcgcgctcgtcaatcctgttgccgcttccccgcatggntgctgaggcaaaagtctgtactctgatgatgacngtggttggtttttgactgctggacataggtgttctgtacaaaatcctgttgtaaaatcagtagaattgccgctgatacatttacctggtggttcctcttgtcgcagttcagt

SEQ ID NO: 45833 - protein, 120 aa, Zea mays
  misc_feature: Ceres CLONE 1450312-F
  misc_feature (1)..(107): Pfam Name: TIP120 Pfam Description: TATA-binding protein interacting (TIP20)
MNPSSFIVPFLLSGLGDHYDVKMPCHLILSKLADKCPSAVLAVLDSIVEPIEKTISHKPKGDAVKQEVDRNEDMIRSALRAISSLSRISGSDYSIRFKNLMNKITTTPALAEKYNSVRGE

SEQ ID NO: 45834 - DNA, 690 bp, Zea mays
  misc_feature: Ceres CLONE 1450319-F
  misc_feature: Encodes the peptide sequence at SEQ ID NO. 45835
cagagctggagctccccgcggtggcggccgctctagaactagtggatcccccgggctgcaggaattcgcacgagaccattacctagaacatcctaatcgaaaaaaatttaaattttacaaaggagtcgagaagaagaagaagaagcatatgagaaagcgtcaagtggtgttgaggagagcctcgccggaggaaccttctagaagctcgtcgacggcttcgtctctgacggtgagagggttgagatacggcgagtgtcagaagaaccatgccgcggcggtcggcggatacgccgtcgatggctgccgtgagttcatggcaagcaacggagaggaaggttcggtggcagcgctaacgtgcgccgcctgtggctgccaccgcagtttccatcgtagagaaatcgaaaccgaggttgtttgcgactgtaattcacctccttcgactggaaactagaccagtaaaaactagacctagtgtcaagggtttgtgtctcgttgagaagtaaagcagaaaatttcagagatgtatagattggaggttgtggaagatctataataactggatgctttaagcatgtctcagaaaagatctatgaaatatgaagcttataagtttcaagaaaaaagaagattattgttgtttttatgtaatgttttataaagtttgattttctgtttctggtcaaattaatg

SEQ ID NO: 45835 - protein, 100 aa, Zea mays
  misc_feature: Ceres CLONE 1450319-F
  misc_feature (28)..(88): Pfam Name: ZF-HD_dimer Pfam Description: ZF-HD protein dimerisation region
MRKRQVVLRRASPEEPSRSSSTASSLTVRGLRYGECQKNHAAAVGGYAVDGCREFMASNGEEGSVAALTCAACGCHRSFHRREIETEVVCDCNSPPSTGN

SEQ ID NO: 45836 - DNA, 682 bp, Zea mays
  misc_feature: Ceres CLONE 1450321-F
  misc_feature: Encodes the peptide sequence at SEQ ID NO. 45837
ggagctccccgcggtggcggccgctctagaactagtggatcccccgggctgcaggaattcgcacgagaccatacctagaacatcctaatcgaaaaataatcctcccaatctcgcgctcccctgtgctccgcggcctccacatttcacgcagccctgcgccgtgttcgttcgcgaggttggggccgatgatggcggcggcggggcggcctccgatttctgcgcggcgtccacatgcggccggctatgttctgcctccggaaatctcggtcgcgatcgatagcctctccatcccgcggccgccacctgatctcgcgtcgcgcgtccccaccgtgcccgccgcacacgccgcgatgagatcctggatccccctgcgacatcctcctccaccgcgccatggccgcccccgacgtcctcgcgtgccgctccccgaggtggcgggcatggtgcgcgcagctatcgcgggggtcacgacggcgacgcgattccaggagctggtagactggatggaggagcggaaggcggcattcagggacgacggcaagtggacagagacggtgaatctggggctcaggagccccgcgctcatcatgttcgggctgcttcagttcgccatcgacagggacctcgggttctggaagaccagcctcgtgctgccctgggtgcgccatggccggctggggtc

SEQ ID NO: 45837 - protein, 80 aa, Zea mays
  misc_feature: Ceres CLONE 1450321-F
MVRAAIAGVTTATRFQELVDWMEERKAAFRDDGKWTETVNLGLRSPALIMFGLLQFAIDRDLGFWKTSLVLPWVRHGRLG

SEQ ID NO: 45838 - DNA, 796 bp, Zea mays
  misc_feature: Ceres CLONE 1450325-F
  misc_feature: Encodes the peptide sequence at SEQ ID NO. 45839
  misc_feature (16)..(16): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (41)..(41): n is a, c, t, g, unknown, or other
  misc_feature (42)..(42): n is a, c, t, g, unknown, or other
  misc_feature (441)..(441): n is a, c, t, g, unknown, or other
  misc_feature (499)..(499): n is a, c, t, g, unknown, or other
  misc_feature (564)..(564): n is a, c, t, g, unknown, or other
  misc_feature (573)..(573): n is a, c, t, g, unknown, or other
  misc_feature (611)..(611): n is a, c, t, g, unknown, or other
  misc_feature (625)..(625): n is a, c, t, g, unknown, or other
  misc_feature (635)..(635): n is a, c, t, g, unknown, or other
  misc_feature (695)..(695): n is a, c, t, g, unknown, or other
  misc_feature (698)..(698): n is a, c, t, g, unknown, or other
ggggtgttaggggggncgccccccggcctttccctnnnncnntgttattttaaaatactggaactccccgcggtggcggccgctctattctagtggatccccccggctgcaggaattcgcacgagaccattacctagaacatcctaatcgaaaaaaacagcacaaggcgcctcgagccacttaaacagagcaagccgccgcggcggcgaccgggcgaccgacgccgaggctgcgcgccctgcgccgggatctagaggggaaagggaaggggaccagccggctcgcttggaggctggagatcggctccggcgggcccatggggggacgcctggtgtccatgctccggtgggcgccggacctggttctgcccaaacctggccccgctggtccccgtacggcctgctgactttcgggttggggtttaggaggggtggcccagtnaaagattaacgattccagttgtgtgttcttcccctcggtaacccatggtgggtggaanggagattgtggggggaacaacgcacgccctgttgtaactctcatatttataggtggagcctttantggccgtancaggccccctccgaaagtcatccgcccctgttcgcgcntgtaaagctaaccnctaaccgccngctgggtggggttcgccgacgaataggaggtcgcgtaacccgcctccccccccacgccangancaactgctagtagccgggcggcggccacacccctctgtcatggggctggccccccacccaacagaccctgtcgtgcacacccccactccccgaccccc

SEQ ID NO: 45839 - protein, 29 aa, Zea mays
  misc_feature: Ceres CLONE 1450325-F
MGGRLVSMLRWAPDLVLPKPGPAGPRTAC

SEQ ID NO: 45840 - DNA, 558 bp, Zea mays
  misc_feature: Ceres CLONE 1450327-F
  misc_feature: Encodes the peptide sequence at SEQ ID NO. 45841
  misc_feature (259)..(259): n is a, c, t, g, unknown, or other
tccccgcggtggcggccgctctagaactagtggatcccccgggctgcaggaattcgcacgagaccattacctagaacatcctaatcgaaaactcggtcggtcgaacaatcttcaataacccagtcggcaggcgtgacccgatgctctctcgtcgtcggatcgccgccaccgtctcctccgcgtctacaccgatatggacgaccggcagtatgccggactgaccaggcaggcttgggcgtgctggccttcaactcggggnctcgcattctacaacttcctggggggaccccagcttccgtcgcgttttggggctttccgggggaatccatccccggggtggtctttcccctggccccccggaacctgaacctccaagggccgggggggccccccccgcaagggcagggatatttcgagattcttaaaaaccccggggttgaaccctaaaaaaacccttttcccgcccaattttctccctttagggggggggccccctaaaacccccccccttttgggggccctttttttgggggaacagttgtgggccacccccccccc

SEQ ID NO: 45841 - protein, 57 aa, Zea mays
  misc_feature: Ceres CLONE 1450327-F
MDDRQYAGLTRQAWACWPSTRGLAFYNFLGGPQLPSRFGAFRGNPSPGWSFPWPPGT

SEQ ID NO: 45842 - DNA, 688 bp, Zea mays
  misc_feature: Ceres CLONE 1450328-F
  misc_feature: Pfam Name: ERG4_ERG24 Pfam Description: Ergosterol biosynthesis ERG4/ERG24 family
  misc_feature: SWISSPROT Homolog: EC 1.3.1.21 7-dehydrocholesterol reductase
aagctggagctccccgcggtggcggccgctctagaactagtggatcccccgggctgcaggaattcgcacgagaccattacctagaacatcctaatcgaaaaacttctactgggggacggacctgcaccctcggattgcacaagtactttgatatcaaaatattcaccacctgtcgtttccgtatgatggcctgtgctggtcttgccataacccattgcataaagcattatgaaatgaatgagcaaattgctgattctatgcttgtgaataccgcacttatattaatatatatcactaatccctcttagcgggaatctcgatattaatcgtcactatggacattgctcatgatacagctggtttccatctctgctaccaatgcttgacacgcatgccatccatatatacttcccctgcaatgtaccttgaaaaccaccccttgaaatcggacccccatctaccactctcaattcctctagctggaatgccatgcacacacctacactatgactgtgacctgcctcaccaagaaattcaaccgactaatgggaaatgctccgtctgatacaaccgcccatcaaatattgttgcctcttatccgactacgaatggagaaactaacaccatgcctctcatgacttctagatggtgaggcttgccacgtcacttccactatgtcccatatata

SEQ ID NO: 45843 - DNA, 709 bp, Zea mays
  misc_feature: Ceres CLONE 1450335-F
  misc_feature: Encodes the peptide sequence at SEQ ID NO. 45844
agagctggagctcaccgcggtggcggccgctctagaactagtggatcccccgggctgcaggaattcgcacgagaccattacctagaacatcctaatcgaaaaacgcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgccaggtggaggtccaccacttcgtcgcccggctcaaccaggacgtcctccagtgcgccgtctacgactcccacaagccctcggcccgcctcatcggcgtggagtacatcgtctccgacaccatcttcgagggcctggccccggacgagcagaggctgtggcactcgcacgcgtacgaggtgaaggccgggctgtggaccgacgtcggcgtgccggaggcgctgcagagctcggagatggcgagcctcgctaggacgtacggcaagttctggtgcacctgggaggcggaccgcggcgacgcgctgccccttcgcccgccggcgctcatggtgtcgcccgcagcccccgagccccggcgcctgccct

SEQ ID NO: 45844 - protein, 187 aa, Zea mays
  misc_feature: Ceres CLONE 1450335-F
  misc_feature (23)..(183): Pfam Name: DUF1264 Pfam Description: Protein of unknown function (DUF1264)
MSSSDQNPAATPASSGPAEPSPPGRPTAVSSRVLDMGAQLAQALKPVRQMKQHACSFALYAHDLHRQVEVHHFVARLNQDVLQCAVYDSHKPSARLIGVEYIVSDTIFEGLAPDEQRLWHSHAYEVKAGLWTDVGVPEALQSSEMASLARTYGKFWCTWEADRGDALPLRPPALMVSPAAPEPRRLP

SEQ ID NO: 45845 - DNA, 656 bp, Zea mays
  misc_feature: Ceres CLONE 1450338-F
  misc_feature: Encodes the peptide sequence at SEQ ID NO. 45846
  misc_feature (598)..(598): n is a, c, t, g, unknown, or other
ggagctccccgcggtggcggccgctctagaactagtggatcccccgggctgcaggaattcgcacgagaccattacctagaacatcctaatcgaaaaaggctagtcaacccgctctcgtctcccgggccctcgcctctctctgccgtctgcactgccgcctgccgcgcgcaaggacgcccatggctcgccacggccaagcgctgctcgccgcgctcctcgtgtccgcggtcggcgcagccagcgcgcagccgagctacgatgacggcggccagggccaggtcagcacggccatgatcgcgctcctggtcgccgtcatcgcggtgttcgtgttcatcgcctcattcaccgtctacctccgccactgcaccggctccgcggccacgtcggacgactacgaccgcgccagagccgtgcccaatttcgacgccttcatctcgcggtcgcggaggcagcggcggccgcgcgggctggacgccgaggtggtcgaggctttccccaccatgaagtacgccgaggccaaggcgctccgggtgggcaagggcggcgcgctcgagtgcgcagtgtgcctcagcgagttcgaggacgaagagcggctcangctcttgcccaagtgcagccacgccttccacccggaatgcatcggcgagtggctcgcc

SEQ ID NO: 45846 - protein, 159 aa, Zea mays
  misc_feature: Ceres CLONE 1450338-F
  misc_feature: The sequence is a functional homolog of SEQ ID NO 1132 in the 10/666,642 US patent application
  misc_feature (140)..(140): Xaa is any aa, unknown, or other
MARHGQALLAALLVSAVGAASAQPSYDDGGQGQVSTAMIALLVAVIAVFVFIASFTVYLRHCTGSAATSDDYDRARAVPNFDAFISRSRRQRRPRGLDAEVVEAFPTMKYAEAKALRVGKGGALECAVCLSEFEDEERLXLLPKCSHAFHPECIGEWLA

SEQ ID NO: 45847 - DNA, 762 bp, Zea mays
  misc_feature: Ceres CLONE 1450339-F
  misc_feature: Encodes the peptide sequence at SEQ ID NO. 45848
  misc_feature (419)..(419): n is a, c, t, g, unknown, or other
agaagctggagctccccgcggtggcggccgctctagaactagtggatcccccgggctgcaggaattcgcacgagaccattacctagaacatcctaatcgaaaaagatcgatccatccggcacggcacgcaaccccacccggctatgctcctccctccgtcgccgcctccagtccagacatgacccgcgctgccccatggcgccccgcggccgcaccctcctcccgctcgccgcggccaccgtcctcgtcgcttccaccatcttcctcttcgccgccgccggtgcgcgctggcggcccgccgacaccgacctccccgtcccgccacacgccttccccacggccgtccccgcggccgtgaccgcttctttttactccaacgccgccggccggcaagagctcttttttgggggccccccccnccgctcccgatgacccctcctccgcctcaacatccaactccacctcccgagccaccccggccgctggtgtcgtccgatgggacccccgcgaccgccttcgaggtattcctgtaccgacatgcccgcccgaagtccacttccgccctcctcccgctggccgccccccgttccctgacccccgtctgggccaaacgttcaccgccagcccccccggcctacggggttatccctgggggtttcaccccacagcccaaccttggaagatctgggtacacggttggaaatgcgtttcccttcgtgggcgtccttggaggggattaccgtccgccggtggtggggtttt

SEQ ID NO: 45848 - protein, 78 aa, Zea mays
  misc_feature: Ceres CLONE 1450339-F
  misc_feature (75)..(75): Xaa is any aa, unknown, or other
MAPRGRTLLPLAAATVLVASTIFLFAAAGARWRPADTDLPVPPHAFPTAVPAAVTASFYSNAAGRQELFFGGPPXRSR

SEQ ID NO: 45849 - DNA, 739 bp, Zea mays
  misc_feature: Ceres CLONE 1450346-F
  misc_feature: Encodes the peptide sequence at SEQ ID NO. 45850
  misc_feature (416)..(416): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaaaaaccaaacacacacacacacgcaggcagcagtcaagcggccaacctctgtttcacaccgtacatgcgtgccacgcccacaccgcagcccccgatgtcgtcgcagcgcccgggccgtcaccagcgccgcgcgtcgcagagcgtgttcgtgctcccagagaacctggcctccctcgacgtcgacgcggcggccgacgcgggcgccaaggccggcgggccagaaggcgccggcgccggcgccgagcagcaggcgaggccgcccgcggggcgtcaccaccgccgcgccatgtccgtggccgcggccgtggcctccanggagcttgagctgatcaaggaggacctcggcagctacaactacaaggtcggcgcctganagaaagagaagagaggagccggcacgctgcgtcatgtgaatagagcttgtgggtaaccgtacccagagctggctttgatcgacgattaacgtggctaaatacaggggctcccccttgccctttttgtttgcccccccccgcctggttaaaaggcccaggaggactatggacctttttcccaccaaaaaaaccttttgggaaaaaaaaaaaaaaaaaccttttcgttccccccacctccgggggggggcccgggcccctattccc

SEQ ID NO: 45850 - protein, 92 aa, Zea mays
  misc_feature: Ceres CLONE 1450346-F
  misc_feature (74)..(74): Xaa is any aa, unknown, or other
MSSQRPGRHQRRASQSVFVLPENLASLDVDAAADAGAKAGGPEGAGAGAEQQARPPAGRHHRRAMSVAAAVASXELELIKEDLGSYNYKVGA

SEQ ID NO: 45851 - DNA, 692 bp, Zea mays
  misc_feature: Ceres CLONE 1450348-F
  misc_feature: Encodes the peptide sequence at SEQ ID NO. 45852
  misc_feature (536)..(536): n is a, c, t, g, unknown, or other
  misc_feature (544)..(544): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcccaatcgaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggctacaagatcgaggacgttcgcccagccggaggaatcaagaagttccagactgctgcttattccaactgcgtccgccagccatcctgatatcgcctcacatgcaattcgcggtagagtaggattttaattcagttttccctctgtgtcggtagttttccgttggctctggctgccttcctctgnctctgagnatccaactgtcctggccatctctccnttttctctcccatcctctctttctggcacacgtcatccagtggcatgtcttcagagaatcttgggcctctccccggcctccccttatgggtttgaaggctatgaaagggccccaaatccgtt

SEQ ID NO: 45852 - protein, 51 aa, Zea mays
  misc_feature: Ceres CLONE 1450348-F
  misc_feature (1)..(51): Pfam Name: AdoMetDC_leader Pfam Description: S-adenosyl-l-methionine decarboxylase leader peptide
MESKGGKKSSSSSSNFMYEAPLGYKIEDVRPAGGIKKFQTAAYSNCVRQPS

SEQ ID NO: 45853 - DNA, 686 bp, Zea mays
  misc_feature: Ceres CLONE 1450352-F
ctggagctccccgcggtggcggccgctctagaactagtggatcccccgggctgcaggaattcgcacgagaccattatctagaacatcctaatcgaaaaccctgatcgcaccatgccagtgtttcggtgcatgctgaggcgcttgtggaactgtggaatcgtctagcttttttcttctttgtcttggtgccctggagtactgttaacgtagaggagggcggcgatggataaaatgctgctcccatcactaacccgggtgctggtggaaaacctggggcctccctaaattacactgccagccgtatcctcctcccggacacatccaagcatcttgattgctgctaatgtggtcggctggttgccctgctgagcaccaccatgtctgcagtctgatcccttttgctctgaaggaacgcgacaactgttcttctgccctattatggtggatctgaattccatcttgcagctgatagagactacctcctcttcctacaagatgacattttgcgcacacttgctgactgtttcagatcgatacctaacagatggtgagatacgtatgatttagagctgggaacctctccataaaaaactgcgccctgtcgtgatgtcatacatttgcggtgaagcatcttatcttgacgatcagacgtgttacttttttgagatgctactgagacaactctc

SEQ ID NO: 45854 - DNA, 666 bp, Zea mays
  misc_feature: Ceres CLONE 1450356-F
  misc_feature: Encodes the peptide sequence at SEQ ID NO. 45855
ggagctccccgcggtggcggccgctctagaactagtggatcccccgggctgcaggaattcgcacgagaccattacctagaacatcctaatcgaaaaccgccgtaaggtcgctgctccgctcgtcggcctcccttcttcgcgccgcccccgccctcgcgagatcctcggctaccacgcgtccgtctcttcggcgcgcattggctgctcctcctcgccttctccggtcgcccgtcgagtcgagcttctgcgtggagtcgcttctgcctctgcacaccgccaccgccggtgcacgcatgacgtccatgctcgccgctcctggccaaggcctcggctggctcacccaaggatctgatgaaactagatgaagagcagccggggaaagctgaaactgacggagtataacgccccctgtgggtgctcccctttaggaaccaggacatcaattgtgcttcgagttcttctgtgcctggaggaaacaggaagagttgattggaaaaagaaaaaatgggatgtgtttttctttttgttcatgtgaactgagatacgacttaataaactagatcttcgaatgatgctctgacccccccccccccctttttttaatgttttttcattgactaaaacggttatgtaatgataactatgtgacacttgttttgtttggtg

SEQ ID NO: 45855 - protein, 57 aa, Zea mays
  misc_feature: Ceres CLONE 1450356-F
MKSSRGKLKLTEYNAPCGCSPLGTRTSIVLRVLLCLEETGRVDWKKKKWDVFFFLFM

SEQ ID NO: 45856 - DNA, 662 bp, Zea mays
  misc_feature: Ceres CLONE 1450361-F
  misc_feature (205)..(205): n is a, c, t, g, unknown, or other
  misc_feature (206)..(206): n is a, c, t, g, unknown, or other
  misc_feature (366)..(366): n is a, c, t, g, unknown, or other
  misc_feature (577)..(577): n is a, c, t, g, unknown, or other
  misc_feature (581)..(581): n is a, c, t, g, unknown, or other
ggagctccccgcggtggcggccgctctagaactagtggatcccccgggctgcaggaattcgcacgagaccattacctagaacatcctaatcgaaaaagtctcagatccgcgtcgtcgcggcccctcccccctctcccgtgcgctgcgcccccaattcccgctccccacgcacccagacacgccgagcgggagaggaagcgacagnnccagcagccgaggcggccagcgccagcgcaggcatgaccactcccactcccagtggcgacggctcgcccccgggctcctccgacctcgtgcccccttcctaccccgagatgatcgtcgcccgcgatcgcagcccctcgcccgaaggagaacggctccagncaggcccgcatcgcgcgccgcatcgaggcgcaggcccgcggcgacctgcccggcctcgcacccgggggtttgttgcccccccacctctggggcatgtccgccgaagggagactccccccccttcccgggggggaaggtacccctttgcccccccccgccgggggaacccggggccccggaatcccccggttgaaccacggggaaaaagaanaacnaacaacaaaaaatgggcccaaaaaaaggagaaaaaaaaaaaaaaagggcccgagaacccctttgcttggcccgggtctgtt

SEQ ID NO: 45857 - DNA, 657 bp, Zea mays
  misc_feature: Ceres CLONE 1450365-F
  misc_feature: Encodes the peptide sequence at SEQ ID NO. 45858
ggagctccccgcggtggcggccgctctagaactagtggatcccccgggctgcaggaattcgcacgagaccattacctagaacatcctaatcgaaaaatatgcggatccaccattcacctatcgccctcccgctcggctcggcgaacgcgatctgttccccaacctccgcagccgcttcaccgccctccactccggctgccgaatcgacccgccccgatccagatcaggagctgagggatggacgcgaacaggcgccagagtgggatccagcagttgctggctgcggagcaggaggctcagcaaattgtgaatgcggctagagctgccaagtcagcgaggcttaggcaagcaaaagaggaggctgagcgggaaatagctgaataccgtgcccagatggagtctgagtttcagaggaaggttgcagagagcagcggcgactccggtgcaaacgtcaagcgtctcgaggaagaaacggcggcgaagattgaacaactcacccagcaggccgcaagcatctccccggatgtcattcagatgcttctgcggcatgtcaccaccgtcaagaactgaggagtgctgttcccgaactatgctcgcagacttgtaccgtcgatctatttatttttgtcaagagtgagagtggtgaggaataatatg

SEQ ID NO: 45858 - protein, 110 aa, Zea mays; identical to SEQ ID NO: 17811
  misc_feature: Ceres CLONE 1450365-F
  misc_feature (5)..(109): Pfam Name: V-ATPase_G Pfam Description: Vacuolar (H+)-ATPase G subunit
  misc_feature: SWISSPROT Homolog: EC 3.6.3.14 H(+)-transporting two-sector ATPase

SEQ ID NO: 45859 - DNA, 646 bp, Zea mays
  misc_feature: Ceres CLONE 1450367-F
  misc_feature: Encodes the peptide sequence at SEQ ID NO. 45860
acccgcggtggcggccgctctagaactagtggatcccccgggctgcaggaattcgcacgagaccattacctagaacatcctaatcgaaaaatctcttaaaaggtaaaaagggggtcggtcgccttacctcgccttacctcgttaacaactatgcacctgcctccgcatcccccctctccccgccgctgctggtgccggtttccatgaactaacatccccttttttcgtgtggcacgttcaagcttaccttgcagtttacagaagattacccaaacaagccaccaactgttcgatttgtctctaggatgtttcatccaaatatatatgctgatggaagcatctgtttggatatcctacagaaccagtggagtcctatatatgatgttgctgcaattttaacttctatccagtccctgctgtgtgatccaaacccaaactcccctgcaaactcagaagcagcaagactgttcagcgagaacaagcgggagtacaaccgcaaagtccgtgagatcgtggagcagagctggacagccgactagtgcataaggatgctcgccgtgcccgataggggcacaataagaaagcgtgaaaaaaaaacacacccactccttgtgtttctggttcgccaggcttgtcgaaacattga

SEQ ID NO: 45860 - protein, 77 aa, Zea mays
  misc_feature: Ceres CLONE 1450367-F
  misc_feature (1)..(70): Pfam Name: UQ_con Pfam Description: Ubiquitin-conjugating enzyme
  misc_feature: SWISSPROT Homolog: EC 6.3.2.19 Ubiquitin--protein ligase
MFHPNIYADGSICLDILQNQWSPIYDVAAILTSIQSLLCDPNPNSPANSEAARLFSENKREYNRKVREIVEQSWTAD

SEQ ID NO: 45861 - DNA, 670 bp, Zea mays
  misc_feature: Ceres CLONE 1450376-F
ccccgcggtggcggccgctctagaactagtggatcccccgggctgcaggaattcgcacgagaccattacctagaacatcctaatcgaaaaattttgttaactctggcccctcacctgctccccttctgtccagcccacgggagggcgactagggttaggggcgaccggaggtccccgcgcctgcccaaatccacccatcccttccgttcaagccgccggagctcccaggccgctggtgtcgaagccgtcgccccttccttccaggcccgcctcctctctgtccgttctgtcttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctaccaaacagggccagacgtctctcaaatccccagttcagtaactggctaactgttagaaaaagaaaaagaaatgaaaaacggcggccctaaagcgacgtcccaaacattcgaacgaacttgccctggaacccttctgaggaaggaggaaagcaaattccctgcctggggccccaaacccgaaaattggccccccgccccaaggggcctaacccccaagggttcccattt

SEQ ID NO: 45862 - DNA, 758 bp, Zea mays
  misc_feature: Ceres CLONE 1450377-F
  misc_feature: Encodes the peptide sequence at SEQ ID NO. 45863
  misc_feature (421)..(421): n is a, c, t, g, unknown, or other
aagctggagctccccgcggtggcggccgctctagaactagtggatcccccgggctgcaggaattcgcacgagaccattacctagaacatcctaatcgaaaagtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcggcgtcggcgcaggagatggacctgggcgtgccgcccgcgccagcgcccgacacgggcgcggcagcgggggccgcggcgtcggtcctgggcgtggcttgctctgccgtcttcttccaccccgtcgccgggtggcctcgtgcaataaggcccccccgtcnaacttggtggctaactgctgggtccgggggtcaggccgagccctggtccaacgcttttcccccttagttaggagtaaaaaatacccctccctggggctggggtgaaatgggtcccctgcccccccccggggggggggtgggaaccttgggcccttggcttatttttttttggcccaacccgcccttttttccagaatacccttgtttttaggggggtgttttttataatataaaaaagcggtgtgtctctttcttccaaaaaaaaaaaaaaaaagagtttatctacccccccccctcccggggggggggccccgaaccaattttccccatatagggc

SEQ ID NO: 45863 - protein, 93 aa, Zea mays
  misc_feature: Ceres CLONE 1450377-F
  misc_feature (72)..(72): Xaa is any aa, unknown, or other
MASRVAVLLVAVAAVLFAAASAQEMDLGVPPAPAPDTGAAAGAAASVLGVACSAVFFHPVAGWPRAIRPPRXTWWLTAGSGGQAEPWSNAFPP

SEQ ID NO: 45864 - DNA, 659 bp, Zea mays
  misc_feature: Ceres CLONE 1450379-F
  misc_feature: Encodes the peptide sequence at SEQ ID NO. 45865
ctccccgcggtggcggccgctctagaactagtggatcccccgggctgcaggaattcgcacgagaccattacctagaacatcctaatcgaaaatccatttagcagcaccggcggcacggcaccccgcagtcccgggctcccggcgtcccgcacccacgccctacaggcagaccaagcaaatggcgatctcgatctcgcaggaggccttcgactccatggtccgggagaacatggaggacctcggcatggaccccgatgaggccctcgctgacgccgttgaggcgctcaccctccagggcgccgatctctcaggtatcgttaagcgcgtgccgggagaggccaccgcggcggaggtgagcccggtggtgcgggttctggacgaactgaaggcctctctcagcgccagcggcgggtcggagcaggatctcgacggacttgtctctctgctcgatgagttgcgcaatctgtgctgctccggcgagggttcggagaatgcagcgatcgcggtacggaatggcgtcgtggaggcgctcgtcgccctgtgcgcgtccgctcgggtcgagcaggagaggctgcttgcttcggccttgaagagtctgagctccgtactccgtgatgtggcaagcactgaaaagttcagacgaagtgagggacccagaa

SEQ ID NO: 45865 - protein, 160 aa, Zea mays
  misc_feature: Ceres CLONE 1450379-F
MAISISQEAFDSMVRENMEDLGMDPDEALADAVEALTLQGADLSGIVKRVPGEATAAEVSPVVRVLDELKASLSASGGSEQDLDGLVSLLDELRNLCCSGEGSENAAIAVRNGVVEALVALCASARVEQERLLASALKSLSSVLRDVASTEKFRRSEGPR

SEQ ID NO: 45866 - DNA, 682 bp, Zea mays
  misc_feature: Ceres CLONE 1450380-F
  misc_feature: Translation starting site: 372
tggagctccccgcggtggcggccgctctagaactagtggatcccccgggctgcaggaattcgcacgagaccattacctagaacatcctaatcgaaaaacgcgatctgcctgtcccacgaggcgaatcatgagattcggtccggcctccgggggctccgcggctccgactagttcggtccggcgccacggcccgggtcggaggggcgtttcggggagggcgaaccggacgccagcgtttccgtttggttggccgtggaggcgaacctgctgctggagcgctacccggggttcctccgttcactagggctcgacatatctgatgatcgttgagctacttgctctgctccagtaccaaccagcgctcctccgccatgatccaggcggtgatggtgatcaacaccgagggcaagcaccgccttctcaagttctacagtttccagccaccccagaagcatcaggacctcgtcgcgctgtgtcttccaattactctctgctaggcccgagagcgcgagcaattttgtcgatgtggactccatctttggcccgggaacaaaaatggtctacaagcatttggccacactatactttgtgtttggctttgatagctctgacaacgagcttgccatgctcgacctcctacaagtgtttgttgaaacattggacagatgcttcgagaatgtat

SEQ ID NO: 45867 - DNA, 733 bp, Zea mays
  misc_feature: Ceres CLONE 1450393-F
  misc_feature: Encodes the peptide sequence at SEQ ID NO. 45868
  misc_feature (356)..(356): n is a, c, t, g, unknown, or other
cagagctggagctccccgcggtggcggccgctctagaactagtggatcccccgggctgcaggaattcgcacgagaccattacctagaacatcctaatcgaaaagtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgncggcgggggctgccacctcccgaagaatacgatggactccgtgaaggacgtgccccccagaatggggaagaagttggccaagccgcccgcaaggaccaaaaccatcaccgggaaattcctggcacccttggaaaccgggaccaagctttcttgaggccgccatggaccagggattctcagggctccccaaaatctttgcaaaaggggggaattaacaaaattttcccatcaaacttttgggggccccccctggggaaaaatctcaaagaacccatggcgtggttttttggcacccccccgggggccccgttaggggggggtcttccccccgccaaaagaaaaaagcggttttttggggagaaacaccccccttccac

SEQ ID NO: 45868 - protein, 40 aa, Zea mays
  misc_feature: Ceres CLONE 1450393-F
MDSVKDVPPRMGKKLAKPPARTKTITGKFLAPLETGTKLS

SEQ ID NO: 45869 - DNA, 691 bp, Zea mays
  misc_feature: Ceres CLONE 1450395-F
  misc_feature: Encodes the peptide sequence at SEQ ID NO. 45870
aagctggagctccccgcggtggcggccgctctagaactagtggatcccccgggctgcaggaattcccacgagaccattacctataacatcctattcaaaaagactctgctgagtgtgcatccttcttctttgaccttcccagccgtgcctcttccccccctctcccggtcgcctctaaggacgatggtgactcacgaacaactccatcgacagcggcgaaactggtgccaacttctggagggtttgacttgatggatacagcggcgggtcttccaatccccgggtgctctctgccactctgtcttgcggagcccccaccgcggaaaaccggttggtgcgcgtggccatggccgtgagcgaaggacaaatcggacgccctctccgtcagacacaagtgcctggaacatcttggccgccagtctgggaagcccacctcaacactgtcaaggctgacaacacgggaagcaagaatgagatttacacctcaagggtgcactacttgatccataagggcacgccctacttgattgtccccgatatcgacatgcacaacattaacattattatcgatgagcgggggtctcttgcagggatcagtccgatacgtggccgagttgcgagcttattgaagccatctaatacccctcctcgtgttgctatgactggtgatgtactgcggctgttacactcc

SEQ ID NO: 45870 - protein, 115 aa, Zea mays
  misc_feature: Ceres CLONE 1450395-F
MAVSEGQIGRPLRQTQVPGTSWPPVWEAHLNTVKADNTGSKNEIYTSRVHYLIHKGTPYLIVPDIDMHNINIIIDERGSLAGISPIRGRVASLLKPSNTPPRVAMTGDVLRLLHS

SEQ ID NO: 45871 - DNA, 649 bp, Zea mays
  misc_feature: Ceres CLONE 1450414-F
  misc_feature: Encodes the peptide sequence at SEQ ID NO. 45872
ggagctccccgcggtggcggccgctctagaactagtggatcccccgggctgcaggaattcgcacgagaccattacctagaacatcataatcgaaaaaatgccatgcgcgcgctactgcatctgcggctcatcaatccgtgcagtcccagagcaccccgtcttcccgctactcccgcaagggcgctcgtcgcttccttctccggggcgtggcaggcaccttctggtagagcgagagcgagagcagcgccgccggcagttcgcgctatggcgtcccagcaggtgttccgggctcagcagcagcagcagcagcagttcccggctcagcagcaggagtcccagccggggaaggagcacgcgatggacccccggcccgaggccatcgtccaggactacaaggccgcctacaagctcaacgacaaggtggcgctcgtgaccggcggcgactccggcatcgggcgcgccgtgtgcctgtgcttctcgaaggagggcgcgacggtggccttcaccttcgtgagggggcaggaggagaaggacgcggaggagacgctgcgtgcgctgcgcgacatcgggtccgagacgggcgcgcgcgagacgatggccctgcccgccgacctcgggtacgaggccaactgccgcgaggtggtggagc

SEQ ID NO: 45872 - protein, 128 aa, Zea mays
  misc_feature: Ceres CLONE 1450414-F
  misc_feature (49)..(128): SWISSPROT Homolog: EC 1.1.1.100 3-oxoacyl-[acyl-carrier-protein] reductase
  misc_feature (48)..(79): SWISSPROT Homolog: EC 1.3.1.56 Cis-2,3-dihydrobiphenyl-2,3-diol dehydrogenase
MASQQVFRAQQQQQQQFPAQQQESQPGKEHAMDPRPEAIVQDYKAAYKLNDKVALVTGGDSGIGRAVCLCFSKEGATVAFTFVRGQEEKDAEETLRALRDIGSETGARETMALPADLGYEANCREVVE

SEQ ID NO: 45873 - DNA, 649 bp, Zea mays
  misc_feature: Ceres CLONE 1450416-F
  misc_feature: Encodes the peptide sequence at SEQ ID NO. 45874
ctccccgcggtggcggccgctctagaactagtggatcccccgggctgcaggaattcgcacgagaccattacctagaacatcctaatcgaaaatttattgaagacgaagctctattcctaccaacaaaagaagcagagcaccagcagaaggttcatgttagaaatgaggatggaagaagatctagctctacgagtgagaagtcattggaccaagaagatgaagatgatagagaaactaaataccgattagatcccaagtatgccaatgtaaggacacctgagcgccatgtccgcactaggctttacttcacatcggaatctcatatacactcattgatgaatgtccttcgttactgcaatttggacgaaagtctacaaggagaggaaagccttgtctgccagagtgctttggaccgtctacatagaactagggagcttgattacatgagtaatattgtgcttagaatgtttgaaaacatagaggttcctttggaagatgagaagaggttcaggattgaaatgacgttcagtcgtggcgccgatctcagtcccctagaggacaaaaccagtgaaagttcttccttgctccaggagcacaccttgcccataatggggcccgagagactgcaggaagttgggtcctgcctgac

SEQ ID NO: 45874 - protein, 215 aa, Zea mays
  misc_feature: Ceres CLONE 1450416-F
PRGGGRSRTSGSPGLQEFARDHYLEHPNRKFIEDEALFLPTKEAEHQQKVHVRNEDGRRSSSTSEKSLDQEDEDDRETKYRLDPKYANVRTPERHVRTRLYFTSESHIHSLMNVLRYCNLDESLQGEESLVCQSALDRLHRTRELDYMSNIVLRMFENIEVPLEDEKRFRIEMTFSRGADLSPLEDKTSESSSLLQEHTLPIMGPERLQEVGSCL

SEQ ID NO: 45875 - DNA, 656 bp, Zea mays
  misc_feature: Ceres CLONE 1450417-F
  misc_feature: Encodes the peptide sequence at SEQ ID NO. 45876
ggagctccccgcggtggcggccgctctagaactagtggatcccccgggctgcaggaattcgcacgagaccattacctagaacatcctaatcgaaaaaagccggctagggtttcatcttcctttcccctcctctctttcatcgacgaccgctggccaccccctcgatctcttgacccggaggcgaggacgggggccagcagcggccgccagcgcctgcccgtcttgttatagggtgtcattgaagttctggtggaaagtggaagacctattgatgcaattaatttggcttatgtgtttgagcttactgaacaatttgaaccagtacaccttcttaaagcatatctaagggatgttaagaaaatgtcacacgccaggaatgtcaaaacttctcctggagcacagaatgagatgaatgaacgtgagttatctgcgctgaaatctgtcattaagtgcattgaagagcacaaacttgagcagcagtaccctgtggatccacttcagaaaagggttttgcagctagagaaagcaaaggcagacaagaggatggctgttgaagcagcaaagccgcagtccaagaggcctcgtgccaatggatcggcctttgcaacccgtgctacaggctttgctgacaagagcttctactcagcaaccccaga

SEQ ID NO: 45876 - protein, 98 aa, Zea mays
  misc_feature: Ceres CLONE 1450417-F
MSHARNVKTSPGAQNEMNERELSALKSVIKCIEEHKLEQQYPVDPLQKRVLQLEKAKADKRMAVEAAKPQSKRPRANGSAFATRATGFADKSFYSATP

SEQ ID NO: 45877 - DNA, 539 bp, Zea mays
  misc_feature: Ceres CLONE 1450418-F
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
ctccccgcggtggcggccgctctagaactagtggatcccccgggctgcaggaattcgcacgagaccattacctagaacatcctaatcgaaaaatacctttctcggccttttggctaagatcaagtgtagtatctgttcttatcagtttaatatctgatatgtgggccatgtgtccactttgatattaaatttattttttatatggggggagagtctactgccagtggcttgccattggaggctctcaagcgtcgtccagctattgcactgctgggcgggaccaggcgcaccccccaacaaaaaaaaatttagcttttggtggcttggtttccttggttaaactcttctgggctttaatttggccccaactaaaacctttttttttaaaaaaattggtttttaaaaccccccttaaaaaaacccccgggggttttaaggggccccccaaaaaaaggggtcctcccccccgggtaattttaaattaccccccccgcgcccccaccccggnnnnggggggaggaaaaattcctctttataag

SEQ ID NO: 45878 - DNA, 721 bp, Zea mays
  misc_feature: Ceres CLONE 1450428-F
  misc_feature: Encodes the peptide sequence at SEQ ID NO. 45879
aaagctggagctccccgcggtggcggccgctctagaactagtggatcccccgggctgcaggaattcgcacgagaccattacctagaacatcctaatcgaaaaactttccggcctccgcttcccaccccgatcatcctgccgcagtgccgctccttccctccctctacccgtcgccgctgctgccatggacgaagtcgtcagccagattttggagaagcaagtgctgtctgccgcgaaggcggtggaggacaagctcgatgaggagatcgccgcgctcgaccgcctcgatccggacgacatcgaggcgctccgcgagcgccggatccagcagatgcgccgcgccgccgagcgccgcgccaagtggcgtgcgctggggcacggggagtacaccgaggtccccgagaaggagttcttctccatcgccaaggccagcgagcggctcgtctgtcacttctaccgcgacaactggccctgcaaggtcgtggacaagcacctgtcggctctgggcaaacagcacgtggagacacgggtcgtgaaggtccacgccgagaaggcccccttcctgacagagaagtcaggatagtcgtcctcccgacccctcgcatagttaagaaacgccaggtcaaggactacttgttcggctttgacgagctcggcggcaaggacgacttcgcccccaggacctggaaaagcccctggcaaggcccaggtcgtcttcctg

SEQ ID NO: 45879 - protein, 132 aa, Zea mays
  misc_feature: Ceres CLONE 1450428-F
MDEVVSQILEKQVLSAAKAVEDKLDEEIAALDRLDPDDIEALRERRIQQMRRAAERRAKWRALGHGEYTEVPEKEFFSIAKASERLVCHFYRDNWPCKVVDKHLSALGKQHVETRVVKVHAEKAPFLTEKSG

SEQ ID NO: 45880 - DNA, 675 bp, Zea mays
  misc_feature: Ceres CLONE 1450451-F
  misc_feature: Encodes the peptide sequence at SEQ ID NO. 45881
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaagatcctctccgccatttctgtgcgcatctggagctgttgttctaaacccccaaaccctccgtcctaacctctgcgccaccggcgtcaccaccgccggagccgcagccatgaacgccttcaggttcctcggggacatgacccacctcttctcggtcctcgtcctcctcctcaagatctacgccaccaagtcctgctcaggggtgtcgaggaagacgcaggagctgtacatgttggtgttcgtggcgaggtacctggacctcttcacggattatgtctcgctctacaactcggtgatgaaggtggtgttcatcgccccctcggcggcccatctgtggtgcatgcgccgccaccccccaggtacgaagaacctacgacaaggagcaagacaccttcccgtcaaacggtggctcgtcgccgccgcattcctgctcgcgctgaaattccaccaagcgggttcacctttccgcgaagatatgcctgggccatttcaattctattttgaaggcagggggttattttcccccacattaacgggtggcctccaaaaaaaccccaaaatgttgagtaaccttn

SEQ ID NO: 45881 - protein, 155 aa, Zea mays
  misc_feature: Ceres CLONE 1450451-F
  misc_feature (1)..(148): Pfam Name: ER_lumen_recept Pfam Description: ER lumen protein retaining receptor
MNAFRFLGDMTHLFSVLVLLLKIYATKSCSGVSRKTQELYMLVFVARYLDLFTDYVSLYNSVMKVVFIAPSAAHLWCMRRHPPGTKNLRQGARHLPVKRWLVAAAFLLALKFHQAGSPFREDMPGPFQFYFEGRGLFSPTLTGGLQKNPKMLSNL

SEQ ID NO: 45882 - DNA, 692 bp, Zea mays
  misc_feature: Ceres CLONE 1450466-F
  misc_feature: Encodes the peptide sequence at SEQ ID NO. 45883
  misc_feature (379)..(379): n is a, c, t, g, unknown, or other
cagctggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccggcggcaagagcgtcgaggcccaggagcacctcgccgaagggcgcagccgcggaggccagactcgtagggaggagctggntcaacaggcgtacatccacacgcggaagaagggcggtctgagcaccaccgaccactccggcggcgagtgcgccgcccgggagggcgtcagcctcgacgagtccaaggtcaccaaggatccctatcgcgtgcgtgcgcacgccacgttacctgcctggctgcggatgggaaccttcggccgtagccacgggccccctccccaactttggggagtagccggcagggatcactcatggagcctaggaagctatgccatggcccggcgaatcataacatacccttacctcagcattgcagggtgaccccttgctcac

SEQ ID NO: 45883 - protein, 152 aa, Zea mays
  misc_feature: Ceres CLONE 1450466-F
  misc_feature (1)..(92): Pfam Name: LEA_5 Pfam Description: Small hydrophilic plant seed protein
  misc_feature (53)..(53): Xaa is any aa, unknown, or other
MASGQESRKELDRKAREGETVVPGGTGGKSVEAQEHLAEGRSRGGQTRREELXQQAYIHTRKKGGLSTTDHSGGECAAREGVSLDESKVTKDPYRVRAHATLPAWLRMGTFGRSHGPPPQLWGVAGRDHSWSLGSYAMARRIITYPYLSIAG

SEQ ID NO: 45884 - DNA, 751 bp, Zea mays
  misc_feature: Ceres CLONE 1450468-F
  misc_feature: Encodes the peptide sequence at SEQ ID NO. 45885
  misc_feature (351)..(351): n is a, c, t, g, unknown, or other
ctggagctccccgcggtggcggccgctctagaactagtggatcccccgggctgcaggaattcgcacgagaccattacctagaacatcctaatcgaaaaaccgatcacaaaaccaatcgcggagattcaatcacgtacgtatacacacggccacacgggcacgtagctagctagcagtcgtagcgtgacgatgagggttctctctgttgcggtcgctctggtcgtggtggtggccgcggcctgcctcgccgcgccgcggggcgcggacggcgcgggcgagtgcggtgcgacgccgccggacacggtggcgctgaggctggcgccgtgcgcgtccgcggcggaagaaaccggntccgcgcgttccggctcctgcctgagcgcggtgcaccccctccggaaaccaaagcccccaggcccccctgccgccggcttggttgttcaaacccccccatggaacgccggggattcaagggcgaaggttcccattcccctttcccaaaacgttgaaacctcccccaaacccccccgtttggtttaaagggggggaaattaaacttctccccttgagggggggggaaggtcccacagcccgatattgtcgtgtggggcggccccaaatatctccaaaaacgcgattttttttgtggaaaaagaaacccggggtttggacaaaacccctcttggtggtccccaaaaaaaaaaaaacaatgggggggaaacaaaaaagggcacccaccatagagagggggggg

SEQ ID NO: 45885 - protein, 115 aa, Zea mays
  misc_feature: Ceres CLONE 1450468-F
MRVLSVAVALVVVVAAACLAAPRGADGAGECGATPPDTVALRLAPCASAAEETGSARSGSCLSAVHPLRKPKPPGPPAAGLVVQTPPWNAGDSRAKVPIPLSQNVETSPKPPRLV

SEQ ID NO: 45886 - DNA, 651 bp, Zea mays
  misc_feature: Ceres CLONE 1450469-F
  misc_feature: Encodes the peptide sequence at SEQ ID NO. 45887
  misc_feature (616)..(616): n is a, c, t, g, unknown, or other
  misc_feature (651)..(651): n is a, c, t, g, unknown, or other
agctccccgcggtggcggccgctctagaactagtggatcccccgggctgcaggaattcgcacgagaccattacctagaacatcctaatcgaaaaatattttgccctcccctcccgtgccacggcctcgccccttcgtaccgcacccataagctaggttttagccgcagctttctcctttttcgccgcggcggccgcaagctccaaccttctccccgaagaagccccaagcaagcgacactcttgtcctctccgcgccagatcgttgtttatgagctcgaaggagaagcccactcttggaggcacgcggattaagacccgcaagcggaacattgcagctcctttggaccctgcatcattctctgatgcaattgtccagatttatctggataatggtggagatctggaactcgtcgccaaaagtattgagtcttccgacctcaacttctcacgttacggtgacaccttttttgaggtggtttttgttggaggacgcactcagcctggcactgtaaaacctgaagaaggagaccgccacccttattctatgttagattgtgtggcacagcgtgaaacaattttgcctttcgtactctatatccagaaaacattgcgcangaggcctttcttaataaaaaatcttgaaagcttan

SEQ ID NO: 45887 - protein, 127 aa, Zea mays
  misc_feature: Ceres CLONE 1450469-F
  misc_feature (116)..(116): Xaa is any aa, unknown, or other
MSSKEKPTLGGTRIKTRKRNIAAPLDPASFSDAIVQIYLDNGGDLELVAKSIESSDLNFSRYGDTFFEVVFVGGRTQPGTVKPEEGDRHPYSMLDCVAQRETILPFVLYIQKTLRXRPFLIKNLESL

SEQ ID NO: 45888 - DNA, 606 bp, Zea mays
  misc_feature: Ceres CLONE 1450471-F
  misc_feature: Pfam Name: Cupin_3 Pfam Description: Protein of unknown function (DUF861)
  misc_feature (218)..(218): n is a, c, t, g, unknown, or other
  misc_feature (267)..(267): n is a, c, t, g, unknown, or other
  misc_feature (346)..(346): n is a, c, t, g, unknown, or other
gctctagaactagtggatcccccgggctgcaggaattcgcacgagaccattacctagaacatcctaatcgaaaagtgtttgattccgaggcggggatgacgagcccaatggtgggccaccccggtccagttccacacaaccggccgcctcagcttctgctccttttcctttcccagcgcatcagggaggcggcgattcgcggcggtgagggcgtccgncgagacgatggcgacggagagctggggcatcaggtgagcgcacccgccngagtccgtctctcgagctcgcgtccgcagtggccaaagtggggtgcgagaaggcaagttcccgtggacctactccgccnaggagacgtgctacctgctgcaggggaagggtaaggttaccccccaaagccaccggggaggaattcgtgggaaatcgggccgggaaaaccttgtccttcttcccccaagggaatgagcctgcccttgggaaagtcccccaaggcccctcaaaaaaacccttaaaactttcaaaaaacccccccccccccaaaaataaccctgggggggctctcaggaaaaaattgggggggggcccttggacccccgaaaccctttaaag

SEQ ID NO: 45889 - DNA, 792 bp, Zea mays
  misc_feature: Ceres CLONE 1450476-F
  misc_feature: Encodes the peptide sequence at SEQ ID NO. 45890
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (417)..(417): n is a, c, t, g, unknown, or other
  misc_feature (418)..(418): n is a, c, t, g, unknown, or other
gtgtgggcgccacccactcccccggcgggctgcgccgggnnnnnaaannnnnnacaagctggagctccaccgcggtggcggccgctctattactagtggatcccccgggctgcaggaattcgcacgagaccattacctagaacatcctaatcgaaaaaaaaccgtcgtcgcgcccgccccgtgccgcccgccatggcgccgccggagccggagatgttcgacgtcgtcatattcggggcctcgggcttcaccggcaagtacgtcatccgcgaggccctcaagttcctcaacgcctcctcatccgcctccccgctccgctccctcgcggtcgccggccgcagcagggaccgcatcgcagccgcgctccgctgggccgcggccccggccccgccgcccgaggacgtgcccatcctagtnnccaacaactcaaaaaacaacctccctcgggtgggctcggcctctcggggcccgcccccttgcgtctcctgaagcggggccctttccgggctccacggcccacgacccccgccaaccagccctggcgcggggcggcggggcggccgaaactgccctcgcccatcctcccggggaaccccccagctccatggaagcggcgtccgactcccgatcttccaacaatgcccgccgcccaaggagcggggctaccccatggtgtgtcaggccaggccggattcgatcgctggttccgcgcccgcactccggctgtggtggtcgcacggccagcgcaccgcggagaccccccgtttggcctccccccaacctaaagaagcg

SEQ ID NO: 45890 - protein, 98 aa, Zea mays
  misc_feature: Ceres CLONE 1450476-F
  misc_feature (76)..(76): Xaa is any aa, unknown, or other
MAPPEPEMFDVVIFGASGFTGKYVIREALKFLNASSSASPLRSLAVAGRSRDRIAAALRWAAAPAPPPEDVPILVXNNSKNNLPRVGSASRGPPPCVS

SEQ ID NO: 45891 - DNA, 683 bp, Zea mays
  misc_feature: Ceres CLONE 1450488-F
  misc_feature: Encodes the peptide sequence at SEQ ID NO. 45892
  misc_feature (419)..(419): n is a, c, t, g, unknown, or other
  misc_feature (683)..(683): n is a, c, t, g, unknown, or other
ctggagctccccgcggtggcggccgctctagaactagtggatcccccgggctgcaggaattcgcacgagaccattacctagaacatcctaatcgaaaaaccgtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgtttgccgcggcgtcggcgcaggagatggacctgggcgtgccgcccgcgccggcgcccgacacgggcgcggcagcgggggccgcggcgtcagtcctggccgtggcttgctctgccgtcttcttcatcctcgtcgccggtggcctcgtgcagtaggccctcccgtcnacgtggtggctagctgctggttcggggtcaggcggagccctgttcgatccttttccccctagttagtagtaaaaagtagcatcatgggctgtgttgaatggtgtccctgcctccccctgggtgggcgttgtgatccttgggctattgcttaatcttttttgaaccaaactcgcattgttcgaagttataccttggtgtttaaggccgggtgtttgcttgaaataaaagacagaaggaatcccggttcccccaaaaaaaaaaaan

SEQ ID NO: 45892 - protein, 66 aa, Zea mays; identical to SEQ ID NO: 45446
  misc_feature: Ceres CLONE 1450488-F

SEQ ID NO: 45893 - DNA, 626 bp, Zea mays
  misc_feature: Ceres CLONE 1450496-F
  misc_feature: Encodes the peptide sequence at SEQ ID NO. 45894
ggagctccccgcggtggcggccgctctatactagtggatcccccgggctgcaggaattcgcacgagaccattacctagaacatcctaatcgaaaagcgactgtgagcttcgttcgttcagttacatcggtgttcttgtttgcgaggtcaacagacagaggatgtcttgctgcggaggcaactgtgagtgcggctccggctgcaattgcgacaactgctgcggagggagcatcaagatgtacccggacatggatgagcaggtgaccaccaccacccaggctctcatcatgggtgtcgcaccatccgaggggcacgcctagggcggtttcgaggcggccgccggacctgacaatggcgggtgtaactgcggcgccaactgacaatgcgacccctgcaactgcggaaagtgagctaggtgctccaccctgcaggcgcggacgaaggaagctagctaattattataagcgtattagcgtatagcctcgtcactgtgtgtgttgccagtcattcagtcaattagttgcgtgtcatggctggcatgctctgactctgacatgatgatgatgcctgatgggagcgtcttgtcatgtagccctgccttgcccctgagggcgctgctggtggcgg

SEQ ID NO: 45894 - protein, 52 aa, Zea mays
  misc_feature: Ceres CLONE 1450496-F
  misc_feature (1)..(50): Pfam Name: Metallothio_2 Pfam Description: Metallothionein
MSCCGGNCECGSGCNCDNCCGGSIKMYPDMDEQVTTTTQALIMGVAPSEGHA

SEQ ID NO: 45895 - DNA, 704 bp, Zea mays
  misc_feature: Ceres CLONE 1450497-F
  misc_feature: Encodes the peptide sequence at SEQ ID NO. 45896
gctcttgaactagtggatcccccgggctgcaggttttcgcacgagaccattacctagaacatcctaatcgaaaaaagacgcgcgcgcataatcacacctgctcgggctagattaggaggacagcttcttcggccggcgacatggcggaggagaagggcgcgttgcagtcggcgagggagtgggtggtcgaccacaagctccgggccgtcgggacgctgtggctcagcggcatcgccggctccatcgcctacaactggtccaggccgggcatgaagaccagcgtcaagatcatccactccaggctgcatgctcaggctctcacgctggctgccttggctgggtgcaccctggtggagtactactaccaccagcaagggtcaggcccccaacttcaccagtatgcaaagcagtccctttcatctgatagcaatatcggcccaacataaggagtagctagctaatgtccttgccaactgcacgcagcgtagtgggcgttatttcctgaccaaataattttgcctatggcacattccggtggaacctttgaccggagctattgcctgccttttccaagcccatgtaagctgcctgaaaacctgcactccttccaatgtttgtgtatggcaaatggtaaccaggccttttgtttcccctgaaatgggctttcaaatagaaaccaaatgggtttcttttttttaacaaaa

SEQ ID NO: 45896 - protein, 101 aa, Zea mays
  misc_feature: Ceres CLONE 1450497-F
MAEEKGALQSAREWVVDHKLRAVGTLWLSGIAGSIAYNWSRPGMKTSVKIIHSRLHAQALTLAALAGCTLVEYYYHQQGSGPQLHQYAKQSLSSDSNIGPT

SEQ ID NO: 45897 - DNA, 504 bp, Zea mays
  misc_feature: Ceres CLONE 1450498-F
tggagctccccgcggtggcggccgctctagaactagtggatcccccgggctgcaggaattcgcacgagaccattacctagaacatcctaatcgaaaaatcacatattcacatcgcatcaagcttgatttacttcgatccaagaaagccacctgctaatcacctcacctgagataccaaaccgttcacgaaccgccagccgaagggcctgaagccacagctaagggagcaaagatccatgggggaacctcatacagcggggggtggctcgggcgccgggcccccgggcggaacttggaaatggcccccttccccccggggctttttttcccggcgggggggggggggcccccccttttccctgggcctcgtgtccccggggggaacccccgaaggctttccaaaaattttgtggccccccgcaggaaggagatttttttcccccccccacacaccaaaagggggggggggcggcacccccacccggggggtttgcccccttacag

SEQ ID NO: 45898 - DNA, 639 bp, Zea mays
  misc_feature: Ceres CLONE 1450506-F
  misc_feature: Encodes the peptide sequence at SEQ ID NO. 45899
  misc_feature (486)..(486): n is a, c, t, g, unknown, or other
tggagctccccgcggtggcggccgctctataactagtggatcccccgggctgcaggaattcgcacgagaccattacctagaacatcctaatcgaaaagtagaccggagcaatggaggaagagaaagcggcggcgtactacgacgagctcaatcgcaagggcgagggcgcccgccgcttcaagcaggggcttggcttctcctcctcatccgccactgccttcccttccaagcccaccgcctcctccttcctatccggttttgttcgcgcgggcgcagcccctggccccgccaaacagccgttaccgcattccaggaccccatccagtccgcaccatcgctcaagttcaccgcctctttcgcgtcccaggatccgctccaggtccaggtccaggtccccgtctcgctccagccggcgccaatcgagatcgaggtcccggtcgagggagcgcaggcgccgctcccagtctagggagagggaccgcaggncatcctgtaaacgctctaggtcgcgggggtcaagatcgccttctcccggaacggcagagcctgcccttggaaacccgccgggacggcatgggatcaggggggggggacaaaaaggccattaaaatccaagggtcccaagaaaaggacggggca

SEQ ID NO: 45899 - protein, 165 aa, Zea mays
  misc_feature: Ceres CLONE 1450506-F
  misc_feature (126)..(126): Xaa is any aa, unknown, or other
MEEEKAAAYYDELNRKGEGARRFKQGLGFSSSSATAFPSKPTASSFLSGFVRAGAAPGPAKQPLPHSRTPSSPHHRSSSPPLSRPRIRSRSRSRSPSRSSRRQSRSRSRSRERRRRSQSRERDRRXSCKRSRSRGSRSPSPGTAEPALGNPPGRHGIRGGGQKGH

SEQ ID NO: 45900 - DNA, 712 bp, Zea mays
  misc_feature: Ceres CLONE 1450507-F
  misc_feature: Encodes the peptide sequence at SEQ ID NO. 45901
ctggagctccccgcggtggcggccgctctagaactagtggatcccccgggctgcaggaattcgcacgagaccattacctagaacatcctaatcgaaaaaatctcgttgcccgttgtgctctctctctctattcgttccccgcctcaccccgagccagccgtctcgctagggtttcgccgccgccgccgccgccgccgccgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgcccagtctacctagacatgctgaacgaatgcccgcctggtggtgtgtctgcctaagctgcctctgggggtattcgtggattttcctttcgggaggctatctcataataagataccgggaaacttttgtctcccagctttgaacta

SEQ ID NO: 45901 - protein, 97 aa, Zea mays
  misc_feature: Ceres CLONE 1450507-F
  misc_feature (52)..(93): Pfam Name: CHCH Pfam Description: CHCH domain
MFGGIGSTIAQGMAFGTGSAMAHRAVDAVLGPRTIQHETVASEAAAAAPAPPVMNADACSIHSKAFQDCLNNYGSEISKCPVYLDMLNECPPGGVSA

SEQ ID NO: 45902 - DNA, 659 bp, Zea mays
  misc_feature: Ceres CLONE 1450511-F
  misc_feature: Encodes the peptide sequence at SEQ ID NO. 45903
ggagctccccgcggtggcggccgctctagaactagtggatcccccgggctgcaggaattcgcacgagaccattacctagaacatcctaatcgaaaaaccactcatcaccaccagctgccattgccatctactgacctgtgacctccgcatttccaaacagcccgacgacgagcgagctagcagagcggcaggcacctccctcctcaaggaacatggcccgcatgcagcagttggcagtggcgacggcggccgtggtggccttggtgctgctggcggcggcgacgtcggaggcggccatcagctgcgggcaggtggcgtcggccatcgcgccctgcatctcctacgcgcgcggccagggctcggggccctccgccggctgctgcagcggcgtcaggagcctcaacaacgccgcccgcaccaccgccgaccgccgcgccgcctgcaactgcctcaagaacgccgccgccggcgtcagcggcctcaacgccggtaacgccgccagcatcccctccaagtgcggcgtcagcatcccctacaccatcagcacctccaccgactgctccagggtgaactgaaccctaaacgacgacgacggcgccggcggccgcctgaagacgatccatatctatcccgccgtcgacgtcggcgcccgcggatcg

SEQ ID NO: 45903 - protein, 120 aa, Zea mays
  misc_feature: Ceres CLONE 1450511-F
  misc_feature (31)..(116): Pfam Name: Tryp_alpha_amyl Pfam Description: Protease inhibitor/seed storage/LTP family
MARMQQLAVATAAVVALVLLAAATSEAAISCGQVASAIAPCISYARGQGSGPSAGCCSGVRSLNNAARTTADRRAACNCLKNAAAGVSGLNAGNAASIPSKCGVSIPYTISTSTDCSRVN

SEQ ID NO: 45904 - DNA, 642 bp, Zea mays
  misc_feature: Ceres CLONE 1450512-F
  misc_feature: Encodes the peptide sequence at SEQ ID NO. 45905
ctccccgcggtggcggccgctctagaactagtggatcccccgggctgcaggaattcgcacgagaccattacctagaacatcctaatcgaaaattttctcagtgaatacaagtgggcagtttgttggtgttgctgaaatgacgggggctgtcgattttgagaaaaccctggggtattggcaacaggacaagtggaatggttccttctctgttaagtggcacattgtcaaggacgtgcctaacaacattctcaaacacatcatcctagagaacaacgagaacaagcctgtcacgaacagccgtgacactcaagagatacacctagaacaaggccttcagatgctcaagatattcaaggagcatgtcagcaagacgtccatcctggatgacttcgccttctatgagagtcgccagaagctgatgcaggataagaggtcgaaacagcagcaggtccaaaagcaggtctgggacagtaggacccccatttctgtcactggaagcgagcaacagcaggaagctgctaatgggaagcccaatccgtctgcaccagcaccaaacggtgtccctgcagaggtgaaggcagcgaaggcttctgcagagaacggcaccgccactccagctatttcctacgcggcaaaggtggc

SEQ ID NO: 45905 - protein, 168 aa, Zea mays
  misc_feature: Ceres CLONE 1450512-F
  misc_feature (1)..(75): Pfam Name: YTH Pfam Description: YT521-B-like family
MTGAVDFEKTLGYWQQDKWNGSFSVKWHIVKDVPNNILKHIILENNENKPVTNSRDTQEIHLEQGLQMLKIFKEHVSKTSILDDFAFYESRQKLMQDKRSKQQQVQKQVWDSRTPISVTGSEQQQEAANGKPNPSAPAPNGVPAEVKAAKASAENGTATPAISYAAKV

SEQ ID NO: 45906 - DNA, 506 bp, Zea mays
  misc_feature: Ceres CLONE 1450513-F
  misc_feature (489)..(489): n is a, c, t, g, unknown, or other
ctccccgcggtggcggccgctctagaactagtggatcccccgggctgcaggaattcgcacgagaccattacctagaacatcctaatcgaaaaagtgtcacctgcacattgcagaccgcctcagcgcctcaccaagcgaaactcgttggcggctagggttttgctgcctcccgagccaaaccctagagcacccgcggcccatcccatggcgtgctaggcttctatttgagactgggggggaattaagtactccccgggctggggttttcccccaaggccccccagcgggaaaatgggctttccaaggaaaacccatttctatctcttctttggggaaaaccccccctaaaaaaaaaaaagaacccccttggcccccacccccctcccccaaaaaattttttccccggagaaaaaaaaaaaagggggggggggcccccccccctttttcctcccttccaaaaaaaagcccccccgccgtcccccctccgcnggcccccccgcctatgg

SEQ ID NO: 45907 - DNA, 670 bp, Zea mays
  misc_feature: Ceres CLONE 1450538-F
  misc_feature (670)..(670): n is a, c, t, g, unknown, or other
aagctggagctccccgcggtggcggccgctctatactagtggatcccccgggctgcaggaattcgcacgagaccattacctagaacatcctaatcgaaaaaatcagcaacaatctcgtcctctcatcgcagaacccacagccgcaaagcgaccccagcgaagcgtcccagcccgaaccggaacggcgatggcagcgtgcgaccccggctccatctccaccttcaccgctcgtccagggatgaccccttccgctgaccggccgctcgacttctccaacctcaccgctacggaggctgtggtatcttgcacgagctgatcgccaatactgggatgatcggtgaagtccaactaccttgagagcccggcctgggctccgaggacgccgcaggacgactacccttccgtcgaaggcagagctgtccgtgtggactctgacttagtcaacagccgcctgatgagggcacggatagagcatacgtagtccgttctcgagaccatgtacgagtcatgcatagcatcatgtatccccagctccaagcaaaagatgccggatcgacctcctgcgcgctcgccgtcgatatatctagcgactccaccccgactgatgtgtgacatcgattgtcgaacttcagtcctctgcgggacggccttttgtataccctttcgccan

SEQ ID NO: 45908 - DNA, 623 bp, Zea mays
  misc_feature: Ceres CLONE 1450541-F
  misc_feature (275)..(275): n is a, c, t, g, unknown, or other
  misc_feature (284)..(284): n is a, c, t, g, unknown, or other
  misc_feature (303)..(303): n is a, c, t, g, unknown, or other
  misc_feature (339)..(339): n is a, c, t, g, unknown, or other
  misc_feature (377)..(377): n is a, c, t, g, unknown, or other
  misc_feature (398)..(398): n is a, c, t, g, unknown, or other
  misc_feature (399)..(399): n is a, c, t, g, unknown, or other
ggagctccccgcggtggcggccgctctagaactagtggatcccccgggctgcaggaattcgcacgagaccattacctagaacatcctaatcgaaaagtctcacctgtcatacgcggttacgtccccttcgccccccgtttgggctccagaagcttccccttccgtctccatatcttcttcttggtccgccgtctccactccgcgtttcctggctccctgcgttgcgtcttgggggagagagagaagtgggagacccgcgagaggctgccgtgtanggactaggnaccgtaaagttagcgaccnccaaggaaggaaaaggggatagcccggatcgggccnatcaagcaagactgggaccccgtggttgtgcgggaaanggcacccaccgcgcttgccannaaagatagaaaggcgttaaaccgcgcggccctccgggggggagattctgaccctggaaaagatctacgctggtgatgacaaggggggggtccaggggacatttctctaaatttaggggctccaagaaaaaacagagaaacccgcccctggaccagattccagggggccggaaaaaaaatttcctggcagccaggctccattaaaaatttgaccccggcccccgc

SEQ ID NO: 45909 - DNA, 1074 bp, Zea mays
  misc_feature: Ceres CLONE 1450542-R
  misc_feature (1074)..(1074): n is a, c, t, g, unknown, or other
caattgggtaccgggccccccctcgaagtcgacggtatcgataagcttttttttttttttttttagcccacaacaaatccttttatcataatttggttcctaaaaagaacagtataatgcctgagacaaaccccagcatgaaatgctttacatgcgagagcaacgcaacgtacagagcacatgaccgtccaatataaaacgttgtacaagatcatccgacagaaaaacttattattcagtgtaggacagataaacttattcaaacacacactcacacagtttgcctcatctcgttctgaacaacatgcctcaggtgaacacggtaggcatagatgaagaaaaacagggcctcctgccctcctcatattcggggggggggggaagagaaacgggcttctgcctggattacccccccacaacaaagaccaaaaaccctaggctcgaaaaagggtcagtttaagaccctcgcgattgggggccctttttccagagaagggaaatcatttgggacgtgcaaaggctcccccttttgcggcctttgtgcggtcccctatctctcaaccctaaatatgtatcccaacattattaagaaaccatggttggcgatcccctatcattacacccaaaagtagtgagcgtggttattatacaacgtataggatattgggggagtcaaacacaataactacaacgtgctggctaagagtctattggcggagagcagggcgatgacatctgcaaaaacgccaggaaggagaaagaatggcgagatgggggggtagacgggcgggtcaccaagacaggcgtgactgatttaacacaaaacaaccgtcgcatcaacatacgaagagaagaaatgagcgcttacactgcaaatctgctgggaaaccatattctaaaagatgcctatatatatcttgtactcacacaaatggggctactagataaatttgtgatagaagaactgggaggagggctcggtggagaggggcgagggggaagagatggaggtggataagggagagtatgggtggctggagggtgaagtaaagatggaaggaggagaggagaaan

SEQ ID NO: 45910 - DNA, 710 bp, Zea mays
  misc_feature: Ceres CLONE 1450543-F
  misc_feature: Encodes the peptide sequence at SEQ ID NO. 45911
ctggagctccccgcggtggcggccgctctagaactagtggatcccccgggctgcaggaattcgcacgagaccattacctagaacatcctaatcgaaaaactctactacgctccacgaacacgcacgtccgaacaattccatcctagctagctagcagttctcatcacgccaaccacctacgacgagcatggccgccagagcaagaacccacggccctctcttctccctcctccccctcctcctccaccaccaccacctcctcctcgcggtactcaccgtcggtaatagcagcagcagcagcagccggtgccccggcgtgccgtccatgacggcgcagcaggcgtgcggcgcggtggccgggacgcggcgcatgctggagctctgcctccgcaccctccgcggcggcgcgccgctgccggtgacccggcacgcggcggtggccgtgcgcggcgcgctcgacgcgtacgcggccacggtggccgccgcgacgtcgctgctggacggcggcgcggtgccggccgacggcgagagggccgcgttcggcagctgcatggtgggctacggcagcgcccgcgtcgccatggcgcgcgtcgccgccgacctcgccgccgccggctgcgacggcagcggcgcccgggccgcggagctcgaggcggggtacacggccgggctccgtggcatggatgcgtgcaccgggggcatgctcagct

SEQ ID NO: 45911 - protein, 128 aa, Zea mays
  misc_feature: Ceres CLONE 1450543-F
MTAQQACGAVAGTRRMLELCLRTLRGGAPLPVTRHAAVAVRGALDAYAATVAAATSLLDGGAVPADGERAAFGSCMVGYGSARVAMARVAADLAAAGCDGSGARAAELEAGYTAGLRGMDACTGGMLS

SEQ ID NO: 45912 - DNA, 709 bp, Zea mays
  misc_feature: Ceres CLONE 1450545-F
  misc_feature: Encodes the peptide sequence at SEQ ID NO. 45913
  misc_feature (638)..(638): n is a, c, t, g, unknown, or other
  misc_feature (639)..(639): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
aagctggagctccccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtcccgaagcgcgggaagacgtcgcagatctacgccatccgccaggcccccccccaagggctcgtcgcctactaccaaaagtacgtcaacaaaggcggccaaaaagaaggtcaaggaattcttcaccccgttacaaccgcaccctttttgtgtgccgaccccaaggggcttgaaaccaaaaaaatttcggggtggctgggcgcccccccccaggtttccaaaaatcctaccnnttaaaacccccnnntccccgtaacgtaaannnnnnnnnnccnnnnnnnnnnnnnnnnggggggggggggg

SEQ ID NO: 45913 - protein, 151 aa, Zea mays
  misc_feature: Ceres CLONE 1450545-F
  misc_feature (17)..(149): Pfam Name: Ribosomal_S9 Pfam Description: Ribosomal protein S9/S16
MSTVLQRPTPGTVQCFGRKKTAVAVAYTKPGRGLIKVNGVPIELIRPEMLRLKAFEPILLAGRSRFKDIDMRIRVPKRGKTSQIYAIRQAPPQGLVAYYQKYVNKGGQKEGQGILHPVTTAPFLCADPKGLETKKISGWLGAPPQVSKNPT

SEQ ID NO: 45914 - DNA, 632 bp, Zea mays
  misc_feature: Ceres CLONE 1450552-F
  misc_feature: Encodes the peptide sequence at SEQ ID NO. 45915
  misc_feature (393)..(393): n is a, c, t, g, unknown, or other
  misc_feature (395)..(395): n is a, c, t, g, unknown, or other
  misc_feature (449)..(449): n is a, c, t, g, unknown, or other
  misc_feature (450)..(450): n is a, c, t, g, unknown, or other
  misc_feature (465)..(465): n is a, c, t, g, unknown, or other
  misc_feature (467)..(467): n is a, c, t, g, unknown, or other
  misc_feature (470)..(470): n is a, c, t, g, unknown, or other
  misc_feature (486)..(486): n is a, c, t, g, unknown, or other
  misc_feature (491)..(491): n is a, c, t, g, unknown, or other
  misc_feature (492)..(492): n is a, c, t, g, unknown, or other
  misc_feature (496)..(496): n is a, c, t, g, unknown, or other
  misc_feature (499)..(499): n is a, c, t, g, unknown, or other
  misc_feature (500)..(500): n is a, c, t, g, unknown, or other
  misc_feature (502)..(502): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (518)..(518): n is a, c, t, g, unknown, or other
  misc_feature (523)..(523): n is a, c, t, g, unknown, or other
  misc_feature (524)..(524): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (562)..(562): n is a, c, t, g, unknown, or other
  misc_feature (565)..(565): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (586)..(586): n is a, c, t, g, unknown, or other
  misc_feature (588)..(588): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (602)..(602): n is a, c, t, g, unknown, or other
  misc_feature (603)..(603): n is a, c, t, g, unknown, or other
  misc_feature (632)..(632): n is a, c, t, g, unknown, or other
ggagctccccgcggtggcggccgctctagaactagtggatcccccgggctgcaggaattcgcacgagaccattacctagaacatcctaatcgaaaaagggtttcttcggaggctttatttatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactacctggcctggcaaaggctgaananaggcacatataattatttgcccccctcctctatgttgccaaggttgtttgcaanncggaaggacttgaananggntatcccctccttcctnagganncccnaanngnagtnnnnnngggtttnacatnnggtgtnnntcttcggggtaggnnnnaggttttgttccnggncccnnnnnnccctcnnnattncntcggcctnnnnganngcactgtacaaacagataacactcaaacn

SEQ ID NO: 45915 - protein, 74 aa, Zea mays
  misc_feature: Ceres CLONE 1450552-F
  misc_feature (25)..(75): Pfam Name: HIT Pfam Description: HIT domain
  misc_feature (71)..(71): Xaa is any aa, unknown, or other
MSSEKEAALAAVLDDSPTIFDKIIKKEIPSTVVYEDEKVLAFRDINPQAPTHILIIPKVKDGLPGLAKAEXRHI

SEQ ID NO: 45916 - DNA, 695 bp, Zea mays
  misc_feature: Ceres CLONE 1450562-F
  misc_feature: Encodes the peptide sequence at SEQ ID NO. 45917
  misc_feature (383)..(383): n is a, c, t, g, unknown, or other
  misc_feature (432)..(432): n is a, c, t, g, unknown, or other
  misc_feature (433)..(433): n is a, c, t, g, unknown, or other
  misc_feature (609)..(609): n is a, c, t, g, unknown, or other
ggagctccccgcggtggcggccgctctagaactagtggatcccccgggctgcaggaattcgcacgagaccattacctagaacatcctaatcgaaaaatcccaaagagcacgcagcgcagcactgaagcaccacttcctgcactcactgctagctgctcacaccgtgctagtaacagtccatcaccagtcaccaccaatggctcccaaggttgcgctcttccttgccctcggccttctcttcgctgccgccgcgaatggctgcgaaccctactgtcccggcccagtcgtcccaacgccgccagtcgtgccgacgccgtcgtcgcacagccacggccgctgcccgatcgacgcgctcaaactcaaggtgtgcgccaacgtgctangcctcgtcaaggtcggcctgccccagcacgagcaatgctgcccactgcnntgagggctggtggacctcgatgtcgcactgtgcctctgcaccgccatcaaggcaacgtcctccgcatccacctcataatgccctttagctcaaactcatcctaaaaactgggggaaaatttgccggaaggactccccttgccccacctaatggacctgaaatttggaataaaaccngcctccagggattgtccccctaaaaattcaacccgcaatccgaattggacttgaaccccaccccgggtaacccatttaaaatttaa

SEQ ID NO: 45917 - protein, 78 aa, Zea mays
  misc_feature: Ceres CLONE 1450562-F
  misc_feature (63)..(63): Xaa is any aa, unknown, or other
MAPKVALFLALGLLFAAAANGCEPYCPGPVVPTPPVVPTPSSHSHGRCPIDALKLKVCANVLXLVKVGLPQHEQCCPL

SEQ ID NO: 45918 - DNA, 553 bp, Zea mays
  misc_feature: Ceres CLONE 1450568
  misc_feature: Encodes the peptide sequence at SEQ ID NO. 45919
acggagagcaaaggcagcacactcagctatccagcaaaagagatcgagaggcaggagtcatggccaccgtcagcgccgccgtggtgaccaccatcgttgcccgcgccgcgatcgccaggcccaatgctctagggctgcctgcgttgagggcgaggagcgagagggtgcggtgcagctacgccaaggatgccaagaacgcggccccagtcagcaccaagggcgcaggcgcgtcgctgctcgccgcagcgggcgcggtgaccgcgtcggcggggcccgcgctggcgctcgtggacgagcgcatgtccacggagggcaccgggctgagcctcgggctcagcaacaacctgctggggtggatcctcctgggggtcttcggcctcatctggtccctctacaccatctacacctctgacctcgacgaggacgaggagtccggtggcctctcgctctagatccacctcctctcctgttaatgatctgaatgtaaacatggtggcggtcatcggtgtaaatttagacatggctatttgcatctaaaaaaaaaaaaaaaaaa

SEQ ID NO: 45919 - protein, 130 aa, Zea mays
  misc_feature: Ceres CLONE 1450568
  misc_feature (1)..(130): Pfam Name: PsbW Pfam Description: Photosystem II reaction centre W protein, PsbW
MATVSAAVVTTIVARAAIARPNALGLPALRARSERVRCSYAKDAKNAAPVSTKGAGASLLAAAGAVTASAGPALALVDERMSTEGTGLSLGLSNNLLGWILLGVFGLIWSLYTIYTSDLDEDEESGGLSL

SEQ ID NO: 45920 - DNA, 580 bp, Zea mays
  misc_feature: Ceres CLONE 1450573-F
  misc_feature: Encodes the peptide sequence at SEQ ID NO. 45921
  misc_feature (219)..(219): n is a, c, t, g, unknown, or other
  misc_feature (226)..(226): n is a, c, t, g, unknown, or other
  misc_feature (429)..(429): n is a, c, t, g, unknown, or other
acccgcggtggcggccgctctagaactagtggatcccccgggctgcaggaattcgcacgagaccattacctagaacatcctaatcgaaaaattcttcaatcccgcgcgcgtcggctgtgttagccggtagccctccccccgtccgaggtccgagtccgaccgaaggagagaggcagcagccatggctaagggcgggctgagcaaactccggtgcatggntcagaangagtggcactcgtcgaagcgcatcgtctcccgcggcccgttcgcacgggttcacgcgaggccgttcgcggccactcccggaaagcgcgcggggcgtcctttcaccgggcggaacaacgccaagggcctggacccgtgtacattgcaagtccgccgcccgttctcctctcgcagagatcctgggcaccccctgttctcgaactngtcaacacggcggcgggcccgggttccccgggtacaaccttctcggctgggaaggagtctcttctacaacttctctgatgagtgaggaccccgaccccagccccagtcctctctagagacctcgactactaaacgcgctgaaaacgaattc

SEQ ID NO: 45921 - protein, 110 aa, Zea mays
  misc_feature: Ceres CLONE 1450573-F
  misc_feature (13)..(13): Xaa is any aa, unknown, or other
  misc_feature (15)..(15): Xaa is any aa, unknown, or other
  misc_feature (83)..(83): Xaa is any aa, unknown, or other
MAKGGLSKLRCMXQXEWHSSKRIVSRGPFARVHARPFAATPGKRAGRPFTGRNNAKGLDPCTLQVRRPFSSRRDPGHPLFSNXSTRRRARVPRVQPSRLGRSLFYNFSDE

SEQ ID NO: 45922 - DNA, 674 bp, Zea mays
  misc_feature: Ceres CLONE 1450577-F
  misc_feature: Encodes the peptide sequence at SEQ ID NO. 45923
  misc_feature (563)..(563): n is a, c, t, g, unknown, or other
ggagctcaccgcggtggcggccgctctagaactagtggatcccccgggctgcaggaattcgcacgagaccattacctagaacatcctaatcgaaaatcgcctcactgcacaccactgccctcctccaatctcgtcgcgccggtaaaagcccccacgcgcgcctcccgtccggctcctcccctctccgcgtcccggctccatgggcggcctgtcggtgatcgcgccccccgcgcgggacacggcgtcgccgcagcaccgccgcgcgcgccgggcgttcctcgtctccaactacctcatcctgggttgcgcgtccgggtgcggcttcctcacgctgtcgctccgcctggtcccctccgtggacggcttcctcctcatcctgctccacgcgctcaccgtggccgccgccgtgggccgggtgcgccgtcatcgcggcgcccgacccgccgcgcggccgctgctacaccgcccacatgtccgccacccgccgtcgtgtccatcctgcagggcgccgccgccgtgctcgccttctcccgcacctcggagttcctcgccggcgggctccnggtcgtacgtccgcgaagaggacggcgccgtcatcctccgcatggtcggcggggctcggcgtcgccatctcctgcttccagtgggtcgcgctcgcgctcgccttcgtgctc

SEQ ID NO: 45923 - protein, 158 aa, Zea mays
  misc_feature: Ceres CLONE 1450577-F
  misc_feature (122)..(122): Xaa is any aa, unknown, or other
MGGLSVIAPPARDTASPQHRRARRAFLVSNYLILGCASGCGFLTLSLRLVPSVDGFLLILLHALTVAAAVGRVRRHRGARPAARPLLHRPHVRHPPSCPSCRAPPPCSPSPAPRSSSPAGSXSYVREEDGAVILRMVGGARRRHLLLPVGRARARLRA

SEQ ID NO: 45924 - DNA, 679 bp, Zea mays
  misc_feature: Ceres CLONE 1450586-F
  misc_feature: Encodes the peptide sequence at SEQ ID NO. 45925
  misc_feature (633)..(633): n is a, c, t, g, unknown, or other
  misc_feature (679)..(679): n is a, c, t, g, unknown, or other
ggagctccccgcggtggcggccgctctagaactagtggatcccccgggctgcaggaattcgcacgagaccattacctagaacatcctaatcgaaaaaaaaccggatagaccaacccttatcctcgagcccaaactgcggtagcgaaaacgcgagcgctgcggaacaacgatggcgacgatgtctcttgccgcggcgtcacccctcgcctccattccccgcggcatcgccgctcaggctccttgcgcggcattcctgtccatccgcttaggtggcgcgacggcgacgcggttcgctggactggcggtggcctcgcagccagcggagcgtcgcgccgcggcgatggtcgcgatggcgaagagggagcaggagctggaggagatccgggccatgacgacggaacagatggaagaggaggtggtagacctcaagggggagcttttcctgctccgccttaagcgctcggcgcgccaggagttcaagaacagcgagttcagccgcatgcgcaagaggattgctcgtatgctaaccgtgaaaagagagcgggaaattgaacaaggaatcaataaaagattgtctaggaagcttgataggaaatggaagcagagcattgtggtcagaccaccaccatctcntagggggaacaaagagagtagaaagccgcaaaaagagggcaatgtn

SEQ ID NO: 45925 - protein, 170 aa, Zea mays
  misc_feature: Ceres CLONE 1450586-F
  misc_feature (68)..(125): Pfam Name: Ribosomal_L29 Pfam Description: Ribosomal L29 protein
  misc_feature (155)..(155): Xaa is any aa, unknown, or other
MATMSLAAASPLASIPRGIAAQAPCAAFLSIRLGGATATRFAGLAVASQPAERRAAAMVAMAKREQELEEIRAMTTEQMEEEVVDLKGELFLLRLKRSARQEFKNSEFSRMRKRIARMLTVKREREIEQGINKRLSRKLDRKWKQSIVVRPPPSXRGNKESRKPQKEGNV

SEQ ID NO: 45926 - DNA, 651 bp, Zea mays
  misc_feature: Ceres CLONE 1450589-F
  misc_feature: Encodes the peptide sequence at SEQ ID NO. 45927
  misc_feature (607)..(607): n is a, c, t, g, unknown, or other
ggagctccccgcggtggcggccgctctagaactagtggatcccccgggctgcaggaattcgcacgagaccattacctagaacatcctaatcgaaaaaaaaattcaggtacccacccgtcaccactacggcactaccccttcagccccagatttctccaagcctccgggacgaggcgcatccgtccatgggggccaaggcggcacaccggcgtggggtgctggacctggaggcgcagttcgccttcttccggtcgcagcaccggcaccccgtgaacgcggcggcgcacgtgctgctcacctggcccatcctcttcaccaacctcttgatcctccacttcctgccgctgccgctgcccgtctcccccgcgctggccctcgcgctcgcatacgccgccgcctacctcgctgtcgaccgcagagccggcgcagtcgcggggctgctcttcctcgccgcatgggccgccagccgcgccctcgcggcccgcctcggcttcgctctctcctggaagcttgtcctcgtcacgcagctcttctgctggacctggcagttcctcggccacggcctcttcgagaagaagggccgagtggtagtgatcttcctgaggtngtcttgatggagccgttcctcatcttcctgcagatactgacaaa

SEQ ID NO: 45927 - protein, 142 aa, Zea mays
  misc_feature: Ceres CLONE 1450589-F
  misc_feature (11)..(138): Pfam Name: DUF962 Pfam Description: Protein of unknown function (DUF962)
  misc_feature (141)..(141): Xaa is any aa, unknown, or other
MGAKAAHRRGVLDLEAQFAFFRSQHRHPVNAAAHVLLTWPILFTNLLILHFLPLPLPVSPALALALAYAAAYLAVDRRAGAVAGLLFLAAWAASRALAARLGFALSWKLVLVTQLFCWTWQFLGHGLFEKKGRVVVIFLRXS

SEQ ID NO: 45928 - DNA, 616 bp, Zea mays
  misc_feature: Ceres CLONE 1450593-F
  misc_feature: Encodes the peptide sequence at SEQ ID NO. 45929
  misc_feature (178)..(178): n is a, c, t, g, unknown, or other
  misc_feature (179)..(179): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (194)..(194): n is a, c, t, g, unknown, or other
  misc_feature (196)..(196): n is a, c, t, g, unknown, or other
  misc_feature (322)..(322): n is a, c, t, g, unknown, or other
  misc_feature (323)..(323): n is a, c, t, g, unknown, or other
  misc_feature (334)..(334): n is a, c, t, g, unknown, or other
  misc_feature (335)..(335): n is a, c, t, g, unknown, or other
  misc_feature (422)..(422): n is a, c, t, g, unknown, or other
  misc_feature (423)..(423): n is a, c, t, g, unknown, or other
  misc_feature (447)..(447): n is a, c, t, g, unknown, or other
ggagctccccgcggtggcggccgctctagaactagtggatcccccgggctgcaggaattcgcacgagaccattacctagaacatcctaatcgaaaaacccccactactctctctcgccccaaaaccagatcgccacgacaagggccgagggccccggaggggcgcgtagcaatggcgnngcaggcnnntaccgngngcccaaaggacgattacgattacctcttcaaggtggtcctgatcggcgactccggcgtcggcaagtccaacttgctctcacgcttcacgcgcaacgagttcagcctcgagtccaagtccaccatcnnggcgtcgaagnnttcgccactcggctctctccaggtcgacggcaaggtcgtcaaggcccagatttgggacaccgccgggccaggaacgatacccgtgcnnaatcactagtgctgtatacccaangcgctgttggggccgttgctttgaatatgacgtccctccccactcaaccctttaaaaactttgaccgtttggctaaagggactaaagggccccccccgaacccgaataatgggggttaggccgggtgggaaaaaaatttggactcccccctcttgtgaacatcccaaac

SEQ ID NO: 45929 - protein, 86 aa, Zea mays
  misc_feature: Ceres CLONE 1450593-F
  misc_feature (19)..(83): Pfam Name: Ras Pfam Description: Ras family
  misc_feature (3)..(3): Xaa is any aa, unknown, or other
  misc_feature (6)..(6): Xaa is any aa, unknown, or other
  misc_feature (8)..(8): Xaa is any aa, unknown, or other
  misc_feature (9)..(9): Xaa is any aa, unknown, or other
  misc_feature (51)..(51): Xaa is any aa, unknown, or other
  misc_feature (55)..(55): Xaa is any aa, unknown, or other
  misc_feature (84)..(84): Xaa is any aa, unknown, or other
MAXQAXTXXPKDDYDYLFKVVLIGDSGVGKSNLLSRFTRNEFSLESKSTIXASKXSPLGSLQVDGKVVKAQIWDTAGPGTIPVXNH

SEQ ID NO: 45930 - DNA, 611 bp, Zea mays
  misc_feature: Ceres CLONE 1450596-F
  misc_feature: Encodes the peptide sequence at SEQ ID NO. 45931
gggctgcaggaattcgcacgagaccattacctagaacatcctaatcgaaaaattttcacgccacgcctctctcctctccctctcctcccatctcatcatctcatggccgcctcgcgcgtcggcgacccggcggagtcctcgcgcctgcgcatcggcgacgagatcgcgtggtccgaaatcagcggcgtctacgaccgcgacgactcgctcaaggagaacaccaaccccaagtgcctcctcaagaaccaccccggcggaggcggccaggccaacggctcctcgcaacggttctctggcaacctcaagccgacggcggcgcccatcatcggcctctccggcaagctcggccagggcggcgcgcggcggcaccacccgcctgccatcttccccaagaaggccaagaccggcggcggcgggcgcgcgcccagggccgccgtcccggagcccagctcgcctaaggtgtcctgcatcggcaaggtgctctcggaccgcgagcgtgggcgtctgggccgcccgccgcggcctcgcggcgccgcgggcgggtgctgcggaggcctagcgttcttgatgcggcggagcaggtccaggaacagcgtcgagtgcgtcgacca

SEQ ID NO: 45931 - protein, 169 aa, Zea mays
  misc_feature: Ceres CLONE 1450596-F
MAASRVGDPAESSRLRIGDEIAWSEISGVYDRDDSLKENTNPKCLLKNHPGGGGQANGSSQRFSGNLKPTAAPIIGLSGKLGQGGARRHHPPAIFPKKAKTGGGGRAPRAAVPEPSSPKVSCIGKVLSDRERGRLGRPPRPRGAAGGCCGGLAFLMRRSRSRNSVECVD

SEQ ID NO: 45932 - DNA, 615 bp, Zea mays
  misc_feature: Ceres CLONE 1450601-F
  misc_feature: Encodes the peptide sequence at SEQ ID NO. 45933
tggagctccccgcggtggcggccgctctagaactagtggatcccccgggctgcaggaattcgcacgagaccattacctagaacatcctaatcgaaaaatgagaggctggaagcaacggtgccgccggagatggagacggaaaaggaggcggcagcggcgaggcaggcgaaggagtccctggagctggcgttccagatgtcccagatcctcgaaaccggcctcgaccgccacaccctgtcgctgctcatggcgctctgcgaccgcggcgccaaccccgaggccctggccgccctcgtccgcgaactctcctccactgctcccccaaccgccgccgaggctccctcccccgtgagcaacgccgccgcggggccggccccggcaacagcgtccatgttctcctccggccttcgccgtccctagggtttgtgatgtcccttttttcgccggtgagactgcttgccagttagtcgactagatcccgcagtatgcactcagccgctgtgagtgcctgaatgtagtatgttcttatgttttgactaaatttgtgcctcacaagaagataatggttcaaccaaaaaaaaaaaaaaaaaagcttatcgataccgtcgacctcgg

SEQ ID NO: 45933 - protein, 96 aa, Zea mays
  misc_feature: Ceres CLONE 1450601-F
METEKEAAAARQAKESLELAFQMSQILETGLDRHTLSLLMALCDRGANPEALAALVRELSSTAPPTAAEAPSPVSNAAAGPAPATASMFSSGLRRP

SEQ ID NO: 45934 - DNA, 685 bp, Zea mays
  misc_feature: Ceres CLONE 1450605-F
  misc_feature: Encodes the peptide sequence at SEQ ID NO. 45935
aaagctggagctccccgcggtggcggccgctctagaactagtggatcccccgggctgcaggaattcgcacgagaccatacctagaacatcctaatcgaaaaaaggaaggaaccagtggaagtgggatctggatctctcctctctcgtctgcaccgcgagtccgcgactccgcaccaagcaaatcccctgcccccaaaatattgctagggattcgaggggaggaaaatccaggcgcccaggcctggcaatccgttcgtcggagaggccatgagctcggcgcaggatccgttctacatcgtccgggaggagatccaggagtcgattgataaattgcaaagtaacttccaccgctgggagcaaactgcttcaaacacaggagaatatgttcatctgacaaaggagcttctgaccagctgtgaaagcatcgagtggcaggtagatgagctggaaaagacatctcagttgcatcaagggatccatcatactatggacttgatgaagttgaactttccagaacaagaaactgggactggttcttgctcataagccaggtgggacacgttaaaaaaagctattgaaaaaggcaaaaaacaatggtacccacttccaaaaccccgggataccagcggggacccacccctttttcctgccccaaaaaaaggaaagaccttttttcctttccaaa

SEQ ID NO: 45935 - protein, 92 aa, Zea mays
  misc_feature: Ceres CLONE 1450605-F
  misc_feature (6)..(78): Pfam Name: Syntaxin-6_N Pfam Description: Syntaxin 6, N-terminal
MSSAQDPFYIVREEIQESIDKLQSNFHRWEQTASNTGEYVHLTKELLTSCESIEWQVDELEKTSQLHQGIHHTMDLMKLNFPEQETGTGSCS

SEQ ID NO: 45936 - DNA, 643 bp, Zea mays
  misc_feature: Ceres CLONE 1450608-F
  misc_feature: Translation starting site: 360
  misc_feature: Pfam Name: MAPEG Pfam Description: MAPEG family
agtggatcccccgggctgcaggaattcgcacgagaccattacctagaacatcctaatcgaaaaacagtccagaccataccctgtagccaagaactcccgttctccatttccagccataggcggtgtctatcgaactcaccaaggatcaccgctacgacggagcaggggctggggggcaatctcgacctcaaccattggatggacttccaagactccgaggccctctgacactacaaggtgttctacctcaccctgtacaccttctagtctcacaacaaggactccaagctcttcaactgcgctgcacagggggcaccaaaactctctagagtggatgcacgttttcgtcaccatactgcatgctggtcggtatgcagcaccagaccatctcgtgcggtatgatcggcatctactccgccgcgaggttcttccacctcaagagatacgccaccggtggtccgcacaaccgtactcagattagtgcgctcaactacttcgtgctgcttgaccggaacatttgcacagcaacttgcggtatcagactgctcatcaggtatatgctcggaactttgggattatatgagagctgcacgttgggctgaccgcccagctacgtcttgatctgagcatttgaaccttgtga

SEQ ID NO: 45937 - DNA, 702 bp, Zea mays
  misc_feature: Ceres CLONE 1450610-F
  misc_feature: Encodes the peptide sequence at SEQ ID NO. 45938
aaagctggagctccccgcggtggcggccgctctagaactagtggatcccccgggctgcaggaattcgcacgagaccattacctagaacatcctaatcgaaaactcgatttctcgcggagcggccctccacctttatcgccgccgcctccgccgccgttgctgtgttccgtctcttcgccgatggcttcggccaagttcggtgctgcccagcaggtggagaaccgaggcgcgctgtccaaaaggtcacgtaacgacgagaatgatgccaggacctcctgcttctggatatgaccggtcacctctattttacggaggaggtggtggcgccccacctccaattccgcttggaactggtagctatggtgctccatatccacaccttgggatgcgatatggctatggtccaccagtaggacctcctggttcatacggtcttttctcttcatatggtccacctgggccaatgagtggtatgggatatggcccaggacctgagctaggccgatatagctatgggtttagaggttctccaatgccggtttctagcccatggtctggtggagcattagctgaaaacactgacaacattgcttcacgaaagcgccgtggaggccctgatggactttctgagggtgactggacctgtcccaaatgcgacaacattaacttttccttcagaagcacttgcaacatgaagaaatg

SEQ ID NO: 45938 - protein, 147 aa, Zea mays
  misc_feature: Ceres CLONE 1450610-F
MMPGPPASGYDRSPLFYGGGGGAPPPIPLGTGSYGAPYPHLGMRYGYGPPVGPPGSYGLFSSYGPPGPMSGMGYGPGPELGRYSYGFRGSPMPVSSPWSGGALAENTDNIASRKRRGGPDGLSEGDWTCPKCDNINFSFRSTCNMKK

SEQ ID NO: 45939 - DNA, 702 bp, Zea mays
  misc_feature: Ceres CLONE 1450640-F
  misc_feature: Encodes the peptide sequence at SEQ ID NO. 45940
  misc_feature (688)..(688): n is a, c, t, g, unknown, or other
aagctggagctccccgcggtggcggccgctctagaactagtggatcccccgggctgcaggaattcgcacgagaccattacctagaacatcctaatcgaaaaatggcggcatacgccggaatcctagttccaccgctccccgtccgcctctcggtctctcaccttagatccgttaccccggcttcctactccctgaaccaccgtcccccccgccccgcggtcgcccgtgcggcttcccgcggcaacggcaacggcgggccaccggtggagggggagaaggagcggcgacgctcgtcgctcccggcgctgtcggagatccggttgggagagcttctgtccccggaccccgccaatgccgtggctgtggtgctcacgggcgcgctcgtatgggctggcgcctcactgctgctgcagctcacgctcatctccgcagcaatcttcgccgccgccgtcaagtactcgtttgtcgccgcgctcctgctaatcgtccttatcgccctgctgtgatcgacccggccaagaaaaaaagctgtaaattcgcacgaagcattccgattgaagatcatgtagatggcaaagcagcggatttcaaatgtttccattatttttgaatggagcagtagaaatatttgcctgccagtgcccagtgcgtatattattattattttttgcacactgagataattggnattccaaagtagtc

SEQ ID NO: 45940 - protein, 134 aa, Zea mays
  misc_feature: Ceres CLONE 1450640-F
MAAYAGILVPPLPVRLSVSHLRSVTPASYSLNHRPPRPAVARAASRGNGNGGPPVEGEKERRRSSLPALSEIRLGELLSPDPANAVAVVLTGALVWAGASLLLQLTLISAAIFAAAVKYSFVAALLLIVLIALL

SEQ ID NO: 45941 - DNA, 745 bp, Zea mays
  misc_feature: Ceres CLONE 1450643-F
  misc_feature: Encodes the peptide sequence at SEQ ID NO. 45942
  misc_feature (74)..(74): n is a, c, t, g, unknown, or other
  misc_feature (75)..(75): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
ccccccccctctctctcttcccccgacctaggaaattctctctacctccccactcatcccattttttccgttgnnttgtctnnnnaaaactggaactccccgcggggggggaggctcatacaaagagagacccccgggctgcaggtatttcccacgagaccattacctagaacatcctaatcgaaaaaacggagaagagaacaagagatagtacttgacactcctgtcctgctcctccactcccacgctcccagccgaggtcgagcgcacgcacacgcgcacaagcaggagctcctgtcccgctagatcccaaacagtctcctgcccgcgcgcgtttgggggggggcgcgaaggaatcaccggatggcgatgttcgcgcggccgctgctggccaccctgctgctgctgccggagttcctgatctctgccgccgcggccgccgacagcaagagcaaccccgctgatgaggtcggggcactgatcaacatcaacggttttccccccaaggcctcttcgggttcagacaaccaaggctcgggatgcatccgcctgcagctactcaaagcatacgaaggccattggtgaccaggtggtaggacaagaaagccgatggaagtcaagccgcagccgaagacgttccgcccccgaatgggggggagcccgaggcccacaaaccactctccaaaaaattcaccgggaaagggctgggtggacacggcccagttctccagactacggaggccct

SEQ ID NO: 45942 - protein, 73 aa, Zea mays
  misc_feature: Ceres CLONE 1450643-F
MAMFARPLLATLLLLPEFLISAAAAADSKSNPADEVGALININGFPPKASSGSDNQGSGCIRLQLLKAYEGHW

SEQ ID NO: 45943 - DNA, 614 bp, Zea mays
  misc_feature: Ceres CLONE 1450651-F
  misc_feature: Encodes the peptide sequence at SEQ ID NO. 45944
  misc_feature (453)..(453): n is a, c, t, g, unknown, or other
  misc_feature (614)..(614): n is a, c, t, g, unknown, or other
gggagctccccgcggtggcggccgctctagttctagtggatcccccgggctgcaggaattcgcacgagaccattacctagaacatcctaatcgaaaaatcggaagtgaagcgcctcgcagtcctcctctcggatctcgcggtggaagtcgccggtccactcgatcagcgagcgagtcggtgccgcgcggcggattccccgacccgagcaaaggaaccggacatgcggccgcggctggtgctcttcggcgactccataaccgagctgtccttcgcgtccggcggatggggggccgcgctcaccgaccgcttcgcccgccaggctgacgtggtgctgcgcgggctcagcggctacaacacgcggtgggcgctcaaggtgctgccgcgggccatggagggcgcggcgggcgcgggcgcgggcgcggacccggcggccgtgacagtcttcttcggcngcaacgacgccctctctggccgaccagttgcaggcgcacccagcacgtggcccggtcaggagtacccaaaggcaacccttccgggccattgggggcctatttttccggggttttggggctttttccttgggattccgaagggctttgggaattggcccccn

SEQ ID NO: 45944 - protein, 131 aa, Zea mays
  misc_feature: Ceres CLONE 1450651-F
  misc_feature (78)..(78): Xaa is any aa, unknown, or other
MRPRLVLFGDSITELSFASGGWGAALTDRFARQADVVLRGLSGYNTRWALKVLPRAMEGAAGAGAGADPAAVTVFFGXNDALSGRPVAGAPSTWPGQEYPKATLPGHWGPIFPGFWGFFLGIPKGFGNWPP

SEQ ID NO: 45945 - DNA, 637 bp, Zea mays
  misc_feature: Ceres CLONE 1450653-F
gcggtggcggccgctctatactagtggatcccccgggctgcaggaattcgcgcgagaccattacctaaaacatcctattcgaaaaatttctatctgtgtgggtcttgttgttccatacccatcacattcggggaggcctccaatccccatatgtcgcggatgcaatgttcactcatgccaggatgtgaggagctcagcgaccgcaaggactgctggctgcatcatgcccggcaacgaggactacgtcacccctttcatggactagcaccccggcggcgaccacgtcctgctggcgtcggtctgccacgactcgcaccgcgaacttctaggacatcgggcacagcgcctcctgccaagtgagtgcatgacgcagtactgcatctccaaggacgagacgcccacctctcccgacaagccgcgcctaggtcgtcctgaaggacgacaccaggtcctccgatatgggcggcaaccagcgctcggccccttggttcttccttcttgaaggttattccccccccgttcctttcttggaggaaccctgggcctttaaggggggggggggacaaaaaaaatttttccgggggctcaaagggggggtgttttaactcttttgtgtacccccccttttttttttccg

SEQ ID NO: 45946 - DNA, 641 bp, Zea mays
  misc_feature: Ceres CLONE 1450658-F
  misc_feature: Encodes the peptide sequence at SEQ ID NO. 45947
tggagctccccgcggtggcggccgctctagaactagtggatcccccgggctgcaggaattcgcacgagaccattacctagaacatcctaatcgaaaaacccacttccgctctgctcacgtgccgtgcccgtgtgcatcggggaaaaaacagcagcaggggccgaatcggagctccgccgccggcagatctgcgccggccggtctgctccgcccagcggacatggaccgcgacggccgcccggggtggctaccgtcgctgggcttcgccttcctcagcttcaactgcgggatggccgtctaccgctcctgggacgacccctacgccgtcgccttcgtcctcgccgcgtacgccgccctcgtcctcctcttccgctgcctccaccttctggagcgccgccgggaccagcgcctcaagctcgccgtctggggcctcttcacgctcctcacactcatgttctcgtacaagatcgccgccgtgatgccgccctgggcccactgctcgtctggggcatggggatccctcccggcgttgggggaatttatacctttttttttcccccccccggaggaacctttacctttttttttttccttggccgcccccccaaaatcaacggggacccggagagcccctctccccc

SEQ ID NO: 45947 - protein, 140 aa, Zea mays
  misc_feature: Ceres CLONE 1450658-F
MDRDGRPGWLPSLGFAFLSFNCGMAVYRSWDDPYAVAFVLAAYAALVLLFRCLHLLERRRDQRLKLAVWGLFTLLTLMFSYKIAAVMPPWAHCSSGAWGSLPALGEFIPFFFPPPEEPLPFFFSLAAPPKSTGTRRAPLP

SEQ ID NO: 45948 - DNA, 622 bp, Zea mays
  misc_feature: Ceres CLONE 1450659-F
  misc_feature: Encodes the peptide sequence at SEQ ID NO. 45949
cgcggtggcggccgctctattctagtggatcccccgggctgcaggaattcgcacgagaccattacctagaacatcctaatcgaaaaacctaccttttcaatccaatcctgccgcattgcataattcgcatcgaagatcgatgtgaatccgtgcaagggagggcggaggaggaggaagaagaggggtcgaggctgaatccgccggtgagaaggggagcaatggcgaggctggcggtggccgcgagggcgttctccgctgcggcctccggcgccggcaccggcggcgtgtccttggtgcagggggcgtcccgggggatcggcctcgagtttgtgcggcagctgctgcggagaagcgatggaggccgcgtcgtcgctacgtgccgcgcgccgggttccgcggccgagctccagaagctcagggaggagcacgcgcctgggcgcctccccgtgctgccgctcgacgtcaccgacgagagcaccatagaggcagctgcggcctcagtcacggagacccacggttctcttgaccttctgatcaactccgccggcatcctctcgatcccgaacctgatacagccagagactacgctaagcaaggttcagaagtcgtccctgatgctggc

SEQ ID NO: 45949 - protein, 134 aa, Zea mays
  misc_feature: Ceres CLONE 1450659-F
  misc_feature: SWISSPROT Homolog: EC 1.1.1.100 3-oxoacyl-[acyl-carrier-protein] reductase
MARLAVAARAFSAAASGAGTGGVSLVQGASRGIGLEFVRQLLRRSDGGRVVATCRAPGSAAELQKLREEHAPGRLPVLPLDVTDESTIEAAAASVTETHGSLDLLINSAGILSIPNLIQPETTLSKVQKSSLML

SEQ ID NO: 45950 - DNA, 648 bp, Zea mays
  misc_feature: Ceres CLONE 1450670-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (132)..(132): n is a, c, t, g, unknown, or other
  misc_feature (298)..(298): n is a, c, t, g, unknown, or other
  misc_feature (299)..(299): n is a, c, t, g, unknown, or other
  misc_feature (302)..(302): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagctgggactcaccncggtggcggccgctctagaacagtggatcccccgggctgcaggattcgcacgagaccattacctagaacatcctaatcgaaaagtcgccccgatttttttctgttccaggtcgcttctctctgttccgcgtgcgatcgagtagatcaaagggagggagagatggcnnagnagtcgtttcagttggagcaccccttcgaaaagaggccagctgaaggctacccgcatcagggaagaaataccctggaccgaatccccggtcatttgttgaaaagggccaaaaaggagatgaactccccccagacctttgccaaaaaaaaaatcccctttggttcctgggccgaaactctcaaaattttgggaaaaatttttgtgtttttttgggggccccccgaaaaacgcggatataaagcgcttaaccccccctaagaagaaagggaaaaattttcttctcctcttcccgaagaagaaaaacaccccccccccccccccaaaaaaagggggtgtgtttggaaggg

SEQ ID NO: 45951 - DNA, 672 bp, Zea mays
  misc_feature: Ceres CLONE 1450672-F
  misc_feature: Encodes the peptide sequence at SEQ ID NO. 45952
  misc_feature (111)..(111): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
gctctcaactaatggatcccccgggctgcgggaattcgcacgagaccattacctacaacatcctaatcgaaaaaattatcttcctcgactcctcgttctcccctctcctantctttggcgcgtagtggcgaactggagaggtgtacaatcgtccggcgatccggacttcgattggttctctgctgttggtctgatgggaagtaaagacggcaccggtgacatatctgaagcccaaggctatgctgccgacattgattccatcacggaggcgcaggcccgcattgcgccgtacgttcacaggacgcccgttatgtcgtcgacgtccatccatgccatggtggggaagaagctcttcttctagtgcgagtgcttccagaaagcgggcgcattcaacatccgaggtgcttcgaattcgatattctcaccttgacatgacagtatcaagctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45952 - protein, 55 aa, Zea mays
  misc_feature: Ceres CLONE 1450672-F
MGSKDGTGDISEAQGYAADIDSITEAQARIAPYVHRTPVMSSTSIHAMVGKKLFF

SEQ ID NO: 45953 - DNA, 710 bp, Zea mays
  misc_feature: Ceres CLONE 1450675-F
  misc_feature: Encodes the peptide sequence at SEQ ID NO. 45954
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaaatcgaaaattacgggcactgttacgttcaatgcagatggacatgcgtgactttctcaatgccccgaatgggtcatcacaatctactgttactgataatggaagacaggagtcagggtctcctcagtctccgcttggtggcaagacggatgtttttgacttgccctttcatatggccagagatcagatagaagagagtttgcgcacaaaaatgacttcaatcaaggcacgaatgacacaacttcaagatgctcagaaaggtgcagaagtgacttctgaggcaactgaccgggagcttgagcttgaagctcaactggttgaagcaagaagcatcatccaagagcaggcctgcatcatgtccaagcacttcaagtctgataagccaagtggcaggaggcatagcggtctggatggcgagcgtgaggcatctgcccgagtgtaaaagcatgtctgtagcaaggatatatctgttctgcaagacctcctgattttagtaagtaccgaggtagtatgttgcaggatataacatggtcctgtgctggtgttagccggagtttaggtgctgnctatgcagtatgatgtgcaggagcatatcttcagccacatgctt

SEQ ID NO: 45954 - protein, 136 aa, Zea mays
  misc_feature: Ceres CLONE 1450675-F
MQMDMRDFLNAPNGSSQSTVTDNGRQESGSPQSPLGGKTDVFDLPFHMARDQIEESLRTKMTSIKARMTQLQDAQKGAEVTSEATDRELELEAQLVEARSIIQEQACIMSKHFKSDKPSGRRHSGLDGEREASARV

SEQ ID NO: 45955 - DNA, 690 bp, Zea mays
  misc_feature: Ceres CLONE 1450678-F
  misc_feature: Translation starting site: 187
  misc_feature: Pfam Name: Thiolase_N Pfam Description: Thiolase, N-terminal domain
  misc_feature: SWISSPROT Homolog: EC 2.3.1.9 Acetyl-CoA C-acetyltransferase
  misc_feature (274)..(274): n is a, c, t, g, unknown, or other
  misc_feature (311)..(311): n is a, c, t, g, unknown, or other
ctccccgcggtggcggccgctctagaactagtggatcccccgggctgcaggaattcgcacgagaccattacctagaacatcctaatcgaaaaagagtccaggcgacccaggctgcgcggtcgctcggtgttgttagtcccgaccgccgccggccatggcatccaacggcatcgccccaagagatgtatgtgttgttggcgttgcacgcacccctttgggtggtttccttggtgccttgtcttccttgcccgcacaaagcttggttctatagcanttgaagctgctctgaaaagaggcaatgtggatccggncctcgtgcaggaggtctttttcggaaacgtcttgagtgctaatttgggacaagctccttgcaggcagcccgttctgggtgcaggattaccaaaccttggttgttgccccccgtgttaacaagttccgcccctcttggctgaaaacttcttttttccccccaaaccaattcccgggggtaacaagaaatttgttggggcgggggggtgaaaaaattttcccatgcccccaaaatttttttgaaaatgagaaaggcgcccttttttaaaaaaacccccttttttaccccccccttaagagggcccttttgggaaaaaaacacaccgcgccgcggggatgtgggcccaattttgtgtcgaaacacctcccctccaaaaaaaa

SEQ ID NO: 45956 - DNA, 569 bp, Zea mays
  misc_feature: Ceres CLONE 1450680-F
  misc_feature: Translation starting site: 154
  misc_feature (191)..(191): n is a, c, t, g, unknown, or other
  misc_feature (201)..(201): n is a, c, t, g, unknown, or other
  misc_feature (291)..(291): n is a, c, t, g, unknown, or other
  misc_feature (312)..(312): n is a, c, t, g, unknown, or other
  misc_feature (354)..(354): n is a, c, t, g, unknown, or other
  misc_feature (366)..(366): n is a, c, t, g, unknown, or other
ccggcggtggcggccgctctagaactagtggattcccccgggctgcaggaattcgcacgagaccattacctagaacatcctaatcgaaaacctccgcgcactccacccaactcgccgccgccgctgccaacgccgcctgctgccgcagccgccatgggggcgtacaagtatgtgtcggaactatggaggangaagcagtcngacgtgatgcgcttcgtgcagcgcgtgcgctgctgggagtacaggcagcagccgtccatcgtccgccctcacagcccacccgccccgacnaggcccgtcgtctcggctacnagggccagcagggatatgttgtctaccgttgtctttgtgaancttggctgccangaaaaagccttgtgcccaaaggtattggctattggcaagccccaaccccaaggggttccccaaactccaggtccccaaagaaacaaaaagtcttgtcctctaaggaaaaaccttgaacactaaccttggggggaacggagggttccttaccccccaccggggggaagggggagaaggcccccccacgtttttttggaataccc

SEQ ID NO: 45957 - DNA, 723 bp, Zea mays
  misc_feature: Ceres CLONE 1450704-F
  misc_feature: Encodes the peptide sequence at SEQ ID NO. 45958
  misc_feature (412)..(412): n is a, c, t, g, unknown, or other
  misc_feature (421)..(421): n is a, c, t, g, unknown, or other
ctggagctccccgcggtggcggccgctctagaactagtggatcccccgggctgcaggaattcgcacgagaccattacctagaacatcctaatcaaaaagtggcacagtgcacacactcgtctcatcggagaaaagtagatccggattagggttttagacggcgatgggtgcggcgggcgacgagaaggctgcggtggctgcggccgctgcggccgcgggggccggtgccgccgagggcgagggcgcggtggactccaaggaccttcagcagcagagcaaggctctcgacaagctcactgatcatgtcgaggaccggcagctcgattcatcccgtgtccaatccgccatggcggcacttgcttcatccaaggaggctgactggaacgcgatgaggctgagggagaaagacttngctgctgtngagatcaaccctgcggatgtcgaaatatcgctagggaccttgacctggacaagaagatccggaaaaaacccttcgtgaccccaaggtaatccccggcctgcgttccatttcggctgcccaagttccaaatttcccccccggataaatgttccctttttttccccccaagggggagggggagggaaccccccccttttggggccctttttggagatttctttaacaactttggcaaaattttaaaagggaacccccccaaaaaaaaaaaaaaaattttttccttcccccccccgggggggggg

SEQ ID NO: 45958 - protein, 111 aa, Zea mays
  misc_feature: Ceres CLONE 1450704-F
  misc_feature (83)..(83): Xaa is any aa, unknown, or other
MGAAGDEKAAVAAAAAAAGAGAAEGEGAVDSKDLQQQSKALDKLTDHVEDRQLDSSRVQSAMAALASSKEADWNAMRLREKDXAAVEINPADVEISLGTLTWTRRSGKNPS

SEQ ID NO: 45959 - DNA, 632 bp, Zea mays
  misc_feature: Ceres CLONE 1450707-F
  misc_feature: Encodes the peptide sequence at SEQ ID NO. 45960
ggagctccccgcggtggcggccgctctagaatagtggatcccccgggctgcaggaattcgcacgagaccattacctagaacatcctaatcgaaaatctgctcgtctcgtgagccttagcgcttaagcttgccgtcttccgccccttataagaagcccgccgcccgcccgccgccgtcactctcggcctcggcagcaaactaacaaggcacatcgtacgctcgaggagaggagctgcgttcgtggtgtgcatggcggaatcggcgatctaccggctgccggaggagtgcgtggcatacgccatctcgctgacgacgcccggcgacgcgtgccactcgtccgcggtgtcgccggccttcagggccgccgcggactccgacgccgtctgggcgcggttcctgccgccggaccacgccgacatcctggcgcgcgccgacgacccgggcgccgtcaccgcccggctgcgcgtccaagaaagagctcttctcgcgcctctgcgacagccccgtcctcctcgacggcgccaccatgagctttgggctggagaggcggagccggcccaaatgcttcatgttgtcggcgaaggcgctcagcaggaaaaacgacccttcgcgctggaacgtggcccgctagc

SEQ ID NO: 45960 - protein, 127 aa, Zea mays
  misc_feature: Ceres CLONE 1450707-F
MAESAIYRLPEECVAYAISLTTPGDACHSSAVSPAFRAAADSDAVWARFLPPDHADILARADDPGAVTARLRVQERALLAPLRQPRPPRRRHHELWAGEAEPAQMLHVVGEGAQQEKRPFALERGPL

SEQ ID NO: 45961 - DNA, 780 bp, Zea mays
  misc_feature: Ceres CLONE 1450708-F
  misc_feature: Encodes the peptide sequence at SEQ ID NO. 45962
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (416)..(416): n is a, c, t, g, unknown, or other
  misc_feature (425)..(425): n is a, c, t, g, unknown, or other
  misc_feature (516)..(516): n is a, c, t, g, unknown, or other
  misc_feature (539)..(539): n is a, c, t, g, unknown, or other
  misc_feature (547)..(547): n is a, c, t, g, unknown, or other
  misc_feature (557)..(557): n is a, c, t, g, unknown, or other
  misc_feature (609)..(609): n is a, c, t, g, unknown, or other
  misc_feature (716)..(716): n is a, c, t, g, unknown, or other
  misc_feature (780)..(780): n is a, c, t, g, unknown, or other
agattgtggagctcaccgcggtggcggccgctctttactagtggatcccccgggctgcaggaattcgcacgagaccattacctagaacatcctaatcgaaaaatcgaacgaacccagccgaagcgcgagctgagcaaggcggaggcggcgggaccggcgatggagcggctgcagcggatctttggcgcctccggcatggggcacccgccgacggactccccgctgctcgactcctccgagcaggtctacatctcctccctcgcgcttctcaagatgctcaagcactttagggcccggcgtgcccaatggaggtcatgggtcttcttgttcggccgagttccgtcatgaactacaccggccggggtttttttttcccccccccccggggggggaagaaagggggggnnnttcccccntcctaatanccacccccccccggctcctccccaaacaaacaaacccctccaacttgcccgtcgccgggacgggggggtggccgggaaagaggggctcgcngaggcccgcgcttggggtggggnagtgctgnggcccccccnccgggggggggcccaggcccgccgggcgagggagctgttgcacggcgcccgnccgattctcgggagagctttcggacagcccaggcgcaggcgcggggggccatggcggcgcggcgagggctgcagcggaggttggtggggcggcctgcagggcgcctnctgtctggcgtgagggcggcgaccccgaaagcccagcgaccaaacgcaccaccagtcccgccgn

SEQ ID NO: 45962 - protein, 62 aa, Zea mays
  misc_feature: Ceres CLONE 1450708-F
MERLQRIFGASGMGHPPTDSPLLDSSEQVYISSLALLKMLKHFRARRAQWRSWVFLFGRVPS

SEQ ID NO: 45963 - DNA, 614 bp, Zea mays
  misc_feature: Ceres CLONE 1450711-F
  misc_feature: Encodes the peptide sequence at SEQ ID NO. 45964
tggcggccgctctagaactagtggatcccccgggctgcaggaattcgcacgagaccattacctagaacatcctaatcgaaaaaaagaaatagagatgagctagagggggccggggccgggagagccaagggcccgagggagatggagaaagatgtgaagctatttgcttctgagtggaatgttgtctggttcaaggtcttttgctttgtgatccatctgtgtagagcttctaagtattccttggatctgcaagatctcggaccaggcttcattcccctcagaaatagcttcaaaaatgatatcgcggagagttaggagagctactcgccagtgtataaatttgttctagtttttttttgaaatatttgtttgagtgttcgtgagattcctggccgttcttagtagtatgcatggtgtggagcaccgtacttccgctcctggatctttactactactccactgtgcttttttgtttgtttgtttgcttgcttgcttgctgcgaaatcgaggagcagcgcaagattggtgtaatgatggcctgccttttgacccctcctttctctgtgcatctctgtgcatctggcaggcatgcagcagatatctgttgcttattt

SEQ ID NO: 45964 - protein, 57 aa, Zea mays
  misc_feature: Ceres CLONE 1450711-F
MEKDVKLFASEWNVVWFKVFCFVIHLCRASKYSLDLQDLGPGFIPLRNSFKNDIAES

SEQ ID NO: 45965 - DNA, 654 bp, Zea mays
  misc_feature: Ceres CLONE 1450716-F
  misc_feature: Translation starting site: 256
  misc_feature: Pfam Name: RNA_pol_Rpb5_N Pfam Description: RNA polymerase Rpb5, N-terminal domain
ctccccgcggtggcggccgctctagaactagtggatcccccgggctgcaggaattcgcacgagaccattacctagaacatcctaatcgaaaaactggtgcggcgcggagcgaggacaacgtcaccttctccagcccccgcccctgtgtaggagtaggtgtagccgcgtaagcggcgtaggcctcagctcggctcagcagccgcctcgctcgaaccagaggagccaagcagaggaagcgaggcggcgggggcggagatgtcggcgggactggtgaccgacgaggccaccgtggggcggctgtaccggatccggcgcacggtgatgcagatgctccgtgaccgtggctacctggtggtggaccacgagctcgccaccagccgccgcgacttcctccgcaagttcggcgagtccttccaccgcgaggacctcctcatcaacaagtacaagaaagaacgacccatccgaccagatatatgtcttcttccccaacgatgacaaggtagggatgaagcacatcaagaagtacgtcgaaatgatgacgcacgagaacgtctccagagctgtgctggttctccagcagaacctaactccgtttgcgaagtcgtttctcatagagctggagccgaagatccatctggaaattttccgcaatcc

SEQ ID NO: 45966 - DNA, 597 bp, Zea mays
  misc_feature: Ceres CLONE 1450738-F
  misc_feature: Encodes the peptide sequence at SEQ ID NO. 45967
cgcggtggcggccgctctttaatagtggatcccccgggctgcaggaattcgcacgagaccattacctagaacatcctaatcgaaaagatttcgagtctgtagagaaccgggtgcggtttcaacgtcgaggcatcacccgcttcacctccagacgtccagttctccaccccacttcgcccatcgagtgccagtggagcgcttccttgacctcgccacctcctgtcctccccctcctgtactggcgcccgttgtttctttcccttgccggatgcccgccgccggagctgaagagggggaatgcagccgccacagcactacccgccgacgcctgaggcggggtcgcgggggccagggccggccccaccaccgtcgacgaggcgtccatggaactcagcaacaccttcatcaaggctctacaggggctccgtgtgagaaggcgaaagagattctgatggaggaaagcaatgttcagaaattctttctttatgctaatgatgaagatgctgcagaagatggagatcaggatgctgaattgctgatagtttggtttgaaaaatgttagatctgaacatctatggtagtacattgttatgtgaa

SEQ ID NO: 45967 - protein, 97 aa, Zea mays
  misc_feature: Ceres CLONE 1450738-F
MPAAGAEEGECSRHSTTRRRLRRGRGGQGRPHHRRRGVHGTQQHLHQGSTGAPCEKAKEILMEESNVQKFFLYANDEDAAEDGDQDAELLIVWFEKC

SEQ ID NO: 45968 - DNA, 643 bp, Zea mays
  misc_feature: Ceres CLONE 1450749-F
  misc_feature: Encodes the peptide sequence at SEQ ID NO. 45969
tggagctccccgcggtggcggccgctctagaactagtggatcccccgggctgcaggaattcgcacgagaccattacctagaacattctaatcgaaaaagcgctttcctgtccgactcccagccgtcgtctgctgcgtactccgcctccagtttggtctgtttcttgcaagttgctcttgcggtagttcccccaactgtcaccatgcagaacgaggagggtaagactgtggacctctatgttcccaggaagtgctcggccacaaacaggatcatcactgccaaggaccatgcctctgtccagatcaacattggccacttggatgcaaatggcctgtaagacggtcacttaaaaacatttagtctcccccccccccgacaggaaacagaggaaaagtaaataaaaaccttataaaaaaaaaacaaaaatatgagtatcttttaaaaacataatataacgggacaaaataaaaaatcaatttcatatgaccacactccataactacaccctataaaaaacaaaaacaaaaaaggttaaaataaatttcacgacaacacaagaagcaacaaaaattgaaagacaacagaaacacaaacaacaaattaaattttaccacccctttattttaattacaactaaattatg

SEQ ID NO: 45969 - protein, 44 aa, Zea mays
  misc_feature: Ceres CLONE 1450749-F
  misc_feature (1)..(45): Pfam Name: Ribosomal_S21e Pfam Description: Ribosomal protein S21e
MQNEEGKTVDLYVPRKCSATNRIITAKDHASVQINIGHLDANGL

SEQ ID NO: 45970 - DNA, 764 bp, Zea mays
  misc_feature: Ceres CLONE 1450768-F
aaagctggagctccccgcggtggcggccgctctagaactagtggatcccccgggctgcaggaattcgcacgagaccattacctagaacatcctaatcgaaaaatacctttctcggccttttggctaagatcaagtgtagtatctgttcttatcagtttaatatctgatatgtggaccatgtgttcactttgatattaaatttattttttgtgggggagggctcgctacagtggcttgctactggggccctcaagcgtcgctcggccgttgcactataggctgagcctggcgcgccccaaccaatgcaatttcagctttaagtatgtctttagactatacgaaatgtatggttccatatcaataaatttggtcgtaagtaatgaagaagctaatatcgcccatatttagtcatcaagcagcatgccggtctagcagcatgtccctgtgctgcccggacctggtggaggccgctctcgccacgagcaggagagacccgccggttcaggtacaggcaaacgacaacaccatggacgcctatgacgggtcgggcagagaaccataacatctgagagctttcgtctactgtataaataaaccattatcagctaaaactccattgaatcgtcttagataggtactgctggaaaagtgccataccaataaaaaatcattgatagttaaaaaaaaaaaaaaaaaagcttatcgataccgtcgacctcgaggggggggcccggtaccccattcgccctatagtgagtcgtatt

SEQ ID NO: 45971 - DNA, 768 bp, Zea mays
  misc_feature: Ceres CLONE 1450776-F
  misc_feature: Encodes the peptide sequence at SEQ ID NO. 45972
  misc_feature (525)..(525): n is a, c, t, g, unknown, or other
  misc_feature (693)..(693): n is a, c, t, g, unknown, or other
  misc_feature (745)..(745): n is a, c, t, g, unknown, or other
ctggagctccccgcggtggcggccgctctagaactagtggatcccccgggctgcaggaattcgcacgagaccattacctagaacatcctaatcgaaaaaatccagtccgggccgatcgccatggcaaccgccaccgctcctgcatatatacctaccactgcacatgctgccaggcccagcttcacaagctaggtgtgtcagcccaaaaccaccaaccagcccgagcttttctttgctgcctgccgcggcgcgtcgcgacccgggccgacaagatagggtcggaaagccccgccgccgacggcgtcggcgacgccgcgcgcaagcggcccagcggcgatgttggccccaccccggggccagccgacaagcgccgccgcccggagcacccttcttcctcctccgcgggctcccgcgaccgccaccaccaccaccacggccgccgcccgccgtcctcggccgacgagaaggtgcgcgcctctcacatcctgatcaagcacgagggctcccgccgcaaggcctcgtggncggatcccgaaggcgtcgccatctcccgcacgacacgcgacgacgcggccgacctcgcgcgcgcgctccgcgaccagatcgtctccggtgaccgcgagttcgaagacgtcgctgccgagaactccgactgcagctcggccaagcgcggcggtgacctccgttcatttnggaagggtagatgcagaagccttttgaagaggcccgcgttgctctaaagtcnggaagatcacgacgtgttgaaac

SEQ ID NO: 45972 - protein, 245 aa, Zea mays
  misc_feature: Ceres CLONE 1450776-F
  misc_feature (160)..(243): Pfam Name: Rotamase Pfam Description: PPIC-type PPIASE domain
  misc_feature: SWISSPROT Homolog: EC 5.2.1.8 Peptidylprolyl isomerase
  misc_feature (175)..(175): Xaa is any aa, unknown, or other
  misc_feature (231)..(231): Xaa is any aa, unknown, or other
GAPRGGGRSRTSGSPGLQEFARDHYLEHPNRKNPVRADRHGNRHRSCIYTYHCTCCQAQLHKLGVSAQNHQPARAFLCCLPRRVATRADKIGSESPAADGVGDAARKRPSGDVGPTPGPADKRRRPEHPSSSSAGSRDRHHHHHGRRPPSSADEKVRASHILIKHEGSRRKASWXDPEGVAISRTTRDDAADLARALRDQIVSGDREFEDVAAENSDCSSAKRGGDLRSFXKGRCRSLLKRPALL

SEQ ID NO: 45973 - DNA, 703 bp, Zea mays
  misc_feature: Ceres CLONE 1450778-F
  misc_feature: Translation starting site: 139
  misc_feature: SWISSPROT Homolog: EC 3.2.1.39 Glucan endo-1,3-beta-D-glucosidase
  misc_feature: SWISSPROT Homolog: EC 3.2.1.23 Beta-galactosidase
caaagctggagctccccgcggtggcggccgctctagaactagtggatcccccgggctgcaggaattcgcacgagaccattacctagaacatcctaatcgaaaaaaaactccaaaatccaatccaagcaactcctccccatgctcctcccgctcctcctcgccgccttcctccatggcttggcggaggcgcagggcggcctcccgtcgctgccgatcggggtgaactacggcgcgaacgcagacaacctaccctcgcccgccgccgtggccgcgttcctggccaagagcacgaccatcgaccgcgtgaagctgttcgacgcgaacccggccttcctcgacgcgttcgccgccaacgcgccctccatcgccctcgccgtctccatccccaactccgccctcccgtccttcgccgacagatccacgggcctggacgcggcgcgcgggtgggtccgcgacaacctgtccccgcacgtgtccgcgggcgccaacatcacggcacgagaagctatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagccaacaggcccgcaccgatcgccct

SEQ ID NO: 45974 - DNA, 754 bp, Zea mays
  misc_feature: Ceres CLONE 1450781-F
  misc_feature: Encodes the peptide sequence at SEQ ID NO. 45975
  misc_feature (512)..(512): n is a, c, t, g, unknown, or other
acagctggagctccccgcggtggcggccgctctagaactagtggatcccccgggctgcaggaattcgcacgagaccattacctagaacatcctaatcgaaaaaaaaataaccagacaatgagcttaacgcttctccagggctactcctccgctgaggacgacgacgatcccgccgccggcgccggcgctggcaccgagctgagcgagtctggtgattcgtcagccgaggaagccggatcggacgaagacgaggagtccgctcctccaaagccgccccccaagctccgccgccgaccaaaccctaaggggggagatgccggcggcagcgacgggggctccttgctgccctccgcgctggaggccttccctcccgcctcgggagggggggattttttgaggcacagggttgcccacccacaggaagggacggaggccctcggtgtactcgatcgccgtgggaaagaggggaccaaacagccgcctccaggtgctgttgtgggggcaaaacccanatagttgctatccccgagcgagttaccaccactgggagccacccccccggttcgtgaccgctgggttctattgatggaaaaagagtaataggtggttcaaaaccctgggcccaaaaaacgcagctgatcctcttaggggggggcctccaatgggggggacccaaacacctattcccatggaaaagggattggggggcccccccgggcggggggaacaccgatgccaacaaaaaagacccaaa

SEQ ID NO: 45975 - protein, 131 aa, Zea mays
  misc_feature: Ceres CLONE 1450781-F
MSLTLLQGYSSAEDDDDPAAGAGAGTELSESGDSSAEEAGSDEDEESAPPKPPPKLRRRPNPKGGDAGGSDGGSLLPSALEAFPPASGGGDFLRHRVAHPQEGTEALGVLDRRGKEGTKQPPPGAVVGAKP

SEQ ID NO: 45976 - DNA, 809 bp, Zea mays
  misc_feature: Ceres CLONE 1450784-F
  misc_feature: Encodes the peptide sequence at SEQ ID NO. 45977
  misc_feature (295)..(295): n is a, c, t, g, unknown, or other
  misc_feature (301)..(301): n is a, c, t, g, unknown, or other
  misc_feature (304)..(304): n is a, c, t, g, unknown, or other
  misc_feature (305)..(305): n is a, c, t, g, unknown, or other
  misc_feature (341)..(341): n is a, c, t, g, unknown, or other
  misc_feature (350)..(350): n is a, c, t, g, unknown, or other
  misc_feature (352)..(352): n is a, c, t, g, unknown, or other
  misc_feature (375)..(375): n is a, c, t, g, unknown, or other
  misc_feature (398)..(398): n is a, c, t, g, unknown, or other
  misc_feature (411)..(411): n is a, c, t, g, unknown, or other
  misc_feature (412)..(412): n is a, c, t, g, unknown, or other
  misc_feature (492)..(492): n is a, c, t, g, unknown, or other
aagctggagctccccgcggtggcggccgctctagaactagtggatcccccgggctgcaggaattcgcacgagaccattacctagaacatcctaatcgaatatctgcttttggtgtttcttatctgagaggtttgcacaagctaggtcatctgaacctggagggctgtgcagttactgcagtttgtttggaggttatatctgagcttgcttcgttggtcttgttgaatctgagtcggtgtggcatatgcgatgaaggctgtgagaacttgaaaggtcttacaaaattgaaggctcntagttnagnnggtcaccaaattacagatgcatgtttaattcatttnaaagatttngntcaacttggagtgcttgaacttnggactcatgtagattggtgatgnaggtctatttcannctaaaagcctcatacagctaaaaaccctggagctttcaaaccctgaagttggaagccatggaactcgccatccctcggtnctgccaaatttgcagagcatcaatccccctttccgttgggtaccgaatttggttaaaaaaaatccgtgcttgatttcccggaaaccttaaattttgaaaaccccaaaatccaaaaatcgggttatccccctttaaggcccccggggtgtgcacccccccccctttttgagcgccaaaaagaattgggggaggcggcttaaaatttttaaaaaaatacccccccccgggggccgcgggggggttataaaagagcgcggggggaaaacaaagggggggggaggggggggggcccccccctctttatagagaaaagcaaa

SEQ ID NO: 45977 - protein, 130 aa, Zea mays
  misc_feature: Ceres CLONE 1450784-F
  misc_feature (98)..(98): Xaa is any aa, unknown, or other
  misc_feature (100)..(100): Xaa is any aa, unknown, or other
  misc_feature (101)..(101): Xaa is any aa, unknown, or other
  misc_feature (113)..(113): Xaa is any aa, unknown, or other
  misc_feature (116)..(116): Xaa is any aa, unknown, or other
  misc_feature (117)..(117): Xaa is any aa, unknown, or other
  misc_feature (125)..(125): Xaa is any aa, unknown, or other
AGAPRGGGRSRTSGSPGLQEFARDHYLEHPNRISAFGVSYLRGLHKLGHLNLEGCAVTAVCLEVISELASLVLLNLSRCGICDEGCENLKGLTKLKAXSXXGHQITDACLIHXKDXXQLGVLELXTHVDW

SEQ ID NO: 45978 - DNA, 764 bp, Zea mays
  misc_feature: Ceres CLONE 1450785-F
  misc_feature (394)..(394): n is a, c, t, g, unknown, or other
  misc_feature (463)..(463): n is a, c, t, g, unknown, or other
  misc_feature (470)..(470): n is a, c, t, g, unknown, or other
  misc_feature (502)..(502): n is a, c, t, g, unknown, or other
  misc_feature (503)..(503): n is a, c, t, g, unknown, or other
aaagctggagctccccgcggtggcggccgctctagaactagtggatcccccgggctgcaggaattcgcacgagaccattacctagaacatcctaatcgaaaagaggaacaagaggtctgtcgctgaggagagagctggacgtaagcttggtggactgagggttcttaactcctactgggtgaatgaggatagtacctacaagtattttgagatcatccttgtggacgttgcccacaaagccatcaaaactgacccgaggatcaactggctatgcaaccctgtgcacaagcaccgcgagctccgtggcctcacctcggcaggcaagaagttccgtggcctgcgtggcaagggccacacccaccacaagaacaggccctcaaggagagccacctgnaaagcgcaccagaccctctccctccgccgttaccgctgagcacctctccccatcagggacagaagggtngcctggnctctggtgcattttcaaaagtttgctatttgnngtcttggcactttttatgttagaaggtcattatggagcatatgtcatggactatttgcaattccggtgtgattattcaaacacggaaggttaagggaccaatgccggccgggcgggtggggccgaaaaaaaaaaaaaaaaattttttcatccccgccaccctcaggggggggcccgggaccccattcccccctaaaggggagcatataaccccgccccccggcgcgctttttttaccccgggagggggaaaaccctcctct

SEQ ID NO: 45979 - DNA, 805 bp, Zea mays
  misc_feature: Ceres CLONE 1450792-F
  misc_feature: Encodes the peptide sequence at SEQ ID NO. 45980
ccgagctggagctccccgcggtggcggccgctcaagaactagtggatcccccgggctgcaggaattcgcacgagaccattacctagaacatcctaatcaaaaaaaaaacaatcaattaaactcaattaaaaaaaaaatgacgtttgcttaaaagatcatcatatgcctcctcttccttacgatgtacattgcacctccaacagagtcacagataatgtgtgggacagagacaagcacaatgacacaatgcatcagctacttgaccaacggtggtccattgccatcaacctgctgcgtggtagtcaaatcattgaaccaaatggctcaaaccacaccagatcgccgacaagtatgtgagtggcttaaatgaggagaaaaacaaattaaaggactcaatatagaccttgtggccgcaatccctacaacttgaggcgcttcactatcctaccccattgcattcaacagctattgtgacaccatatcgattgccagtgtgcacgatactagacacgcacgaactactatgagaagattggccaaacttctaaactaaaaaataatatccccctgctattgtctatactccaaactggggattcctaattatgaaatgatcccctcccataaagaaactaagttataaaggaaataaagagcttaactctcttttctatcgagcgcttttacatggattggacaacaaaacaataccaattccggaaatatcaccacactgaatttcctaacaaaataaaagataaaaagactctaaacagcattaccgattaggacctttctagggggg

SEQ ID NO: 45980 - protein, 62 aa, Zea mays
  misc_feature: Ceres CLONE 1450792-F
MYIAPPTESQIMCGTETSTMTQCISYLTNGGPLPSTCCVVVKSLNQMAQTTPDRRQVCEWLK

SEQ ID NO: 45981 - DNA, 784 bp, Zea mays
  misc_feature: Ceres CLONE 1450796-F
  misc_feature: Encodes the peptide sequence at SEQ ID NO. 45982
  misc_feature (397)..(397): n is a, c, t, g, unknown, or other
gaaagctggagctccccgcggtggcggccgctctagatctagtggatcccccgggctgcaggaattcgcacgagaccattacctagaacatcctaatcgaaaaacaaattcaaataactccaccggcaagtcccctccgccgtccttcagtaccggaagaaggcgaggcgcccaaccgagagcaccaggggaaaggaagtgcgcctaggcatcgacatggaggacttctacgtcacgatcctctacggcctgctgctcgtagccggcggcgtagccggctacatgaagcgcggcagcgccgcgtctctggtcgccgggggcggattcggcgctgcgctccttctcgctggtgcgctcagcgtctgtgtcttcgcgcacggcagagggggggctgccnccatctttgccacccccccccccaccctttgtgctgtgctattgactgttgtcatgggaataagatacgtcaaaacaccaaagaaaatgcctgctggaattgtcgcttctatcagtgccctcgtactgatattttacctggaacaagatatctaccggtggggaccaaggtttaaatgtccgcggaatgcccaagggaacctgctggcgcgtggggggttccccgcacccgttttgacgcgagctaaattgtgaagaaaacaaaaccaccgtggatccattggtatttttatcgggccaacccgggccccaaccacgcagggccttgttcagcttaacattggaccgggcaaccattgttcaatgttaactcttttaatcagcttgg

SEQ ID NO: 45982 - protein, 144 aa, Zea mays
  misc_feature: Ceres CLONE 1450796-F
  misc_feature (4)..(110): Pfam Name: TMEM14 Pfam Description: Transmembrane proteins 14C
  misc_feature (61)..(61): Xaa is any aa, unknown, or other
MEDFYVTILYGLLLVAGGVAGYMKRGSAASLVAGGGFGAALLLAGALSVCVFAHGRGGAAXIFATPPPTLCAVLLTVVMGIRYVKTPKKMPAGIVASISALVLIFYLEQDIYRWGPRFKCPRNAQGNLLARGGFPAPVLTRAKL

SEQ ID NO: 45983 - DNA, 781 bp, Zea mays
  misc_feature: Ceres CLONE 1450799-F
caagctggagctcaccgcggtggcggccgctctagactagtggatcccccgggctgcaggaattcgcacgagaccattacctagaacatcctaatcgaaaatacagataacggagtgaccagcttagcgtcaagatgccctgatctcagagccgtacacttgtgcggttgtgctcttataacacatgagagtgtggttgctcttgccaacggatgtccgcacctgcgctagctgggactctacttctgccagaacatcacggaccgcgacatgaactccctcgcaaacagacgcgtgaagagcaagcgtgggaggtgggatgcagagaaagacgggctcgcaaacctcaacatcagtcagtgtattggtttttttacccccggtggtgtaggccctttgttaatatttccgaaccctttccacctgcccggagaggcactccctcatcatcaaggggctgcctcagcctcacgccattccactgcgcctgcgccctcaacccacaccgtgccggggaacccctgatggccaaacctgccgtacatataaacatgtcggtgggttcttcgctgaatagtcttccgggatgccgacccctggctcggggcccagggcccctctcaaatgttcagggaacttccctggtgacattaaactcgaatctctgcccgctacccctattggacttgttggtttggactttgtcgaggacacacaaggtagtgccccatttctctagaaggacggtctgtcgcatctcatgggacccctgttggttgtc

SEQ ID NO: 45984 - DNA, 791 bp, Zea mays
  misc_feature: Ceres CLONE 1450805-F
  misc_feature (327)..(327): n is a, c, t, g, unknown, or other
ggagctccccgcggtggcggccgctctagaactagtggatcccccgggctgcaggaattcgcacgagaccattacctagaacatcctaatcgaaaacatcggcgtgctcccgagccctgaaccctgtccctgacccgttcacccgtcgcaggcgagcagcagacagccagaggagacgtcgcgcctgtgcctaccatggacgagaaggagttctggcgcatgctcgacctcttccccgtcgtcccgctccgtgactattgcgctgatccctgaacatctatcagaggaaccagacagcgatcacgagttcaggaggcagcggagggncatgagcaggactcatccgacgcaacagattttgtttatccaaaagttgaaaatggcttgccaaaaaaaaaattgggaaccacaaaggccaagttcttcttggaagggctttgaaaaaaccccttggaaaaccttgtttacccaaagacgaaattgggattgccttaaaaaagtttccgacgccctttttgaacttaagtttaaaccttggtaatatccccccaaagaatccggggggccaaatacccaaaaaatgttggacccgtccgcatttttttttttcaaaacctttttgtgggggaaaaaaaaccaccccttttgggggcaccctctttttttttaaaaaaaatttttgatggcccctctgcccgccaaatttttttttaaaaaaaaaaaaaaaaattttttttcctccccccccgggggggggcgcccccccccctcttcccggggggtggtctcgc

SEQ ID NO: 45985 - DNA, 776 bp, Zea mays
  misc_feature: Ceres CLONE 1450806-F
  misc_feature (696)..(696): n is a, c, t, g, unknown, or other
  misc_feature (697)..(697): n is a, c, t, g, unknown, or other
  misc_feature (701)..(701): n is a, c, t, g, unknown, or other
  misc_feature (703)..(703): n is a, c, t, g, unknown, or other
  misc_feature (704)..(704): n is a, c, t, g, unknown, or other
  misc_feature (712)..(712): n is a, c, t, g, unknown, or other
  misc_feature (715)..(715): n is a, c, t, g, unknown, or other
  misc_feature (716)..(716): n is a, c, t, g, unknown, or other
  misc_feature (722)..(722): n is a, c, t, g, unknown, or other
  misc_feature (726)..(726): n is a, c, t, g, unknown, or other
aagctggagctccccgcggtggcggccgctctagaactagtggatcccccgggctgcaggaattcgcacgagaccattacctagaacatcctaatcgaaaaattttgtaattctccactgtagtcgttggcggggtctgcttcgtgtttcttactttgttctggaggaaaaaaaaaagatccctaatcaggagacaaggatccacatgcaataaatcttctcttctgttctgttctggcaccttcttcccagatcaataggggcgaggcgacagcagcgagcagacgaaatcgtttaaaggcgccagcttgtcttctgttccatttgtggtttcatttcctctgcaaacgatttccactttttctgcacgccgtcagctgatccttttcgccgtgtatttccgagcaaaagagaaaccctttttttgtgcgctgtgccgtttcgccatctctgttcgtcccaccgaggcaccgactcaatccccattcttggcatctggcttcacaaaacaagaccggttcccgttccctagatctctgcgtagaggcggcggcgaggcacctgaatccggcaaaaaagggttcgcggtttggttgggaggagcgcaggagcccggcgccaaaacccaatcttggcgcccgggctgccgtgcgccatcgtcttctccctggtggtgtttaggaagaggagaagccnngtgnannatgtgccntgnngaaggntacntcagcgacgagacgatgggcaccttctcgcccatcgtgctctactggctg

SEQ ID NO: 45986 - DNA, 764 bp, Zea mays
  misc_feature: Ceres CLONE 1450810-F
  misc_feature: Encodes the peptide sequence at SEQ ID NO. 45987
  misc_feature (554)..(554): n is a, c, t, g, unknown, or other
  misc_feature (555)..(555): n is a, c, t, g, unknown, or other
ctggagctccaccgcggtggcggccgctctagaactagtggatcccccgggctgcaggaattcgcacgagaccattacctagaacatcctaatcgaaaaatttttaccatccgcaggagctcccttccagacgcttccgctcttctctctctgcttccggcagaaatcaaggcagtattaggatggtgaccccgcgcctcttcgcgcgactctaccggcattgcgtcggcgcagcggctgcgtcatcagccgcggggcggcaccggggggccctggcagcggcggccgtggagcagttcgccggttcctccctgcctgtcggggttccaaaatttttgaatcatcatttcagatactcaaccagcatttttcaaaagattggtttctcgtctgtttcaccacaacaaagtgatgatgatgttaatgagctgaaagaccacgaaagggccttagatggatcaagtgaagattgtccatctggaagtattgaaggccttgatctgtcgagagatgatttggtgaagctagttcgtgagaaagatggatttgtgaanngtcaagatggtgaaatcaaagatatgaaggataaggttttgcgcagctatgcagaaatgaaaatatcatttgctcggacaaacgtgaatctgagaactccaaaaatatgcagtacagaacttctctaagagcctgctagatggtgctgacaaatttgctagggcatcatctgttgtcaaggaagctttctcgaaaatgatacctcaaaa

SEQ ID NO: 45987 - protein, 166 aa, Zea mays
  misc_feature: Ceres CLONE 1450810-F
  misc_feature (124)..(124): Xaa is any aa, unknown, or other
  misc_feature (125)..(125): Xaa is any aa, unknown, or other
MVTPRLFARLYRHCVGAAAASSAAGRHRGALAAAAVEQFAGSSLPVGVPKFLNHHFRYSTSIFQKIGFSSVSPQQSDDDVNELKDHERALDGSSEDCPSGSIEGLDLSRDDLVKLVREKDGFVXXQDGEIKDMKDKVLRSYAEMKISFARTNVNLRTPKICSTELL

SEQ ID NO: 45988 - DNA, 746 bp, Zea mays
  misc_feature: Ceres CLONE 1450816-F
  misc_feature: Encodes the peptide sequence at SEQ ID NO. 45989
ctccccgcggtggcggccgctctagaactagtggatcccccgggctgcaggaattcgcacgagaccattacctagaacatcctaatcgaaaaatcaaccgcagtacacggcgtatcattcccagcgaccacgagagactagctagccaagtgcatgcaaccagccatgcaggccgggaagacggcagtggaggcgacgaaggaggccgcggccaacgtcggggcctcggcgaacgccggcatgcagaagacccgtgccgcccgtgcagggcaggtggagaaggccacggcgcgcaacgcgtcggaacaggtcgcggccgaggagcgccagcgggagcgcgtgcgcgccgcgaagctggagaagcaggacgccgtgcgcgccaacgcggccgcgaaggagcgcgccattggcggcgcggccacgtaccagcaccagcacccgtcgcagggcgcgcccgggatcggcgcccagcaggagtatggcggcggaagagtcgccccccgcgggcgggcacgtcgaggccggcgtcggcgagacccgtcccgtcgctaggggcaccggcacggcgcggcccagcgccgcgcacaaacccggtcgtcggcagcgactttctcgaggcgcgcggcaccggcgaacagtaccattggagcgctaccgccgggacgtgcccgtacgtgtgacgtatcagtgtgttgaaaaggcatgtccccaaaggccctcgggtgaaaatctatgccaaaaaaaag

SEQ ID NO: 45989 - protein, 128 aa, Zea mays
  misc_feature: Ceres CLONE 1450816-F
  misc_feature (8)..(80): Pfam Name: LEA_1 Pfam Description: Late embryogenesis abundant (LEA) group 1
MQAGKTAVEATKEAAANVGASANAGMQKTRAARAGQVEKATARNASEQVAAEERQRERVRAAKLEKQDAVRANAAAKERAIGGAATYQHQHPSQGAPGIGAQQEYGGGRVAPRGRARRGRRRRDPSRR

SEQ ID NO: 45990 - DNA, 812 bp, Zea mays
  misc_feature: Ceres CLONE 1450819-F
  misc_feature: Encodes the peptide sequence at SEQ ID NO. 45991
  misc_feature (359)..(359): n is a, c, t, g, unknown, or other
  misc_feature (812)..(812): n is a, c, t, g, unknown, or other
acccgcggtggcggccgctctataactagtggatcccccgggctgcaggaattcgcacgagaccattacctagaacatcctaatcgaaaagcgcgcaggcggttctcacagcacggaggcactcatcagtcatcactagtacttcactagttagctagcaatattcctactcgctaagtagtggagaactggagatcgacatgagccaggggcagccgaggaggcggcagggcgaagagggcatgcacgcgcaggacaagcccgtcaagttcggcgacgtgctcgacgtctcaggcgagctggccgaccagcccgtggctccaagggacgccgcgcggctgcagggcccggaatagttngaggccccccgggacgcaaaggggggggccggcggctgtcaccccccccctctcccaccgacaacagcgagagggggccaccgagggcgggtcctcaaccccggggcccgtctccgacaggggggccctccgtaccccaaaaccaaaattccggggcccgcgcgttctgccccaaatccttcgcggtggacagttggggggaaaaaaagggaagtcctgggccctcggtgggaaaaaaggaacctccccgggcccctctcggagcaagagaccccttccaaattcgacgccccccctttgagcgtgtgggcccacaaattgtccttgacaaacgcccggtgtaaataaaaaaccaacggcgaggccgctcatatgactcgaaaatattgtggttttagggagttaaaataccgccccctctcccccgaagggggtttcccaccaacaccacan

SEQ ID NO: 45991 - protein, 51 aa, Zea mays
  misc_feature: Ceres CLONE 1450819-F
MSQGQPRRRQGEEGMHAQDKPVKFGDVLDVSGELADQPVAPRDAARLQGPE

SEQ ID NO: 45992 - DNA, 753 bp, Zea mays
  misc_feature: Ceres CLONE 1450821-F
  misc_feature: Translation starting site: 185
  misc_feature (491)..(491): n is a, c, t, g, unknown, or other
tggagctccccgcggtggcggccgctctagaactagtggatcccccgggctgcaggaattcgcacgagaccattacctagaacatcctaatcgaaaaaacccaagccaaagcccctcggatcggatccggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttcctcctcctcctcctcctccgccaccacgacgccgcggtccgtgctggcggcggcgccggcgccggcgctggagatcccgcggccggagctggaggccgtgctgcggcgcctggggcacgcggagccgtccgacgccgagctcgacgccgtgggcgcgctcngcgcgcagcccccgccgtgcgacgccgacgccgacgccgacggcgacctcatggaggcgttccgcgtgttcgacgcggacggcgacggccgcatcaccgccgaggagctccgcgccgtcctggacgccgtcctcggcggcgggtgcagcctcaacgactggcgccccatgatcggcggcgtccaccctgacggcgacggctttcgtcggcttccaggacttcgcgcgaatgataatggccaggcgcggcacggccgacccag

SEQ ID NO: 45993 - DNA, 717 bp, Zea mays
  misc_feature: Ceres CLONE 1450823-R
  misc_feature (407)..(407): n is a, c, t, g, unknown, or other
ttgggaccgggcccccctcgaggtcgacggtatcgataagcttttttttttttttttttgcagataaggcatatatataatataataaatatatcatacgagccaacaggaatttacattgcaacgctaatttattggagatcgatagataggacagtagtaacatatttctatctccaattactactttgctcatttggccttcaattgaaaaattacagaaaccagatgagcagtgaaaccactaagaaaagaatgactagaatgtggcaacgagctttctccaacaaataattgccatctcttgacaaatctaggaacgaaatagaaaagattacactatgtaccctatgcaacctcctttgaaaaaaaacgaggagactaaccaaagccccaacatatatgtnggtgatgcttccggcaaatatatcatacatcgcaagaacaaatgcatcataaaatgcctttggatgttcttgaagggggcctgttaatctctgacagcgaagaggaatgcgcttcttcgtatctttgtatctcctgagataatgttaaagtcgaagcagatttacgggattgcagttgatccttcaaatggttacgatgctgcagctgcatgttctcaaattgctgggagaggaaatgggaaattgattggcactggagttctgcatatctttggtttctatttgccatcttccgtcacttgcagaaatc

SEQ ID NO: 45994 - DNA, 789 bp, Zea mays
  misc_feature: Ceres CLONE 1450824-F
  misc_feature (400)..(400): n is a, c, t, g, unknown, or other
  misc_feature (402)..(402): n is a, c, t, g, unknown, or other
  misc_feature (443)..(443): n is a, c, t, g, unknown, or other
  misc_feature (476)..(476): n is a, c, t, g, unknown, or other
  misc_feature (478)..(478): n is a, c, t, g, unknown, or other
  misc_feature (623)..(623): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (634)..(634): n is a, c, t, g, unknown, or other
  misc_feature (637)..(637): n is a, c, t, g, unknown, or other
  misc_feature (638)..(638): n is a, c, t, g, unknown, or other
  misc_feature (653)..(653): n is a, c, t, g, unknown, or other
  misc_feature (654)..(654): n is a, c, t, g, unknown, or other
  misc_feature (656)..(656): n is a, c, t, g, unknown, or other
caacacgctggagctccccgcggtggcggccgctctagaactagtggatcccccgggctgcaggaattcgcacgagaccatacctagaacatcctaatcgaaaaatacgccgccatcttcgcaagccaccgcaaccgaagcccgccttcgccgccgccgcctctgcgatccccgcaaggtcgcaaacatgtttaccgtgctccagcgcccgacccccggcacggtccagtgcttcggccgcaagaagacggctgtggccgtcgcctacaccaagccggggcgcgggctgatcaaggtgaacggcgtcccgattgagctcatcatgccggagatgctccgcctcaaggccttcgagcccatcttgttggcgcccccccccgggtggggggagggggacctnangatcccccccccacccggttggaatacctcccaaaaatacnccctcccgccgggcgggcgccaagaggctccgncnccaattatcaagaaggacgttcaacaagggccgcaaaaaaggaggtcagaggaattctttccccgggaagaatcgccccctttttcgtcccccaacccagggggttcccaacccaaaaaaacccggtggcccccgcacccccccncaccnnnnncnaannccccaccgccggganngntacaaatgggcccgcctccggggcaccaatggaccgtggttcccccacccccccccgtccctcgcctttacccaccgcttaacttatctttccctgggcgcactcctgtgccagcctttatactgcacccacc

SEQ ID NO: 45995 - DNA, 617 bp, Zea mays
  misc_feature: Ceres CLONE 1450825
  misc_feature: Encodes the peptide sequence at SEQ ID NO. 45996
agcttagctccagtcctcgcacgcacactgtccactctctctgcccccctccacctccacctccacctccatgcatgggatgggcagtcaaagaaggcttctcctcctcctggctctcctcctgctgacgctggtcgccggagaaggcgacggcgcactgtccggcgccggcagcacggccacggacgacggggccaatgccaccgacgctagcccaccggccggcgcgccgctcgacgtgcgggcaaggaagtggtggcggttcccggcgacggaaggcctcgtcacgggcagcgagcggagggtgcccaactcgtcggaccccctccacaaccgctgaagcgcctgtgtcagccgcgctgccattcgtgctgcttcgacctctgctgttagttatacataccgtacctctggtcgcatgctttttggctgcacaacaatgtggcttggtattcagacttcagagaatttaattgcgtatacgagtaaatgtagctgattttggtctagctggtttgccgtttcgaccgcttgtaaacacaaattcgtcggcagtttacaccgtgccgtgtgtatataaattccctgaaatctgtgtcttaaaaaaaaaaaaaaaa

SEQ ID NO: 45996 - protein, 89 aa, Zea mays
  misc_feature: Ceres CLONE 1450825
MHGMGSQRRLLLLLALLLLTLVAGEGDGALSGAGSTATDDGANATDASPPAGAPLDVRARKWWRFPATEGLVTGSERRVPNSSDPLHNR

SEQ ID NO: 45997 - DNA, 764 bp, Zea mays
  misc_feature: Ceres CLONE 1450827-F
  misc_feature: Translation starting site: 204
  misc_feature (358)..(358): n is a, c, t, g, unknown, or other
  misc_feature (585)..(585): n is a, c, t, g, unknown, or other
  misc_feature (686)..(686): n is a, c, t, g, unknown, or other
  misc_feature (728)..(728): n is a, c, t, g, unknown, or other
  misc_feature (750)..(750): n is a, c, t, g, unknown, or other
aagctggagctccccgcggtggcggccgctctagaactagtggatcccccgggctgcaggaattcgcacgagaccattacctagaacatcctaatcgaaaaatatatccacacctgagtcccctccgccgcctgccgcactctcctgcgacgccacaaccacacgttcacggtagcgagagcttatcgtcgtcggcggtgaagatggtgtcgctgaagctgcagaagcggctcgccgctagcgtcctcaagtgtgggaaaggcaaagtctggcttgaccccaatgaagtcagcgagatctccatggctaactcccgccagaacatccggaagttggttaagaatgggtttatcatcangaagcctcagaaagttcactctaggtcccgtgcaagaagggcacatgaggccaagcagaagggaaggcactctggatacggcaagcgcaggggtaccagggaagctaggctccccacaagattctgtggatgaggaagatgcgtgttctgaggcgcctgctccgcaagtaccgtgaggccaagaagatcgacaagcacatgtatcatgacatgtacatgaaggtcangggtaatatgtttaagaaacagagggtgcttatggagagtatccacaagtccaaggctgagaaggccagagagaagacactttctgatcagtttgaggccnagcgtgcaaggagcaaggcagccgtgagagaaaaattgctangagggaggaaaggctggcccanggcccagagaacca

SEQ ID NO: 45998 - DNA, 762 bp, Zea mays
  misc_feature: Ceres CLONE 1450829-F
  misc_feature: Encodes the peptide sequence at SEQ ID NO. 45999
  misc_feature (363)..(363): n is a, c, t, g, unknown, or other
  misc_feature (366)..(366): n is a, c, t, g, unknown, or other
aaagctggagctccccgcggtggcggccgctctagaactagtggatcccccgggctgcaggaattcgcacgagaccattacctagaacatcctaatcgaaaaaaaagccgaaagcccgaaaccagaggcgggtagggttctagctgcaggcgacggccatggccgcctccgccgccgccccggcgctgcttcgacgcctcttctgcagctctattccagcctcctcctccgtactgcgcgctaccttttgctcctccgccggcttcggctcgtcttctccgtcctccatattcggcgacgccaccgaggtcgccaacgtgccaccgctcaccacgcccaacctcttcgtcagtggcctttcanggntaacgacagatgagaagctccagggtgcatttgctcctttcgggaggctccttgaagcaaaagtggtgacggatagagtttctgggaggtcaaagggtttcggtttcgtgagatatgccaccatagaagagccgagagagcgcgccaggaaaatgacgcccaagttcctgaatggatgggtcatcttcgttgacccgcccaggcaagggagcccaagcccgctcctcagcaggaccctggtttcatccatgctggcttcccgacaaacaaactgtaagatggggcgcctaaggctcattgatctgccccgaatttccggcccaaaattggattggcggggtggactctagggttttaccccccccgaaaatttttaaattttttaaaaaacccgta

SEQ ID NO: 45999 - protein, 185 aa, Zea mays
  misc_feature: Ceres CLONE 1450829-F
  misc_feature (62)..(133): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (69)..(69): Xaa is any aa, unknown, or other
  misc_feature (70)..(70): Xaa is any aa, unknown, or other
MAASAAAPALLRRLFCSSIPASSSVLRATFCSSAGFGSSSPSSIFGDATEVANVPPLTTPNLFVSGLSXXTTDEKLQGAFAPFGRLLEAKVVTDRVSGRSKGFGFVRYATIEEPRERARKMTPKFLNGWVIFVDPPRQGSPSPLLSRTLVSSMLASRQTNCKMGRLRLIDLPRISGPKLDWRGGL

SEQ ID NO: 46000 - DNA, 884 bp, Zea mays
  misc_feature: Ceres CLONE 1450830-F
  misc_feature (12)..(12): n is a, c, t, g, unknown, or other
  misc_feature (44)..(44): n is a, c, t, g, unknown, or other
  misc_feature (440)..(440): n is a, c, t, g, unknown, or other
gtgtgtggattncgcttgtacacaccatccccccttttttttanaaaaaaaaaactggggctccccgcggtggcggccgctctagaactagtggatcccccgggctgcaggaattcgcacgagaccattacctagaacatcctaatcgaaaagtcactgcgcccgaatccctacgaacccccaccaaacggaatttcacatccagcgagcaataccgcaccgcaggtaagatcaaagaggaggcgatggctggcggcgggcaggcggcgattccgtccatgacccgcatggcaaaggtggcggcggcgttgggcgtgggaggggccagcagacctccacctcctactacacggtggacgggcgaaaagcgcgccggtcatcttcgataacgtccgcgggcgagctccccgcgtaacgatggagagagggggtttttaaanaattgataactaatcccccccaaaggcccgttcgttttcccccctgtcggtatttgggccttaacagcttttgtccttccaaccttccgggcacccaaagggaccttccaagatggggtccagccctcaacggcttcgggggttccttggtgggggaacccgcacgggtcaaaacaacccttgccggggaaacatcctgccacccctcccctccggggcttcggaattccccattgaggaaaggtgtcctccccaatcacatcggggaaagggaggggggttaaaaaggcccataacgtgtcccccatttttaaagagcgagaccaggcgccctcccccgggggcggtcctccatgggccctcgcacgcctcggtcccgacgaagatgctctccaccaagccggtggtcgtgcaaggattctaacatgggcctctcgcaacaga

SEQ ID NO: 46001 - DNA, 702 bp, Zea mays
  misc_feature: Ceres CLONE 1450832-F
  misc_feature: Encodes the peptide sequence at SEQ ID NO. 46002
  misc_feature (387)..(387): n is a, c, t, g, unknown, or other
  misc_feature (549)..(549): n is a, c, t, g, unknown, or other
ggagctccccgcggtggcggccgctctagaactagtggatcccccgggctgcaggaattcgcacgagaccattacctagaacatcctaatcgaaaattacactgggtgaccatcatcatcagtaactaataattactttagattagaagcaaagggaagcgaagcaagaatcgatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaagatcaacgccttcttcctcgnacaggaggaggagttcatcatccgccaccgggagctgcagaaccacatcgagcgcgcgctgggccgcggcaggccggcgccggcgccggcgctgcacgaggccgaggtcgcccgcatccgcagggagatcgtcaacttccacggcgtcatggtgctgctccntcactacagcagcatcaactacataggtaggacttaggagctctagctctagctagctagctgtacggagttgaattgaaagcctgcaggtctgtccttttgccatgcatgtctccctctcatgcatgatgattctaaccatccccgtccatc

SEQ ID NO: 46002 - protein, 132 aa, Zea mays
  misc_feature: Ceres CLONE 1450832-F
  misc_feature (2)..(133): Pfam Name: SPX Pfam Description: SPX domain
  misc_feature (67)..(67): Xaa is any aa, unknown, or other
  misc_feature (121)..(121): Xaa is any aa, unknown, or other
MVQFGKWLRRQIERSLPEWQDQFLRYKELKRCVKARSGGCPPLPAEEAEFVAEIDAETEKINAFFLXQEEEFIIRHRELQNHIERALGRGRPAPAPALHEAEVARIRREIVNFHGVMVLLXHYSSINYIGRT

SEQ ID NO: 46003 - DNA, 766 bp, Zea mays
  misc_feature: Ceres CLONE 1450833-F
  misc_feature: Encodes the peptide sequence at SEQ ID NO. 46004
  misc_feature (338)..(338): n is a, c, t, g, unknown, or other
  misc_feature (372)..(372): n is a, c, t, g, unknown, or other
gtggatcccccgggctgcaggaattcgcacgagaccattacctagaacatcctaatcgaaaaccgggttctggctcgccaaaccctagccgccgagtgccgcccactggcccgcccgccctccgccgcgcgtcggacggtgccgagggaagaggcaccatgaggttggagaagtgctggttctgctcctctaccatctaccccggccatggaatccagttcctccgcaacgacgccaaggtcttccgcttttgccggtcaaagtgccataaaaacttcaagatgaagaggacccctcgtaaggttaattggacaaaagcatacaggtatttgtattgncaagaacatgacccaggatacaatctttgagttngcccccactaagaacaggcccgagcgctacgaccgtaattttggctaaccacactctaaaggctatcccgcttatttgcaaaaattaggcatgatcgtatggggaaaacccttctcaaacataccttaaccttggtaaaccaaggagatggaaaaggcctcctaggggcttggaacaggaaatttcacttgctccccaaagaacttttttattcacccttcttgccggttgaaacaaccaaaggtccagggtgtgatttttgttccccaccaaaaaataaaaataaccgtctttgtaaaagttaagtgcgcggggatttttctggggaccttggtgatttacaatggtcctgaaagccagaaccctttttctcttttttcgccgtcaacaacat

SEQ ID NO: 46004 - protein, 69 aa, Zea mays
  misc_feature: Ceres CLONE 1450833-F
  misc_feature (1)..(65): Pfam Name: Ribosomal_L24e Pfam Description: Ribosomal protein L24e
  misc_feature (60)..(60): Xaa is any aa, unknown, or other
MRLEKCWFCSSTIYPGHGIQFLRNDAKVFRFCRSKCHKNFKMKRTPRKVNWTKAYRYLYXQEHDPGYNL

SEQ ID NO: 46005 - DNA, 802 bp, Zea mays
  misc_feature: Ceres CLONE 1450834-F
  misc_feature: Encodes the peptide sequence at SEQ ID NO. 46006
  misc_feature (360)..(360): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (624)..(624): n is a, c, t, g, unknown, or other
ggagctccccgcggtggcggccgctctataactagtggatcccccgggctgcaggaattcgcacgagaccattacctagaacatcctaatcgaaaaatactagcggatcctggcccgatccctcttcccaccccacccacctccgcttctctccaagtgaggaaccccaagccctcgccatggtgtcgcggatcctggcccgatccaaggaccttcccctcgtcgccgccctcacccctgccgctgccaaagcagcaacgcctatcgccggagcccgcgcgctctcgtccctgccccgctacgcgtctgccccgtcgccccatgggctcggcaatgttctgggatatgaaccgacatttnattttattaaaccacaagttttacctccatggttttcatctcaaccccccactgaatctcacgtgcacaattcacatattctctgaaacgtaccacctccagcaggagaaatgaaacactcttgacacccggaaatgcaagtgagggaacccccggcaaaaggttgtggcgctccacccccctagaagacagccatccgttataccttaaaaataagtcccctggccaagggaatatttctcacaccagcggcccgnnnncggntagcaacctcaagttcgcctttttaccatggatcccagccccttggttctcctggcctccacaaaaccggaccaaaagatccctccgcctttccgtgggcggggccccgggttcccaccaaaggatcatcgtggttccccacacgggaagttccttcttgtgtcctctctcgcccctg

SEQ ID NO: 46006 - protein, 88 aa, Zea mays
  misc_feature: Ceres CLONE 1450834-F
  misc_feature (61)..(61): Xaa is any aa, unknown, or other
MVSRILARSKDLPLVAALTPAAAKAATPIAGARALSSLPRYASAPSPHGLGNVLGYEPTFXFIKPQVLPPWFSSQPPTESHVHNSHIL

SEQ ID NO: 46007 - DNA, 752 bp, Zea mays
  misc_feature: Ceres CLONE 1450835-F
  misc_feature: Encodes the peptide sequence at SEQ ID NO. 46008
ctggagctccccgcggtggcggccgctctataactagtggatcccccgggctgcaggaattcgcacgagaccattacctagaacatcctaatcgaaaactccgaaaagcaagctccggcccggaccgccccaccgcgcgcgcgcatacacagagagagagagagagaccgcacggtcgttcggggttcctttggccaggcgcacgacacgagcatggcgcagcgcgacaagaaggaggagcccacggagctgcgggcgccggagatcgcgctctgcgccaacaactgcggcttcccgggcaacccggccacgcagaacctgtgccagagctgcttctcggcgtcgaggtcgtcgtcgtcgtcttcgtagccgtcccctacctcctctccctcagcttccgcgccggccgcccccctgccgcagccgagccggggctcctggacgcggcgctgcagctggcgcctcggccgcggcccgcggccaacctgtggaggcctggccaggacttctggcacacgggctccaactgccgaaaccccgtggggttgacgggttcccggggccttggggaaaattgtttgggggccccaccggttctcgaccgcccggtgtgcttaaaaataagggggcccccccggaaccctctccccggaaaaaccgggggggcgcccgcaaaaatattttggttttattcccccggggggggggggaaaattttttaaagggaaaaaaaaattcctcggggggggggg

SEQ ID NO: 46008 - protein, 51 aa, Zea mays
  misc_feature: Ceres CLONE 1450835-F
MAQRDKKEEPTELRAPEIALCANNCGFPGNPATQNLCQSCFSASRSSSSSS

SEQ ID NO: 46009 - DNA, 792 bp, Zea mays
  misc_feature: Ceres CLONE 1450838-F
  misc_feature: Encodes the peptide sequence at SEQ ID NO. 46010
  misc_feature (345)..(345): n is a, c, t, g, unknown, or other
gctcatgaactagtggatcccccgggctgcaggttttcgcacgagaccattacctagaacatcctaatcgaaaaacgcaacaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgctgcgccacaaccccgtccacaagaaggtgcccgtgctcgtccacggcggccgcgcgctctcgttttttnacattatcctccagtaccttgacaacgcctggctggtatacccccccgctgctccccgcccgaagccttcaaccgcgcgcatctcgcggtttctggggcccactttcaccgacaacaagctccgggccgggcggatgggcgccggttttcctccccccacagggggaaggccccataaggcggctggtgcctgaaaggggcaccaagaaacctggcctctgaatcgaagttccaaacttccccgaacgcgcgcgttccggggggctgccgctttctttcggcggcccaaccaggggggccttgctggaacgtctgtccctggggctggcgtcttcttcatgggttccgccctggttccaaaaaagatgaccgggggttgcccccttctttgaagccttgacccttttcctgctgttttcccgcccgcggtggccccacattccaggg

SEQ ID NO: 46010 - protein, 142 aa, Zea mays
  misc_feature: Ceres CLONE 1450838-F
  misc_feature (14)..(87): Pfam Name: GST_N Pfam Description: Glutathione S-transferase, N-terminal domain
  misc_feature: SWISSPROT Homolog: EC 2.5.1.18 Glutathione transferase
  misc_feature (79)..(79): Xaa is any aa, unknown, or other
MEKTSENAIPPAASPLMLFGSWASSYTHRVQLALRLKGLEYDYVEEDLGNKSDELLRHNPVHKKVPVLVHGGRALSFFXIILQYLDNAWLVYPPAAPRPKPSTARISRFLGPTFTDNKLRAGRMGAGFPPPTGGRPHKAAGA

SEQ ID NO: 46011 - DNA, 719 bp, Zea mays
  misc_feature: Ceres CLONE 1450841-F
  misc_feature: Translation starting site: 122
  misc_feature: Pfam Name: tRNA_bind Pfam Description: Putative tRNA binding domain
  misc_feature: SWISSPROT Homolog: EC 6.1.1.1
  misc_feature (408)..(408): n is a, c, t, g, unknown, or other
  misc_feature (440)..(440): n is a, c, t, g, unknown, or other
  misc_feature (508)..(508): n is a, c, t, g, unknown, or other
ccccgcggtggcggccgctctagaactagtggatcccccgggctgcaggaattcgcacgagaccattacctagaacatcctaatcgaaaactttcaattacctgcttccggcagcggtacgatggccgctgcgagaatggcgctcgtctcttgcgcccgccgcctcccgtccttaccctctccgctcaccctctcgaggccccgcgccggcgccgtctcatttctggctgcccagccgtcgccggcgacggcaccgagatccggcaggaatcttgctctcttctgttctttatcaccgacgtcgccatcgctaactgaggccgccgtagcactgccgccaccgaaggctgcggtggaagagacgaagcctcctgtgccgagcggggacgagaagggggaccgactgtnggagagctagcgggcctgctggacgtccgggntggccgagtggtgaaaggcgtgaagcaccccggaggcgacaccctctacgttgaagaggtggacgtangtgaagcggagccccgggacatctgcagcggcctcgtcaacttctccccatcgaagaactccagacggaacgtcattgttctggctaccctcaaccaaggacctgcgtgcatcaatcaaagggaggcccagggcgcccctgagcttccccagaaaaggggacttgcctcccttcaaaagttctttcttggaaaaaaattggtccgttccaa

SEQ ID NO: 46012 - DNA, 893 bp, Zea mays
  misc_feature: Ceres CLONE 1450846-F
  misc_feature: Encodes the peptide sequence at SEQ ID NO. 46013
  misc_feature (893)..(893): n is a, c, t, g, unknown, or other
ccccgcggtggcggccgctctagaactagtggatcccccgggctgcaggaattcgcacgagaccattacctagaacatcctaatcgaaaaatccatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacatcgtcggtggcgccgtgcctcgggtacccgatgggcagcgcggcgttagccttcttccccctgctgcaaccggggtgcccctcgctcaaaaggcgctcccccctctaatggtggaaccggtaaggccaccctggaaaatggcctcaaagaacattaaaacggcccggccccgggccggggggggtcaaaaatgtgccaaaacgccgcccaaaaatcccccttccaaggggcgggcggtcctccggtcgggggtggcccacattaagcccccccaccgtgtgaattgggcccaagaagatacaatttgaattcgatgggaaccccttatgtgagagagtagacctccccctctctgggaaatgggaaaacgaaaccttggctccaatcaaaacaaaatggcaaatcttattctctcaataacaaaaaatgggccacaaactcacgcaggggtgggccgacagccaccaacaaaaggggggcgcttatataagatgaagcgtaaatcctggcctcccacccccccgatgatggaacacactctctgtctcaaggggcgcaccctccgcggcttccaccctcgagtgatan

SEQ ID NO: 46013 - protein, 78 aa, Zea mays
  misc_feature: Ceres CLONE 1450846-F
MAARSSSSQPQLVAAAAVLAAALLLLAAGAGTASAAVSCGEVTSSVAPCLGYPMGSAALAFFPLLQPGCPSLKRRSPL

SEQ ID NO: 46014 - DNA, 742 bp, Zea mays
  misc_feature: Ceres CLONE 1450853-F
  misc_feature: Encodes the peptide sequence at SEQ ID NO. 46015
ctggagctccccgcggtggcggccgctctagaactagtggatcccccgggctgcaggaattcgcacgagaccattacctagaacatcctaatcgaaaaacgcacagccgcggagccgccagagacagacgctgccgccgtcggccgtcctccgccctccagtccgctgctcgcccgaccggagtgaggcggcgcggcgatggagcacgggtcgttgacagactcgacgtcgtcgactttctccatcatggatgaggaccacaccctcgccaactccgccagattcgtcctcaaccaggacccaagggtagcattttgtggatataccatccctcatccttctgagaagaaagtgaacataagacttcagacgacaggagatgcagcaaaggatgtactgaaagatgccttgcaaaatctgatgattatgtgccagcatgtcagagggacaatggacacccgcgtggttaccatagagcaaaaatgctgcaaaagaatggatgttgatcagaactagaatgaacgcagtgtttgttgagaccaacacaatatcattacagcttttagtactggtcagaagctcggagagctcagtcattgttccagttgtttgtaggattaccggtcgtatccattggcttccacttctgcaatactgaaacttcttcaggttactgcataaaaaaaaaaaaaaaaagcttatcgatcccttccacctcgaagggggggcccggtaccccatt

SEQ ID NO: 46015 - protein, 105 aa, Zea mays
  misc_feature: Ceres CLONE 1450853-F
  misc_feature (8)..(83): Pfam Name: RNA_pol_L Pfam Description: RNA polymerase Rpb3/Rpb11 dimerisation domain
  misc_feature: SWISSPROT Homolog: EC 2.7.7.6 DNA-directed RNA polymerase
MEHGSLTDSTSSTFSIMDEDHTLANSARFVLNQDPRVAFCGYTIPHPSEKKVNIRLQTTGDAAKDVLKDALQNLMIMCQHVRGTMDTRVVTIEQKCCKRMDVDQN

SEQ ID NO: 46016 - DNA, 680 bp, Zea mays
  misc_feature: Ceres CLONE 1450858-F
  misc_feature: Encodes the peptide sequence at SEQ ID NO. 46017
  misc_feature (409)..(409): n is a, c, t, g, unknown, or other
  misc_feature (496)..(496): n is a, c, t, g, unknown, or other
  misc_feature (563)..(563): n is a, c, t, g, unknown, or other
  misc_feature (658)..(658): n is a, c, t, g, unknown, or other
ctggagctccccgcggtggcggccgctctagaactagtggatcccccgggctgcaggaattcgcacgagaccattacctagaacatcctaatcgaaaaacgagacaaagggcctcacgctttccacatcgacacaaaaaccaaccgccgccacctccctccgctcgcgctagctgtgtgcgttccttgcctgccacaactccagcacttggagtcttcgacgacgacgatgacgacgacggcaggggaggagaaagagaacaggcgggcgggtcatccatggagacggaggaggagacgacgcccaaggcgaagaagcggccgcagtcgctactcgggagcctgcgggaggcgatcaccaaggtccggttcctgctctcctccagcgcgacgcggtggatgctgctcangtccctggcccgcggcggcggcagcggcggcgccccggcgcggcgcctcagcttcgacgcgcgaccgggcctgctcgacaccatcgncgcgtcgccgacctcctcctgcagctcccagacctccagtcggccagcctgggcacggcgaccaccngaacctgtcgcgggcagcagcgcgcgtccccgaagcctgacaagggctcgtcgtcgtcgggggccgctccccgggtcttcgccggggaagacaantcaacaaggcggcaaggtctca

SEQ ID NO: 46017 - protein, 134 aa, Zea mays
  misc_feature: Ceres CLONE 1450858-F
  misc_feature (44)..(44): Xaa is any aa, unknown, or other
  misc_feature (73)..(73): Xaa is any aa, unknown, or other
  misc_feature (127)..(127): Xaa is any aa, unknown, or other
METEEETTPKAKKRPQSLLGSLREAITKVRFLLSSSATRWMLLXSLARGGGSGGAPARRLSFDARPGLLDTIXASPTSSCSSQTSSRPAWARRPPEPVAGSSARPRSLTRARRRRGPLPGSSPGKTXQQGGKVS

SEQ ID NO: 46018 - DNA, 744 bp, Zea mays
  misc_feature: Ceres CLONE 1450859-F
  misc_feature: Encodes the peptide sequence at SEQ ID NO. 46019
  misc_feature (396)..(396): n is a, c, t, g, unknown, or other
  misc_feature (425)..(425): n is a, c, t, g, unknown, or other
  misc_feature (428)..(428): n is a, c, t, g, unknown, or other
  misc_feature (496)..(496): n is a, c, t, g, unknown, or other
  misc_feature (497)..(497): n is a, c, t, g, unknown, or other
  misc_feature (555)..(555): n is a, c, t, g, unknown, or other
  misc_feature (716)..(716): n is a, c, t, g, unknown, or other
tggagctccccgcggtggcggccgctctagaactagtggatcccccgggctgcaggaattcgcacgagaccattacctagaacatcctaatcgaaaaacaagattccctctccagcggcgcaccaccgctaccatcctccgacccccaacccgaacccgccatgtcaccggcgccgtcgcgcccccgcatccgtccgtggctggtggtgggtgacctggcactggcggccgcgtgggtttgcgcgggcgcgctggtcaagctgctcgtttacggcggactcggcctcgggggacggcccgaggccgaggccgtcaaggtctcgctctccctcgtatacatgttcctcttcgcctggctcgaggctgcctcgggtggggcctcctacaatccgctcnacgtcctcgccgctgccctcgccttccanggnggaaccgccgtgtacctgttcaccgcgttcgcgcgaatcccagctcaggtgattggggcggttcttgnnagtaagctcattcaagtaactttccctaatgtgggtaaagagcccgcttaagtgtggntgctcatcatggtgcgttagctgaaggcttagcaccttcatggtttgtatggtatcggtgaccctgaaaaagaagaaatgaaaagttctttatgaagactggatcacagcatttgaaagaacccattcctcctcttaactccgaataactggagggatatngaccctgctcctgcttttgctgggctaa

SEQ ID NO: 46019 - protein, 128 aa, Zea mays
  misc_feature: Ceres CLONE 1450859-F
  misc_feature (79)..(79): Xaa is any aa, unknown, or other
  misc_feature (88)..(88): Xaa is any aa, unknown, or other
  misc_feature (112)..(112): Xaa is any aa, unknown, or other
MSPAPSRPRIRPWLVVGDLALAAAWVCAGALVKLLVYGGLGLGGRPEAEAVKVSLSLVYMFLFAWLEAASGGASYNPLXVLAAALAFXGGTAVYLFTAFARIPAQVIGAVLXSKLIQVTFPNVGKEPA

SEQ ID NO: 46020 - DNA, 749 bp, Zea mays
  misc_feature: Ceres CLONE 1450861-F
  misc_feature: Encodes the peptide sequence at SEQ ID NO. 46021
  misc_feature (469)..(469): n is a, c, t, g, unknown, or other
ggagctccccgcggtggcggccgctctagaactagtggatcccccgggctgcaggaattcgcacgagaccattacctagaacatcctaatcgaaaaacacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggaaacgcgtcggcgcggtgagctgcggcgaggtgacgtcgtcggtggcgccgtgcctcgggtacgcgatgggcagcgcggcgtcgccctcccgcgcgtgctgcagcggggtgcgctcgctcaacagccgcgcgtcgtcgacggcggaacggcaggccacctgcaactgcctcaagagcatgacgggcccgctcggcggcngcgtcagcatggccaaacgccgcaacatcccctccaagtgcggcgtctccgtcggggtgcccatcagccccaccgtcgactgcaccaagatcaactgatcgatggaaccctagtggaagtaactcgctcgttggatgcagcgtacgtgggcatcagcagcatgcagtcgtcgtcctaacagagatgtctaactaccgggggtcatgcatcaaactggccataaaaaaaagtaaatctgcccccacccactagggatcacttcgctagggcccctcccgcc

SEQ ID NO: 46021 - protein, 129 aa, Zea mays
  misc_feature: Ceres CLONE 1450861-F
  misc_feature (39)..(125): Pfam Name: Tryp_alpha_amyl Pfam Description: Protease inhibitor/seed storage/LTP family
  misc_feature (98)..(98): Xaa is any aa, unknown, or other
MAARSSSSQPQLVAAAAVLAAALLLLAAGAGKRVGAVSCGEVTSSVAPCLGYAMGSAASPSRACCSGVRSLNSRASSTAERQATCNCLKSMTGPLGGXVSMAKRRNIPSKCGVSVGVPISPTVDCTKIN

SEQ ID NO: 46022 - DNA, 763 bp, Zea mays
  misc_feature: Ceres CLONE 1450862-F
aagctggagctccccgcggtggcggccgctctagaactagtggatcccccgggctgcaggaattcgcacgagaccattacctagaacatcctaatcgaaaaacctccgccgccgtttccccgcgtgctttctctctctctcgatctcgagcgacgactcggttacagccgccgtcctacgccaggttccaggtcttcgtcgggcccttctccggcaacgagcaccaacaagatttttgtgtgtaaagatttgcgagcaccattcacttttacatcagtgtgaaataaaacacttcaagcatgagctctcaccgtgtaaaggggaatgaggacaatttgtatgaatatgagtcaaacaaacgggtgaggcacacaatacggaggccaagaacccatatcccccatggaaacccaccccggacattggtcgccaaaccgtcctttcaaaaaaggttttgttaaactgtgccggttaaacttatttaaacgcctaaagggggggggtttttccgcaattaaattttcaagaggaagggggggggggttcccaaaaaaagaacacaagcccctaaaataaaggtgttcccccgagggcacaccaaaaggggtttttttaggggatctcccccccccccacaaaaaacccccccggggtataggatattaaaagttggtccccttttcgggggggggggggagagaaataaaaacccccccctctcccaaaaaaggggggtggggggagcggggggttttttatcacc

SEQ ID NO: 46023 - DNA, 747 bp, Zea mays
  misc_feature: Ceres CLONE 1450869-F
  misc_feature: Encodes the peptide sequence at SEQ ID NO. 46024
  misc_feature (346)..(346): n is a, c, t, g, unknown, or other
  misc_feature (386)..(386): n is a, c, t, g, unknown, or other
  misc_feature (387)..(387): n is a, c, t, g, unknown, or other
  misc_feature (393)..(393): n is a, c, t, g, unknown, or other
  misc_feature (394)..(394): n is a, c, t, g, unknown, or other
  misc_feature (431)..(431): n is a, c, t, g, unknown, or other
aaagctggagctccccgcggtggcggccgctctagaactagtggatcccccgggctgcaggaattcgcacgagaccattacctagaacatcctaatcgaaaacttcactggagccagcttggtcggttcgtttaccaccaaagcgccccgcaaaatctcgccgccgaccgccatggcagccgccgacgagacgcgtccgctgctcgttgctatatctctcgccgtagccgcctgctgcctcgcgcagctggcggtgggggacacgaacggcgtctacgagccgtgcagtgacgcacggatccagcgcggggacggcttcaccttcggggtggtcttcgccggatancacgccttcttctccggcaacacacagctcttcccctcgnnacgcgnnctcaactcgctgcctccgggcagctcgccgtcttccngcccaaagtcgacgagatctccctcctcacatcaacaccactaccggattcaccaagcttcagctggtggattcatggtaacatttgcccgcagggagtatgcacctagatctaatccgaattttggatccaaacctcagtcccagtgcccagtttccaccgggcctttggtttcaaaaagggcgaaccccaaaacttgctgtgaaaaggacggtgtggcctttgccccgaaaataaaattttttgcgctcgaaaaaaaattggcccttggacccaaattgaaaaaaaagggccccctaaagggggggggacccac

SEQ ID NO: 46024 - protein, 191 aa, Zea mays
  misc_feature: Ceres CLONE 1450869-F
  misc_feature (58)..(58): Xaa is any aa, unknown, or other
  misc_feature (72)..(72): Xaa is any aa, unknown, or other
  misc_feature (74)..(74): Xaa is any aa, unknown, or other
  misc_feature (87)..(87): Xaa is any aa, unknown, or other
MAAADETRPLLVAISLAVAACCLAQLAVGDTNGVYEPCSDARIQRGDGFTFGVVFAGXHAFFSGNTQLFPSXRXLNSLPPGSSPSSXPKSTRSPSSHQHHYRIHQASAGGFMVTFARREYAPRSNPNFGSKPQSQCPVSTGPLVSKRANPKTCCEKDGVAFAPKIKFFALEKKLALGPKLKKKGPLKGGGP

SEQ ID NO: 46025 - DNA, 927 bp, Zea mays
  misc_feature: Ceres CLONE 1450875-F
  misc_feature: Encodes the peptide sequence at SEQ ID NO. 46026
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (415)..(415): n is a, c, t, g, unknown, or other
  misc_feature (419)..(419): n is a, c, t, g, unknown, or other
  misc_feature (490)..(490): n is a, c, t, g, unknown, or other
  misc_feature (526)..(526): n is a, c, t, g, unknown, or other
  misc_feature (527)..(527): n is a, c, t, g, unknown, or other
  misc_feature (532)..(532): n is a, c, t, g, unknown, or other
  misc_feature (533)..(533): n is a, c, t, g, unknown, or other
  misc_feature (603)..(603): n is a, c, t, g, unknown, or other
  misc_feature (661)..(661): n is a, c, t, g, unknown, or other
  misc_feature (662)..(662): n is a, c, t, g, unknown, or other
  misc_feature (682)..(682): n is a, c, t, g, unknown, or other
  misc_feature (760)..(760): n is a, c, t, g, unknown, or other
  misc_feature (761)..(761): n is a, c, t, g, unknown, or other
  misc_feature (765)..(765): n is a, c, t, g, unknown, or other
aggggggccacccccccccaagagnnnnnnccctcnccnncccaaactggagctcaccgcggtggcggccgctctatactagtggatcccccgggctgcaggatttcgcacgagaccattacctagaacatcctaatcgaaaaaatcacaacctccacgaccaacgaggcaacgaccaaacccttccccctccctagctccgtgctccagcgggagtccgcggcggcggtgaagatgattatcccagtgcgctgcttcacctgcggcaaggctattgggaacaagtgggatgtctacctggacctcctccaggccgactactcgaaaggggatgctctggatgctttggaattgttccgatactgctgcacgcgaatgctcatgacacatgttgacttgatttgagaggttggtnaaanaccccccccttagaggaccacccaagtgtaggtggaggcccactgtgtgttgtgtcgaaaaaacacttatnggttctccccaccacccatagaactacacaccaaannaccanncaccaccatccccccttcacctcaaaaaattgcgaatacatcaaagcatacaaccatggctataatgggntaatggaaccactaccaaagggatatttttcaatggggggtcaatgtcaattgatttnnctactcctaataccaatcgnagagataagactcttttctcaaaccaacacttgtaatttggctgttctggagagcgctttatgagctctccccccacnncacncacacccaacccacagggtcttctccaaatatcttatataactcaatcagggagtggacctcgatacgcacaatcaacccgcgaaaaaggggggcacgattactcacctacggttgaacagcgaccggcatactcccacaaactgcgacaatacgccacact

SEQ ID NO: 46026 - protein, 56 aa, Zea mays
  misc_feature: Ceres CLONE 1450875-F
  misc_feature (1)..(56): Pfam Name: RNA_pol_N Pfam Description: RNA polymerases N / 8 kDa subunit
  misc_feature: SWISSPROT Homolog: EC 2.7.7.6 DNA-directed RNA polymerase
MIIPVRCFTCGKAIGNKWDVYLDLLQADYSKGDALDALELFRYCCTRMLMTHVDLI

SEQ ID NO: 46027 - DNA, 764 bp, Zea mays
  misc_feature: Ceres CLONE 1450886-F
  misc_feature: Encodes the peptide sequence at SEQ ID NO. 46028
  misc_feature (496)..(496): n is a, c, t, g, unknown, or other
  misc_feature (526)..(526): n is a, c, t, g, unknown, or other
  misc_feature (599)..(599): n is a, c, t, g, unknown, or other
ggagctccccgcggtggcggccgctctagaactagtggatcccccgggctgcaggaattcgcacgagaccattacctagaacatcctaatcgaaaagcctccgccggctcccccactcagaaaacccagccgccgccgcatcggcctcccaggtaagcagtagcgtccaccccagccgccgccatgaagcgcaacccccgcgtcacgagctcccgccggaagtgccgcaaggcgcacttcacggccccgtcctccgtccgccgcgtgctcatgtccgcggcgctatcgacggagctccgccacaagtacaatgtgcgttccatcccgatccgcaaggacgacgaggtgcaggtcgtgcgcggcacctacaagggccgtgagggcaaagtggtgcaggtgtaccgccgtcgctggttcatccacgttgagcggatcacccgcgagaaggtgaacggctccaccgtgaacgtgggcatccacccttccaggtcatggntacaaagctgaagcttgaccaggaccgcanggcgctcctcgacggcagggcccggggccgcgcgccgaacaggctaagggcaagtttactggcgacgacgtcncccccgctgctggtggcgccgcgccactggcgcgtctctccaggagatcgactaggcgcttcgcggggatctgaagggggtccacccgcctattacccctaaccgcccagattttgctatcaatgattaagggctaggatttttatgttacttaaaaacggcttg

SEQ ID NO: 46028 - protein, 107 aa, Zea mays
  misc_feature: Ceres CLONE 1450886-F
  misc_feature (51)..(82): Pfam Name: KOW Pfam Description: KOW motif
  misc_feature (105)..(105): Xaa is any aa, unknown, or other
MKRNPRVTSSRRKCRKAHFTAPSSVRRVLMSAALSTELRHKYNVRSIPIRKDDEVQVVRGTYKGREGKVVQVYRRRWFIHVERITREKVNGSTVNVGIHPSRSWXQS

SEQ ID NO: 46029 - DNA, 749 bp, Zea mays
  misc_feature: Ceres CLONE 1450887-F
  misc_feature: Encodes the peptide sequence at SEQ ID NO. 46030
  misc_feature (622)..(622): n is a, c, t, g, unknown, or other
  misc_feature (623)..(623): n is a, c, t, g, unknown, or other
aagctggagctccccgcggtggcggccgctctagaactagtggatcccccgggctgcaggaattcgcacgagaccattacctagaacatcctaatcgaaaacttcgaaaacccttctcccgtcctgctcactcccgtctccgagcgccgccgccgccagcgccgatacgcgataaacaagaggaagaagaggccaaccgatccagcagcgatggcgggcgggggcatgctggggggcgctttctgggcgacgcgggcgctggaggtggtcaagcggaacgattccccgggcctattgtggaagcgcatcaagctcaccaccacccgcaagaacaacgccaagaagcgcctcaagcggctctggcagaatgaggcggttataagagcttgtggtgcatcagcgtctgacgcggcttccacagctgacaaacaacagtagcttggagcacaactggagcaggtcctgtgacctacctatgcttgataagctgaagccttgactttgctgcccccccccccaagtgttttgattttgctgtcctcggattgaatactttctccatccagaggacaacatcattgcttgttaccaggtgcaacctttgcccccccccccccccctnnctctctctggttacatcagttccgagcacctttgcgcccctctgattccatcgattttcgttgtttccacgtacttctggaggagaggaaaaaaacatttggagcctggtgtttttctcattctgc

SEQ ID NO: 46030 - protein, 75 aa, Zea mays
  misc_feature: Ceres CLONE 1450887-F
MAGGGMLGGAFWATRALEVVKRNDSPGLLWKRIKLTTTRKNNAKKRLKRLWQNEAVIRACGASASDAASTADKQQ

SEQ ID NO: 46031 - DNA, 805 bp, Zea mays
  misc_feature: Ceres CLONE 1450888-F
  misc_feature (141)..(141): n is a, c, t, g, unknown, or other
  misc_feature (274)..(274): n is a, c, t, g, unknown, or other
  misc_feature (275)..(275): n is a, c, t, g, unknown, or other
  misc_feature (331)..(331): n is a, c, t, g, unknown, or other
  misc_feature (349)..(349): n is a, c, t, g, unknown, or other
aagctggagctccccgcggtggcggccgctctagaactagtggatcccccgggctgcaggaattcgcacgagaccattacctagaacatcctaatcgaaaagccgctcttgctgtcctctgtgctatccgctagggtttantctgctcgaggaatggcgtcggtgcaggtctccggcgcgggggtcggtgccgcggccttctctgtgaaggggaaggcctcaccggtgcgctccggcttcgctctacgttgacctttcgcgagtctgcccggcnngcgcggcgttccgcggcctcgtcgtcaagggcgctacggtcgtcgccccaagtatnacacacttagccctttgnctgatagagtgcttgtaagaattacctccttccgaggaaagaacaactgttgaattttggttccctacaaatgcttaatccaaaacttaagggtgggaaggttattcccttttggaaaaagaaagaaattttggaaaaaaaaagtttaatgccccctttccggtggaagccagggtttggtatttaaaaaacccgagacaccaaggccgtttaaaaaacaccacccccttgtgtgtcccaaaaaagaaacttttttgtgttctttaaaaaatggagggcgaaaaaaaatatcctcctcaaaaaccccgtttttaaaagaggggggagagaaaaaaaaaaaaacccccgggggcttttttttttataaaacccggaggaaaaatccttttttaaagggttgggtgtgcgcccccccccccccaagaaaaaagagagggccctctcttctcccccccc

SEQ ID NO: 46032 - DNA, 749 bp, Zea mays
  misc_feature: Ceres CLONE 1450889-F
  misc_feature (391)..(391): n is a, c, t, g, unknown, or other
  misc_feature (394)..(394): n is a, c, t, g, unknown, or other
  misc_feature (399)..(399): n is a, c, t, g, unknown, or other
  misc_feature (416)..(416): n is a, c, t, g, unknown, or other
  misc_feature (417)..(417): n is a, c, t, g, unknown, or other
  misc_feature (452)..(452): n is a, c, t, g, unknown, or other
  misc_feature (498)..(498): n is a, c, t, g, unknown, or other
  misc_feature (537)..(537): n is a, c, t, g, unknown, or other
  misc_feature (681)..(681): n is a, c, t, g, unknown, or other
aagctggagctccccgcggtggcggccgctctagaactagtggatcccccgggctgcaggaattcgcacgagaccattacctagaacatcctaatcgaaaagcgctaacgcttcgcctttcgatcccctttctgacttcttatagcatcatcccaagtcctcgcccggactccgcagattctctggttgctacgagttcttcgcctggtttttgggcaaggccaaaatttctgatttttttccaccgccgcaaacccctttgctgtgccataccgccattccattcctaagctgggcgtgggcgggtgaagaaagaagcgaggccggctgtttcgctgaaacccgccgcctttttttccttttcttttctggatctgattgaagaacgtancanattangggaaggaggaagcgcnngcgcccgtcggtcggtcagtatgattcacctgctngtcctcgtgctgtttcgcgaagggcgcgtagcgctgctcctcatgntgaaggtcggcccgctgcgggagctggcgatgcgcgtcntgaacccagtgaagacggcaagggccccggcaccgtcaggacgctggcatgcacgctctcggtcatcctcatgtccaacgtcgccagcatcctcaagatcagaatcgtgggctcaagcttcggaccgtcagccccatggaccangtgctctggagaaccaccctcctcaagcatcctcatcggatacccctatccttgcatttgaatcgacc

SEQ ID NO: 46033 - DNA, 803 bp, Zea mays
  misc_feature: Ceres CLONE 1450892-F
  misc_feature: Encodes the peptide sequence at SEQ ID NO. 46034
  misc_feature (395)..(395): n is a, c, t, g, unknown, or other
  misc_feature (567)..(567): n is a, c, t, g, unknown, or other
aacgctggagctccccgcggtggcggccgctctagaactagtggatcccccgggctgcaggaattcgcacgagaccattacctagaacatcctaatcgaaaaagtcccgcgcgcacactcgcacgcactcgacgctcattcactgagccatttactcagatcaccaactccagatctcaatggcgcactcgcgcagccaccaccacctcctcctgctccccgcgcccatggccacggcgtgcttgctcctcgccaccctcctcgcgctctgcgccgcgccggcgccgacccacggcgcgcgcgtcctcatgccgggcggcgcgggcgcggtgaccaaggcgcagcagggtggcaccggcagcgtgagtaacgcaaccgcggaggaggacctggcnccccaaaaccggtttttcccccccgagggcggtggccccgctgcgggtgaaccgcgggcctggctcccggcgcccgcggggaacggcggcccaaccacccgccggcagggagggggccgcgtaccccgaactggggggccaaaccccatcgggccgaaacaagggggggggngaagcaaccaggtggggcccccccccagaggcggggccctgtggggggggccaagggcgcaactcaaccaccaccccccaacaacacgggcgcccgcgggagcctcacacgcaagcttccccaccaccgcaggggggggggaccgctaccccgcacaaagaacaggcggcgcctcaggcaaattttgcgcttgctgacgcgcccttctcacatccctataagcggagacacacacg

SEQ ID NO: 46034 - protein, 178 aa, Zea mays
  misc_feature: Ceres CLONE 1450892-F
  misc_feature (114)..(114): Xaa is any aa, unknown, or other
MATACLLLATLLALCAAPAPTHGARVLMPGGAGAVTKAQQGGTGSVSNATAEEDLAPQNRFFPPEGGGPAAGEPRAWLPAPAGNGGPTTRRQGGGRVPRTGGPNPIGPKQGGGXSNQVGPPPRGGALWGGPRAQLNHHPPTTRAPAGASHASFPTTAGGGDRYPAQRTGGASGKFCAC

SEQ ID NO: 46035 - DNA, 880 bp, Zea mays
  misc_feature: Ceres CLONE 1450901-R
  misc_feature (784)..(784): n is a, c, t, g, unknown, or other
  misc_feature (785)..(785): n is a, c, t, g, unknown, or other
  misc_feature (807)..(807): n is a, c, t, g, unknown, or other
  misc_feature (858)..(858): n is a, c, t, g, unknown, or other
  misc_feature (859)..(859): n is a, c, t, g, unknown, or other
  misc_feature (867)..(867): n is a, c, t, g, unknown, or other
  misc_feature (869)..(869): n is a, c, t, g, unknown, or other
cgaattgggtaccgggccccccctcgaggtcgacggtatcgatacgctcgactgtttgtgtagtcgccccgcgacatcctctttctcggcgacgagggtgagttgggcgtacgccgggtccgtggactcgtccgcatggagagtgacgtcgaccacttggcagaagacgtggggcggcagggcgactggcggtggcgcgcctcttccggcggccgcggcgtcgccgaggtgctcgatgtgtccctgcgggaggtacaccatgacgctccctttcctcggcagcggcacgacagggccggcgcatgcgtgccacagttcgaggcacaccgcggcgctttgcctcagctggttcggcggcagcggctggaacgtggcctcagagctggtccgggtctgctgggagcaagcgttgccgggctccgccgggtcctcgacctcctccacggtgtcatagaggtccatcccccccctggctggctgtgggggctctaagcaagataaggtggagcgggccccccggagggaggcaggtagctcgcgcgcgattgattttttctacttgggatgttctaaggtgagggtttttggggggaattttgtgggcctctccggggggaaccccccttttttctctggcgggccccccccgttgaaggattgaaaaccccccctcttttttttgtccccacaccctgggggggggggtggaaaaaaaaaaaatatttttcgcccggcccagccggcgcgcccgcggatggagggagtttatttttttttcttcttnnctctccacccacacgatcgaanggagttgtgtttgtggtcttttattttgtgtgggtgatatgtctgctcacnngttgctgntntgctcgcgaag

SEQ ID NO: 46036 - DNA, 783 bp, Zea mays
  misc_feature: Ceres CLONE 1450905-F
  misc_feature (290)..(290): n is a, c, t, g, unknown, or other
aagctggagctccccgcggtggcggccgctctagaactagtggatcccccgggctgcaggaattcgcacgagaccattacctagaacatccttatcgaaaaagtcctgtccagtggtgcagctgcctgccttcagccttccctctctttcgcgacccccccggagccggagcagagatcgccagctctaccggcgcggaggcatggcgggggccggagacaaggtggactacgtcttcaaggtggtgctgatcggagactcggcggtgggcagtcgcagatcctcgcccngctcgccccgcacgagttcagcctcgactcaaagccaccattcgcgtcaggtccagaaccgcaccctccgtatcgacacaggagcgtcagggccaaaattgggacccccccggccaggaaagtaccaaccccggactaggggttatttaaaaggccccctggggccttgttgggttcccaaactccccagggggaaaatttttttcataccccccggggtaaaaggcccccacccccggttaaaaaaattttttaattggggggtggaaaaaagagctttctaggaagcccgggccgggaacctaaaaaccccagggttttccaaaaaaaaaaccctttttttttagaaacccccccccccccccaaaaagaggggagtgtttttttcacccccgtgggggatttttcctcaccccccccaaaaaaaagggggtgggcgaaaaaaaaaaaaaaagccccccccccctgggggggggggaggagaacctctcct

SEQ ID NO: 46037 - DNA, 757 bp, Zea mays
  misc_feature: Ceres CLONE 1450907-F
  misc_feature: Encodes the peptide sequence at SEQ ID NO. 46038
  misc_feature (516)..(516): n is a, c, t, g, unknown, or other
aagctggagctccccgcggtggcggccgctctagaactagtggatcccccgggctgcaggaattcgcacgagaccattacctagaacatcctaatcgaaaaatgtttgcaaaattctcacagagaaccggaggactgagaccagaggaggagacgtcacgcctgcgcggctgcgcccaccatggacgaggatgagtttcggcgcatgctcgacctcttcccggtcgtccgctcccgagactactgctgctccgatcttggaacatccagcagaggaaccagacagcgatcacgagttcaggaggcaactaaggggcgataatagggactcgtcgggtggacgagatatgtttatgcagaaatggaagatggctgcggagaataagatgggagcgacaaaggcagagttcttctgcaagacattcgaaggaagttcatgagaaacttgttcacagagagctgaatttgggatgctgctaagaaggttcctgagcgcatatgagagctgatgatgaancataagtagatgctgctaaggggtcggtagttgccaatgatctggaaagttgttgatgcctgttaaattttgatcacaggcaaactttttacaacggtagatgcttgttaacgcatactgataccccctgattggtccccgatcgcccgttaccagctcgtatgcagccagcttgtcaaagactgtttttgtggccgtaaaagtggatcccctccaaaaaatgttgcgtttacccggcaaa

SEQ ID NO: 46038 - protein, 46 aa, Zea mays
  misc_feature: Ceres CLONE 1450907-F
MDEDEFRRMLDLFPVVRSRDYCCSDLGTSSRGTRQRSRVQEATKGR

SEQ ID NO: 46039 - DNA, 760 bp, Zea mays
  misc_feature: Ceres CLONE 1450909-F
  misc_feature: Encodes the peptide sequence at SEQ ID NO. 46040
aaagctggagctccccgcggtggcggccgctctataactagtggatcccccgggctgcaggaattcgcacgagaccattacctagaacatcctaatcgaaaaactcgaaggggaatctccggaggatggaggtgggcaggactccgcggcgacgggcgtccccagcggcggctgtgccttcgctgcttctgttcgccttgctattcgtgtgccgggcggcggcagcgttgggcggcccggcgccggcgctatacaagcacgcgtcgttcttcgaccgcgacggcgacggcgtcgtctccttcgcggagacgtacggcgcgtttcgggccctcgggtttggactcggcctgtccagcgtcagcgccgccttcatcaatggcgcccttggcagcaagtgcagacctcaaaacgcgacgtcgtcgaagctggacatctacatagaggacatccggagagggaagcacgggagcgactccggctcgtacgacgcccaaggaaggttcgttcccgagaagttcgaggagatattcgccaggcacgcgaggaacagtcccgacgccctgacctcggacgagatcaaccagctgctcccagctaaacgagagcccggggactacagcggctgggctgccccgaaaccgaaatgaagaatcctgtacggcctcggcaaggacggggaaccgcctcctccccaaggacttcccgaggaacgtctaacacgggacactgttcccccggctccgccccaaatgagaatccc

SEQ ID NO: 46040 - protein, 173 aa, Zea mays
  misc_feature: Ceres CLONE 1450909-F
  misc_feature (30)..(173): Pfam Name: Caleosin Pfam Description: Caleosin related protein
MEVGRTPRRRASPAAAVPSLLLFALLFVCRAAAALGGPAPALYKHASFFDRDGDGVVSFAETYGAFRALGFGLGLSSVSAAFINGALGSKCRPQNATSSKLDIYIEDIRRGKHGSDSGSYDAQGRFVPEKFEEIFARHARNSPDALTSDEINQLLPAKREPGDYSGWAAPKPK

SEQ ID NO: 46041 - DNA, 759 bp, Zea mays
  misc_feature: Ceres CLONE 1450910-F
  misc_feature: Encodes the peptide sequence at SEQ ID NO. 46042
  misc_feature (570)..(570): n is a, c, t, g, unknown, or other
  misc_feature (640)..(640): n is a, c, t, g, unknown, or other
  misc_feature (759)..(759): n is a, c, t, g, unknown, or other
ctggagctccccgcggtggcggccgctctagaactagtggatcccccgggctgcaggaattcgcacgagaccattacctagaacatcctaatcgaaaaatctgaaatatcttgccacctgacgcgacagcgacaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgtcctcttcaacgacgaccggtgtgcaaatatctttgaagcactagttggcaccttgagggccgccaagaagaggaagatcttgacctacgaaggcgagctgcttctgcaacgtgtccatgacaacgtggagataaccctgttgcccccacctgcagttgctgccgcttgaagcgaagagcaccaccaagttctcgattcccatacactcgtatgcttgtattctgccgtgcctatattagattctctcgaaccatttgggtgtccnttgaaactgctatcgtgtgatatatgaaattgtggtgctcaagaaatttgccttgctgcatatggttgtngtgcttaataaattcaatgctggtatagcattcgtgtcatgagacatgaaaacagcagactggagttatggccgccgggttattgaaaaaaaaaaaaaaaagcttatcgataccgtcan

SEQ ID NO: 46042 - protein, 87 aa, Zea mays
  misc_feature: Ceres CLONE 1450910-F
MNVEEEVGRLKEEIHRLGQQQPDGSYKVKFGVLFNDDRCANIFEALVGTLRAAKKRKILTYEGELLLQRVHDNVEITLLPPPAVAAA

SEQ ID NO: 46043 - DNA, 762 bp, Zea mays
  misc_feature: Ceres CLONE 1450911-F
  misc_feature: Encodes the peptide sequence at SEQ ID NO. 46044
  misc_feature (668)..(668): n is a, c, t, g, unknown, or other
ctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcttccttatgctccttggtctttctgcaagtgttgctaccgcgaccattttcccacaatgctcacaagctcctatagcttcccttcttcccccatacctatcaccagcggtgtcttcagtatatgaaaaaccaattgttcaaccctacaggatccaacaggcaatcgcaacaggcatcttaccattatcacccttgttcctccacaaccgtcagccctattacagcagttacctctcgcgcatttggtggcacaaaacatcagggcacaacaactacaacaacttgtgctagcaaaccttgctgcatactctcagcaacatcagtttccttccattcaaccaactggctgcattgaactcctgctgctttatttcaacaacaactaccatttcagcagctagctgctgcctacccccaagaaatttcttcatttcaccaactagcagcattgaactctgctgctaatttacaggagcaaccactactaccaancacccagttaactgatgtgacccctgctgcctcttgaaacaaaacagttgttgccttctacctgcaccctatgcctaaagttggaccctcttca

SEQ ID NO: 46044 - protein, 103 aa, Zea mays
  misc_feature: Ceres CLONE 1450911-F
MAAKIFCFLMLLGLSASVATATIFPQCSQAPIASLLPPYLSPAVSSVYEKPIVQPYRIQQAIATGILPLSPLFLHNRQPYYSSYLSRIWWHKTSGHNNYNNLC

SEQ ID NO: 46045 - DNA, 759 bp, Zea mays
  misc_feature: Ceres CLONE 1450912-F
  misc_feature: Translation starting site: 210
  misc_feature (375)..(375): n is a, c, t, g, unknown, or other
aaagctggagctccccgcggtggcggccgctctagaactagtggatcccccgggctgcaggaattcgcacgagaccattacctagaacatcctaatcgaaaaatccaaccgtacgtaaactagtcacaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcnaaagagcaaaggccgtgtttaaggagcttgagttgaagaaagagcatatgttgtggagcttgatcagcgagaggatggctcagagattcaggatgccttacttgagatagttggcaggcgtactgtccctcaagttttgtccatggaaagcacctgggtggttctgacgatactgttgactcctacaaaagtggaaaactggctagacttctaaacatcggagtcaaggacgacctttgagtgacatgctacatcggtcagcctgttcgtttggttcaatccgtacgggcttcaaccacttccaaattggttttggccccaggggattacagctccaccgtctaaaatactgattttaatccaaagcgacagttcaaaaagtct

SEQ ID NO: 46046 - DNA, 761 bp, Zea mays
  misc_feature: Ceres CLONE 1450913-F
  misc_feature: Translation starting site: 103
  misc_feature (436)..(436): n is a, c, t, g, unknown, or other
ggagctccccgcggtggcggccgctctagaactagtggatcccccgggctgcaggaattcgcacgagaccattacctagaacatcctaatcgaaaaaccaagatgaagtcttcattgtcgcctgcagtcctacagattcatcacttgtggcttctggaggcaaagatgataggggatttctgtggaggattggatcagaagagggtgccctggagctgactggacataaggatactgtcggcacagtggctttcagttcagatgggaatttgttggcttgtggaagttttgatgggcaaataaatgtgtggaatacagctacacgaactctcaagggaacccttgagggttccgggtcaggttttgagtggcttaaatggcattctcggggacatttgataatcgcaggatcagaggattgtaatgtatggatgtngaatgccgacccatatgccattctgaataccttttgctgacatagtaacacagtgacatgtgggtgatttactccagatggtaaacttatatgcactgggatcgatgatgcgtctttgaggatatgggacccaggaagtgcacaagcagacatgttgttccgagccatgcctaccattctgatggattgaactgcttatcgatgacttccgatccacaaacggttgttagcggctccaagacagttctgtgacattggtaatttaaactcgggccaggtcgttggctcattacaggccacccagtttcattgaatggcctggatc

SEQ ID NO: 46047 - DNA, 776 bp, Zea mays
  misc_feature: Ceres CLONE 1450915-F
  misc_feature: Translation starting site: 415
  misc_feature (452)..(452): n is a, c, t, g, unknown, or other
  misc_feature (465)..(465): n is a, c, t, g, unknown, or other
  misc_feature (575)..(575): n is a, c, t, g, unknown, or other
ctggagctccccgcggtggcggccgctctagaactagtggatcccccgggctgcaggaattcgcacgagaccattacctagaacatcctaatcgaaaaaatgcagcagtagccgtctgcctcctcgctttccctttcgtccgtacgccgccgcctcgcaccgccgacagtcctcagtccagaactccagatcgagcctccctctccccagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatcaggcgcttagaaggggcgctgcccggtggatgacgatggcgggtggcgggggactgaacccgtcttcatcganggggcagctgccngcgcaggagctgcttgacgatctctgcagccggttcctttctgaatgtgcccaaggaggagctggagtcgttcgagcggatcctggtcctgctggagcaggcgcactggntctatgaggaacacttcgttgagcaacaccccaacttcaagtccctctccttcaagggacttcacttccctcatggtcaagagctgcactggctcttcgggcttacatcgggcacctgggatgatatctacaaggactccaacaactaccaggttccgggggcttgggtccggcgccatcattctaaaccacccttatgag

SEQ ID NO: 46048 - DNA, 768 bp, Zea mays
  misc_feature: Ceres CLONE 1450916-F
  misc_feature: Encodes the peptide sequence at SEQ ID NO. 46049
  misc_feature (448)..(448): n is a, c, t, g, unknown, or other
  misc_feature (455)..(455): n is a, c, t, g, unknown, or other
tggagctccccgcggtggcggccgctctagaactagtggatcccccgggctgcaggaattcgcacgagaccattacctagaacatcctaatcgaaaattttactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacacatgggggatgtcgacatggtctcagttgaagagtcttcagaagctgcaaagggcaagtcccaagtgaagttcagtgtgaagaaaactcangaatacngataaagagattaaaggggcaaggcaggaagaaagccaaaaatgcaaaaccacctgcaagggagaaagttgatgccatggtagaatgacagtggaatgcatggtagcatgacggacaagactacatacctccatcccctttgtatgttttctcagagtttgcaagatggaaccgacctcaccgaacactggcgcgtgtctcctgcatcttcctgcctggattgtaaatagagcctacttaggcctggtggttatgtacttcaaacattgatctacttttaaaaggggacttagcaaattggccaaaaaaaaaa

SEQ ID NO: 46049 - protein, 89 aa, Zea mays
  misc_feature: Ceres CLONE 1450916-F
MAKYNVVQKNKRQCNQDRKRAAHGEPGTGKLKQRTAPVSMSGKRKKKLERRLNRKQKEAAMIKALENTWGMSTWSQLKSLQKLQRASPK

SEQ ID NO: 46050 - DNA, 741 bp, Zea mays
  misc_feature: Ceres CLONE 1450917-F
  misc_feature: Encodes the peptide sequence at SEQ ID NO. 46051
  misc_feature (232)..(232): n is a, c, t, g, unknown, or other
tggagctccccgcggtggcggccgctctagaactagtggatcccccgggctgcaggaattcgcacgagaccattacctagaacatcctaatcgaaaatcccttggttcctcgcggcgacgactgggcgagcgcctcctcccctccctcactccctccgtgagctcctcgccggcggcgcgcgccgccgcccgtcgccacgtcttctccgctgacgtgggctcaccagatccnatgaaggctgcccacttgacgcaagggtgttcagaaatttaaaccatgcactcttcatcgtaggttcaaggcaatatctgtgttaatcttggggaccttcagtagattgctgagagttctccttgatacaggggaaataagatcaaaataagtttttgacattgatctgtagccagtactgcaatggctacgaagcttgttggtctcggtatcccctgggatgttgacactgaagggttacgagagtacatggccaagtttggacccctagacgattgtgtcgtcatgaaagagcggtcttctgggcgatctcgcgggtttgctatgtaactttcgctcagctgagatgcaaagattgttcttgattgcgagcatgttcttgggagccgtacctaagaggtgaaggtgctcctccaaggaaggaatgaatccccgggtccaagaagcttcaggatatccgttgctcgatttcccaacggtggtgagtcaagtttctaaacttttggact

SEQ ID NO: 46051 - protein, 48 aa, Zea mays
  misc_feature: Ceres CLONE 1450917-F
MATKLVGLGIPWDVDTEGLREYMAKFGPLDDCVVMKERSSGRSRGFAM

SEQ ID NO: 46052 - DNA, 745 bp, Zea mays
  misc_feature: Ceres CLONE 1450920-F
  misc_feature (377)..(377): n is a, c, t, g, unknown, or other
  misc_feature (579)..(579): n is a, c, t, g, unknown, or other
ctggagctccccgcggtggcggccgctctagaactagtggatcccccgggctgcaggaattcgcacgagaccattacctagaacatcctaatcgaaaaatgtaagcgagccaatctcatccgctgctgctcgtatgcgcactctttgtctgtgacccgaccccgtcctcaccaaattgctctgagggaatcgattaatcgtccgcctacgccgagcgcggtggaggatcgggacaaggagccttctctcgtagaaatcattaacatcaagtttgtagagagtggagagaaggagaagctgacggagctcctccgcgagcggctcgtcgagtgcggctggatggatgagatgaaggcattctgcagggactatgtaangaagaaaaggaagaaaatatgtgagggtagaccacctcattcatgttattgttccgaaaagaagagcatcagtgcctgctttcgtgaaggcagaactcctgcaacgtatccggtccttcatggctaccacacttcggtagtcatttatcgtgacggttggagctacatgtaccattgtacgaacactgggaagtcgatcttngtggggaacaaggttgcaggtactgagcatgaaaaggatcagtgtgatcttcatgatgctatcgacatgttcctccccagacaggcggttggcgttgattcaggggtagcaacccggaattataaccctgaatactgtaccgttaaaggaactttgtagttggtat

SEQ ID NO: 46053 - DNA, 812 bp, Zea mays
  misc_feature: Ceres CLONE 1450921-F
  misc_feature: Translation starting site: 206
  misc_feature (278)..(278): n is a, c, t, g, unknown, or other
  misc_feature (287)..(287): n is a, c, t, g, unknown, or other
  misc_feature (350)..(350): n is a, c, t, g, unknown, or other
aagctggagctccccgcggtggcggccgctctagaactagtggatcccccgggctgcaggaattcgcacgagaccattacctagaacatcctaatcgaaaatcaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgtcngcggcggcngcggggcccggccgcccgcactacagaggcgtgaggaaccgggcgtgggggccgtacccggcngagatccgcgaccgggcaaaaaaaacccgggtgtggtcggcacctacaacacggcgaagaccccccccgggcctacaacgcccccggggggaagtaccgcgggccccagggcaaaaacaaatttccctaaccccttgggggggccccctcctcccaaccgggttgcgcggaaaaaaaaacaaaaacacccgtaaagtccttttaaaaggaacccccagggcccccttgggggggaatgccccccccccccgctctctcaagagtggagattttccacccccggggggcccccccccccggggaaggggggcctcccccctatatttttcttctttggggaaccccccctaaacccccccttattatttttttggggggggcgcccccccccccccaaaaaaagggggggtggttttataaatgtggggccgggcccccccgggaaaaaacacctccccattt

SEQ ID NO: 46054 - DNA, 763 bp, Zea mays
  misc_feature: Ceres CLONE 1450925-F
  misc_feature: Encodes the peptide sequence at SEQ ID NO. 46055
  misc_feature (215)..(215): n is a, c, t, g, unknown, or other
  misc_feature (378)..(378): n is a, c, t, g, unknown, or other
  misc_feature (402)..(402): n is a, c, t, g, unknown, or other
  misc_feature (719)..(719): n is a, c, t, g, unknown, or other
  misc_feature (763)..(763): n is a, c, t, g, unknown, or other
aagctggagctccccgcggtggcggccgctctagaactagtggatcccccgggctgcaggaattcgcacgagaccattacctagaacatcctaatcgaaaagaaacatcgaatcgtctcgctcgtggctgccctgctcatactgcttgccctcgccgtatcgtccacccgcaacgcacaggaggattccatggccgacaacaccgggacgttggncggcggcatcaaggacgtgccggggaaacgagaacaaccttcacctccaggagctcgcccgctttcgcgtcgatgagcacaacaaggaagcccatgctcttctggggttcgagaggcttgtgaagggcaagacacaagtggttgctggaacgatgtactatcncactattgaagtgaaggatggccnaaatcaaaaaccttctacaaagctaaggtcttggaagaagccatgggagaacttcaaggagcttccagaatttcaagccttgtttaagattgttgctaacgccctaaaggatctttcctttcaccatggtgccaaccctgaaacctcaaaagcaaaagttccaaaaataaaggagccctccttcacaacattggtaaaaccattgctcccctttgtgaaattttcataagaactaccaacccttttttagggcttgtttcggttttgtttcctttatcctaagggaaattgaaagggggatttaaatttccccttcnaaacaaaaaaggaggggttttaatctccccctccaaaatatttn

SEQ ID NO: 46055 - protein, 87 aa, Zea mays
  misc_feature: Ceres CLONE 1450925-F
  misc_feature (4)..(4): Xaa is any aa, unknown, or other
  misc_feature (12)..(12): Xaa is any aa, unknown, or other
MYYXTIEVKDGXNQKPSTKLRSWKKPWENFKELPEFQALFKIVANALKDLSFHHGANPETSKAKVPKIKEPSFTTLVKPLLPFVKFS

SEQ ID NO: 46056 - DNA, 838 bp, Zea mays
  misc_feature: Ceres CLONE 1450930-F
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (410)..(410): n is a, c, t, g, unknown, or other
nttcccctnnatcatagctggagctccccgcggtggcggccgctctagaactagtggatcccccgggctgcaggaattcgcacgagaccattacctagaacatcctaatcgaaaaacgcttgccttatcttctcccgttcaccccgccgtgcgcgcgcgcccccgcggcgacaaccgggcgaccgccgccgacctacgccaggtgccaagccgttcctcagtcccatcacgaggccttcaacgagcccttcgccggcgacgagaaaatttgattctagttaactattcaggagtaggagatgatgacctacttccaagccactacttgcaagcctcaaagcagggtcgttgtgaacaaacctattccaggtcttgggagtaaaggtgattgctcgggggggggggagggnccctcaaaatttaaaaggccccacccccacgggggtgggggagggcaacccccccccccgccccaagcccccaaaaaggctaaccccccagaaaagtgctcttaacggtgcacagggggaaaagcttgggcattggctgaagaaaacctttggctggaaccctttaaaagaaagcctagggcctcgcgcacaacacacacccacctcccttatcaagcgctggtccgatcggtcacagcaggctaacccctcaatacatcactcattccacgccaacccgccacggaaaggcgacaagttgcgctatcccgcgcactacgggtctgtgttggcgcgcaggagagctcgcccggcgccccgcctcgcaggggcgccatccagcccgatgttccttcttagcgtctggcactcttcccgcaagagagcca

SEQ ID NO: 46057 - DNA, 770 bp, Zea mays
  misc_feature: Ceres CLONE 1450935-F
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaatcccagccgccgccgactctatctctcccttccctctcaccacctcctcgtcatcctcagcgtgcacgctgcgcgtggccgtagtgggggtggccccgcggcacgtcggctgccgaggcgctggtctcgccgagggcccagatgcaggtgctctcctctaccaacctcgccgctgacttctcccgcgcgctgccgcccggggcacccatccccatgctccgccgtgaggtgctccactccttcctccgccgtcgaggccgagctcgtccagggcctcatcacctccgccgtgaggtgctccactccttcgtcttcaagctctcgccccaggggtgcgctagtgccaggtgcggcgagccagcagatcaaggaaaccgcccgtggccgccccaagcgttacatctgcactggctgctgctggtgacaagcaagaacaaccaagggaagagaagaaggggagacagtcngacaaaacagaagacgagaagaactgctttcagctggagtgatgtcgctgtggtgcttttgtgactgatcatctctggagcttttgtgaatgattgaactagctatctgtaattgatctagttgggaatgaaaatataaattgggaaacttttgggaataaaaaattgggggggctttggggtttatgggaatggatctataactg

SEQ ID NO: 46058 - DNA, 819 bp, Zea mays
  misc_feature: Ceres CLONE 1450937-F
  misc_feature: Encodes the peptide sequence at SEQ ID NO. 46059
  misc_feature (318)..(318): n is a, c, t, g, unknown, or other
ctggagctccccgcggtggcggccgctctagaactagtggatcccccgggctgcaggaattcgcacgagaccattacctagaacatcctaatcgaaaaatcccacccattcgcatccttccccgctctcgctctctcagccgcagagccactcgtgtcggtgacggcggcgaaggcaatgtcatccctccgcccgtccctcctgctcgtggtgtcgctgctcgcggcggctctgcttgcagcggcgccgtcctccgcgtctcgcgacctccgcccgctccaggcgagcttcgtcgtgcgcggccgcgtctggtgcgancactgccgcgcgggcttcgagacccccgcatccacctacatttgccgagcttaggtgagagtcgactgcaaatccaaggactaccggggcaaatacatgcagccttcgaagggaatactggaccgaaccgggcacctaaaaaattcttggtctttgttaaacatgaccatgaccttctgcaatccccccttttgaaacacccccgaaaaagggggtggcccaatttttggcgctggcccaaaaaaggcccccctttttttttttaagaaaaaaggggggtgtccccccaattttttttgaaaaaattcctgggggttcccaaaaaagttttccctcttctaaggggcggccattcccctagtgttcccccaggagggagacccccgtttttaaccccccgagattaaaaatgctccgcgcggaacaaaatttttttttggggggggcgaaaattttctcacacccccccttttttaattagagaaaatattttttcttttt

SEQ ID NO: 46059 - protein, 64 aa, Zea mays
  misc_feature: Ceres CLONE 1450937-F
  misc_feature (47)..(47): Xaa is any aa, unknown, or other
MSSLRPSLLLVVSLLAAALLAAAPSSASRDLRPLQASFVVRGRVWCXHCRAGFETPASTYICRA

SEQ ID NO: 46060 - DNA, 808 bp, Zea mays
  misc_feature: Ceres CLONE 1450939-F
  misc_feature: Encodes the peptide sequence at SEQ ID NO. 46061
  misc_feature (369)..(369): n is a, c, t, g, unknown, or other
  misc_feature (370)..(370): n is a, c, t, g, unknown, or other
  misc_feature (378)..(378): n is a, c, t, g, unknown, or other
  misc_feature (684)..(684): n is a, c, t, g, unknown, or other
  misc_feature (688)..(688): n is a, c, t, g, unknown, or other
gctcttaactagtggatcccccgggctgcaggaattcgcacgagaccattacctagaacatcctaatcgaaaaagtgatagtgagcgacgccacgggacaggcatggcgagccgcgagcggcagcacacccgcagctacgactacgactacgagcacctcgtgctcgacccggcgtctctgggcgtgccgtgggccgacccggccgccgtggagatcccgccgcagctcctcgccgcgctgggggagtacctctccggctccggggcccggggggacttcaaggcggaggcggacgaacgagtcatgatgcactagttcaaggtgtgggttgtttccccccggaaaaaacccgcggcgggcacctcctnnccccctanccaccccccccccccctgcggcagtggcctcgggggagagccgcgcccccccccccctgccggcggggccacccccccccccctccatctccccgggggcccccacgggggcgccccccccacgctcgctggctcgcttcagggtggggggctcgcccgcgcacccgctcctcgctgtgtgactccctctttcaaccccctcggagggtccatccgtggcccaccccccccgggggtccccctctctggtccccccaccctcccctcggtccgcccgcccccgctgtcgtcgccctcgcccccccntttntgctcgccccacttgcgcccgggtcgccaggcccccccccccgcggggggggtggccccccgagcccacgcaccaccctctcccgcacgatgttgttccacgcctcccccttgtcatgag

SEQ ID NO: 46061 - protein, 70 aa, Zea mays
  misc_feature: Ceres CLONE 1450939-F
MASRERQHTRSYDYDYEHLVLDPASLGVPWADPAAVEIPPQLLAALGEYLSGSGARGDFKAEADERVMMH

SEQ ID NO: 46062 - DNA, 829 bp, Zea mays
  misc_feature: Ceres CLONE 1450949-F
  misc_feature (486)..(486): n is a, c, t, g, unknown, or other
  misc_feature (491)..(491): n is a, c, t, g, unknown, or other
  misc_feature (810)..(810): n is a, c, t, g, unknown, or other
caaagctggagctccccgcggtggcggccgctctagatctagtggatcccccgggctgcaggaattctcacgagaccattacctagaacatcctaatcgaaaaagcaaaccttcgggaagggaagcagcagcatgaactgcgcgtctgccatcccgcagctactccaaacagcaacgtcctagccgacgagagcctccctccgccacctacccacccaccaactcccgcccgtcgcctccgcttgtcttttcgtcgagcagttggttggcacctaaccccccagggccgcgggccagtaaggcgggagagtgaggcagaggcactgagccaaaaccgggaaatgaagaagctgtgccaaggcggcaagaagggggggtgggtgaacagggggggcggaaaaccccccggtgttcataacccccccctgttgggcgtgggtggccccccccctctcggttgatggttgatgaagattgaagtgtttntcttnaacccctgtcctcgccgccgcccccccgagaccaagccacggccgcccctaagctaacccccccttgcgccccccccccaccaacaaagagagaagcgcccaactttggcgctggtaacaagaaatatattggggtcggtctgcgccccccgacccaccgagcgcgcgcgcccgacgtcccccccaaatttttaacctcctactcaagaaactcgcgtgcccacggggcgcggtgactccctgagccgtcgcgatcgcgctgtcggcggtcacgactcggcggcgcgctgggctgatgatgggcgtatgcgcgacccanctcttaatgctgtgctctc

SEQ ID NO: 46063 - DNA, 807 bp, Zea mays
  misc_feature: Ceres CLONE 1450950-F
  misc_feature: Encodes the peptide sequence at SEQ ID NO. 46064
atagctggagctccccgcggtggcggccgctctataactagtggatcccccgggctgcaggaattcgcacgagaccattacctagaacatcctaatcgaaaaacatccaaaattcccagtccgcgatacaagaccaatccaatccaatccaatcccagcggaagtggaagcagcttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctcccctttgtgccgccggctctgccccggtcgtcgtggtgggaggccctcgggggggggcggcccaccctgattattgtccccccccgggggggggggttcagcccaccggccggccggggccgccccccccctaagcctgcgcctaaagggaggtagttagttaacaatgggaggccacaccccgggatcaccgggcatgtaccccccgggacccctgggtgcccccgaagctcgcaccgggcgcacctcgcccggggcgccttaaacgcatccagttccggccaccttctcacaggcccctgctctctggtgggacactctcttaacacacccgcgccgggagagatgatccccccccccggccgtgagcaaagacacacaaagaccgggggccctcccgccgtgggggggggggggccccctgcctggcgggtcccaccccgcggcaccggtgtctctctcccccgcaccctcgc

SEQ ID NO: 46064 - protein, 94 aa, Zea mays
  misc_feature: Ceres CLONE 1450950-F
MILVAIVAELLEEYTALVARVLEQLLNDAPFPRRMRFLMLRSLPFVPPALPRSSWWEALGGGRPTLIIVPPRGGGFSPPAGRGRPPPKPAPKGR

SEQ ID NO: 46065 - DNA, 747 bp, Zea mays
  misc_feature: Ceres CLONE 1450951-F
  misc_feature: Encodes the peptide sequence at SEQ ID NO. 46066
aaagctggagctccccgcggtggcggccgctctagaactagtggatcccccgggctgcaggaattcgcacgagaccattacctagaacatcctaatcgaaaagtactcatgagggccgggcaggtgtgccggccctggcgccgcgcggcgcgggaggagcccgagctgtggcgccgcatcgacctgcgccgccgcgctgcgctctccacgtccatcctctaccatctcgacgtgatggcgcgcactgcagtgacgtgtagcgcaggccagtgcgaggccttctgggccgaggacttcgtcgacgacaccttcatcttcttcctcagtcaccgggctaccgggctgaggagcctccgcctcatatcctgcaacatctcgaagcaggcggccctcaacgaagcaataacgcggttctccatgcttgaggagctagagctgtcactctgctcaggcgccaccaccgcctccgggcactacaacctcgccgacacctgcacggccgcagccaaggcctgccggaacctgaagtgcctccggctgaacaaataccggttccaccggcggtcaggctacgacggcgacagcgaagccatggagatcgccaagatgcgcggcctccggtgcctggcactcttcggcaacagcctcggcaacgccgggctcgcggctatcctcgcagactgcgcgcatctggagtccctcgacatccgccactgtttcaacgttgaggtgaatgatgagacgcgc

SEQ ID NO: 46066 - protein, 249 aa, Zea mays
  misc_feature: Ceres CLONE 1450951-F
KAGAPRGGGRSRTSGSPGLQEFARDHYLEHPNRKVLMRAGQVCRPWRRAAREEPELWRRIDLRRRAALSTSILYHLDVMARTAVTCSAGQCEAFWAEDFVDDTFIFFLSHRATGLRSLRLISCNISKQAALNEAITRFSMLEELELSLCSGATTASGHYNLADTCTAAAKACRNLKCLRLNKYRFHRRSGYDGDSEAMEIAKMRGLRCLALFGNSLGNAGLAAILADCAHLESLDIRHCFNVEVNDETR

SEQ ID NO: 46067 - DNA, 741 bp, Zea mays
  misc_feature: Ceres CLONE 1450964-F
  misc_feature: Translation starting site: 165
  misc_feature (402)..(402): n is a, c, t, g, unknown, or other
aagctggagctccccgcggtggcggccgctctagaactagtggatcccccgggctgcaggaattcgcacgagaccattacctagaacatcctaatcgaaaaagagatccacgaatatacccatcccattccccacaaggctccgtcccttcggaggcggcggtgatgtctctcccccctggcccggcggacagtggcaccggcaccggagaccactggttcctcgactgcggcatcctcgacgacctgcccgccgcggcctgcggagccttcccgtggaatgcgtccccgacgtcttccaaccccagtgtggaagtgggcagctatgtaaacgccaatgatgcattcaaggagcctaatgatgtcttcaaggaccctggcagcagtaaacgtttacggccangatccaccccccaccccaacatctaaagtttgcagggaaagaatgaggaggacctggctgaatgacaggcttcttgaactggggtctgcattaaaacctgggaaagccagtgaaagaatgacaaacttgccatcgtaagcgaagctactcgcttgggtattcaactccgttcataatcacataaactgagggacacgtatggcacccccaaagaaactatttaaaaattagaggccgaaaagggaaaccttcccgaccataacgctaaccctgaaactggaaaaggaaattttccacgatcccatgaacctgaatgcaactttctcccccccaatgacg

SEQ ID NO: 46068 - DNA, 652 bp, Zea mays
  misc_feature: Ceres CLONE 1450965-F
  misc_feature: Encodes the peptide sequence at SEQ ID NO. 46069
ctggagctccccgcggtggcggccgctctagaactagtggatcccccgggctgcaggaattcgcacgagaccattacctagaacatcctaatcgaaaaacttgcccaggaggctcgcgacccgcgacgccttccgcagccccgacccaaaccctagcccctccaccgtagtattgccaccgtcatggccgaatcatctgtcgctgccgtcaccgcagccgaggtcggggcgccatcttcgttgccaccgctggtcgccgaggaggccgatgccgcgatggaggaggctgcggcggtcgcgaagaggtggcccgggtggcccggggacagcgtgttccggctggtggtgccagtgctcaaggtcggaagcataatcgggcggaagggcgagctcattaagcgcctcgtcgaggagaccaaggccagggtccgcatcctcgagggccctgtcggcgccaccgagcgtatcgttttggtttctggaaaagaagatccaggcttggagctacctccagccatggatgctctcatgagagtttttaagcgtgtcactgggatagcagatggagctgctgagggtactcaggccgctgctgctcctgaagtatgtgctgcccgattgttggttcctggagctcaaggcattaatctat

SEQ ID NO: 46069 - protein, 156 aa, Zea mays
  misc_feature: Ceres CLONE 1450965-F
  misc_feature (50)..(112): Pfam Name: KH_1 Pfam Description: KH domain
MAESSVAAVTAAEVGAPSSLPPLVAEEADAAMEEAAAVAKRWPGWPGDSVFRLVVPVLKVGSIIGRKGELIKRLVEETKARVRILEGPVGATERIVLVSGKEDPGLELPPAMDALMRVFKRVTGIADGAAEGTQAAAAPEVCAARLLVPGAQGINL

SEQ ID NO: 46070 - DNA, 775 bp, Zea mays
  misc_feature: Ceres CLONE 1450967-F
  misc_feature: Translation starting site: 224
  misc_feature (604)..(604): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaactcgccctcgtccgcagcgcccacgaaacgcgccgccgccgccgtgacatcgcagcggcgtcggcgtcgtctcggccgctccccgccgtagggccattttcgctcgagctgccggagaccatgtcgagcggtctagacatgtccctggacgacctcatcaagcagtctaagtcccgacccaaggccaaccccgcgtcctcgtcggggcctgcccgccgcgcgcaccccgctcgcgccgcgccctacccaccggtcgctcccaaggcccgtgccaccgccgactcgccttacggggtctactccgagcagatcaccgctatagccgcggccgcgccgctgccggccaaagcaaggtcgctcgagacgggaatgaagctgcacatctccaatcttgactccggcgtcacggtcgaagatgtccaggaactcttctcagaagttggggagctcaagcgttattcaatgaactatgacaaggatgggagatccaaggggactgcnggaagttgtttttgcaaggaaagtggatgctttggatgctatcaagagatancatggtgttctacttgatgggaagccaatgaatttagagctcattggaaacatgtcgaaccacctccccttgcaccattaatacacaatcgtcctttgcagaactatacgatatccacc

SEQ ID NO: 46071 - DNA, 740 bp, Zea mays
  misc_feature: Ceres CLONE 1450972-F
  misc_feature: Translation starting site: 190
  misc_feature: Pfam Name: SCP2 Pfam Description: SCP-2 sterol transfer family
  misc_feature (496)..(496): n is a, c, t, g, unknown, or other
  misc_feature (508)..(508): n is a, c, t, g, unknown, or other
  misc_feature (512)..(512): n is a, c, t, g, unknown, or other
  misc_feature (566)..(566): n is a, c, t, g, unknown, or other
tggagctccccgcggtggcggccgctctagaactagtggatcccccgggctgcaggaattcgcacgagaccattacctagaacatcctaatcgaaaaatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaggtcaccaaagggccgtaccagggaaaagccggatgccactttctccttcacgggacacgatttccttggaaaatcgcacggcaagacgaaatccgcagattgcattcatccgaggggcgaataaaatcanggggagcatcantgcngcgcagaggttcacccctgacatcttccccaggcctggctaagctgtaaaaggntaaattggattacttgggtcgaggtggaattataatgtttgcaagctttcaattactttgttccaaaaaacatggggtgggaactggaaaagcccctttcccgggggaaatttggaaatggtggaatttcccccgaaaacacacccagggggtctgtttcccgggataaaaaaa

SEQ ID NO: 46072 - DNA, 673 bp, Zea mays
  misc_feature: Ceres CLONE 1450977-F
  misc_feature: Encodes the peptide sequence at SEQ ID NO. 46073
  misc_feature (298)..(298): n is a, c, t, g, unknown, or other
gctctagaactagtggatcccccgggctgcaggaattcgcacgagaccattacctagaacatcctaatcgaaaagtgtattcctctgcctccacggctccacccacatggcgctccaggcgcagcagcagcccaccccgtcgccgacgcgcgacagggtgggcagcggcgagtggctggccgacacggagaagctccccggcgccgccgcgtccccggaggacgtcgtcgtcgccttcacgcacgacgccgccgccgccgccattctgtcgcgccagcgccgggccgcggtgatgcancgcgccgcggggctctgcctcgcctcgctcggcgtgctcgctggcgacactcgcaggggctggggccgcgacttctacagcaactacgcccaggtccggtactcggaagccgtcaacgtcgtcgggttcctgtactcggtggtccagttcgtccggctcccccagcttctggaggaggaaaaagcttttgaattcccctaaccaaggggggtctcttccacttccccagggatccgggcgcaacaaaacttctgaaaacgcatccgcaacaaaaaatgtgtcaagaaagtgttttacctggaactgggggggaggattctttcccaaaaatggggaaagggtctccttggccatatcttttgggggtttgtttgt

SEQ ID NO: 46073 - protein, 130 aa, Zea mays
  misc_feature: Ceres CLONE 1450977-F
  misc_feature (64)..(64): Xaa is any aa, unknown, or other
MALQAQQQPTPSPTRDRVGSGEWLADTEKLPGAAASPEDVVVAFTHDAAAAAILSRQRRAAVMXRAAGLCLASLGVLAGDTRRGWGRDFYSNYAQVRYSEAVNVVGFLYSVVQFVRLPQLLEEEKAFEFP

SEQ ID NO: 46074 - DNA, 744 bp, Zea mays
  misc_feature: Ceres CLONE 1450978-F
  misc_feature: Encodes the peptide sequence at SEQ ID NO. 46075
ttccccgcggtggcggccgctctagaactagtggatcccccgggctgcaggaattcgcacgagaccattacctagaacatcctaatcgaaaaaaaccaacttgccgaccgcaggaatccagccgacccagcacttccccggttcctcccagcagagtcttcttctctgcatccgttccgttccccggcctctcgcacatccaccgccaccgagccgcgtgcgtcttccatgaaggacccgttcgaggcggacgtcgaggagcaggactcgccgccggagtcgccggcgccgcccgaggatgaacccggcgccgcgggccctgcggaggaccccgaggactacgacggcggcccgcccccgcgccagccgtctgccccggcgtctcacgcagccggtgccaaggccaaggcccgtgtccatagggagcagcaggaggatgacgacgaggacgaggaccagattgaggtcgacctcgagaagcttcccagcagcactggcgacccagacaagctcgctaagatgaatgctatactgtcccaatttacacaacagcagatgaaccgttatgagtcattccgaagatctggatttcagaaatctaacatgaaaaggctgttggcaagcatcactggaagtcagaagatttctatccctacttcaattgtggtatcgggaatcgcccaaatatttgttggtgagctaattgaaacagcaagagtggtcatgagcgagaggaaggattca

SEQ ID NO: 46075 - protein, 172 aa, Zea mays
  misc_feature: Ceres CLONE 1450978-F
  misc_feature (98)..(172): Pfam Name: TAFII28 Pfam Description: hTAFII28-like protein conserved region
MKDPFEADVEEQDSPPESPAPPEDEPGAAGPAEDPEDYDGGPPPRQPSAPASHAAGAKAKARVHREQQEDDDEDEDQIEVDLEKLPSSTGDPDKLAKMNAILSQFTQQQMNRYESFRRSGFQKSNMKRLLASITGSQKISIPTSIVVSGIAQIFVGELIETARVVMSERKDS

SEQ ID NO: 46076 - DNA, 794 bp, Zea mays
  misc_feature: Ceres CLONE 1450979-F
  misc_feature: Encodes the peptide sequence at SEQ ID NO. 46077
  misc_feature (414)..(414): n is a, c, t, g, unknown, or other
aaagctggagctccccgcggtggcggccgctctagaactagtggatcccccgggctgcaggaattcgcacgagaccattacctagaacatcctaatcgaaaaactcgctagtcgccacttctcccgttgccccccgcgtctctcttctcgttgcgacgactgggcgatccctgccgccccccgtctcccgctccccgccgccaggtgcccaggttgtcgccgggcccttcgccggcgatgagcacccaacaggaggttactgagaactacgcaaatcctaagacatgcttcttccatgttctcttcaaggcatcggcattggcgttctacatactgtccacactgttcgtgaacaacttcgtcatcatctttgtcatcactgtgctcctcgcagcacttgacttctgggtcgtngagaatggtcagcgaaggatactgggttgggctgccgtggtgggaatggagattaacgatgagggaaaaaagtgcctgaaaatttgaatgccttggatgaaaagcccctgcctaggattgataaaaaggacccctgggcggttctgggggaactctaatttgaacggcggcggcggggataaacttggggaaattccccccccaaaaaatttaaaggggaataccttccccctgtggggaagttgtgtggccccccccttttgcaatattttttgggggtccccccgggggttaaagaggcgaaaaaaaacccccgcggtggggaaaagggggcccctcccctcgggggggggaaacaccccccccccccacctttgtgg

SEQ ID NO: 46077 - protein, 87 aa, Zea mays
  misc_feature: Ceres CLONE 1450979-F
  misc_feature (2)..(84): Pfam Name: DUF846 Pfam Description: Eukaryotic protein of unknown function (DUF846)
MSTQQEVTENYANPKTCFFHVLFKASALAFYILSTLFVNNFVIIFVITVLLAALDFWVVENGQRRILGWAAVVGMEINDEGKKCLKI

SEQ ID NO: 46078 - DNA, 657 bp, Zea mays
  misc_feature: Ceres CLONE 1450983-F
  misc_feature: Translation starting site: 573
  misc_feature: SWISSPROT Homolog: EC 2.4.1.207 Xyloglucan:xyloglucosyl transferase
ggagctccccgcggtggcggccgctctagaactagtggatcccccgggctgcaggaattcgcacgagaccattacctagaacatcctaatcgaaaatcatacttcaagttacctgggaaacttgtgcgatttagccctacacgctttacaccaacgtgttcgcgcgatgacatggccaatgagagcatctcttacgcctctggttcgtaccctactactgccttccgctgctactccatcctgtggaacccgcgacacgggatcttcgctgaggactgcgccccggtgcgggacttacaagaaccaccaggcactcggggtggcgttccccacgatgcagcccatgaggctgtactccagcctgtggaacgcccacgactgggccacacagggcgggcgcgtctaggcagactgagtccaaggcccccttcgtcgcctccttccgcggcttcagcgcctacgcctgcgtctgggacggccgcaggcagctctgccctgacggcaccatggaggccgccgacgtcgcggatgccagctcccgccgcggttagtggaaccagcatctcaccgacatgagctaccgccgcatgcgctgggtgcagcgcaagttcatgatctacctctactgcgccgactgctatcgcttcccgcaaggcg

SEQ ID NO: 46079 - DNA, 708 bp, Zea mays
  misc_feature: Ceres CLONE 1450985-F
  misc_feature: Encodes the peptide sequence at SEQ ID NO. 46080
tggagctccccgcggtggcggccgctctagaactagtggatcccccgggctgcaggaattcgcacgagaccattacctagaacatcctaatcgaaaaaaactaccatttttcctccgttccattcttctctcctcgcctcccctcccctcccctcctctcttgaaccctccgccgctccgaggaaaatccgatttgaattgaaaatcatccggagacagagatcttttcttcctcgaagctatcttctctctcgactcgatccatagctgctcgcgtccctgttcctcgccggctggcaagtggcggcgacgggacgaggtcttcatcgcctcctcgcgagcgacgatcacccactagtttggtcggtctgaggcacatgatgatggccaacgcgaagctccacaagcaggccctgctgccgccgcggagccccttcccgacggcggcgccgtacgccgaccgcggcccaatcgcgcggccgcaggttggcgccacgcaccaccgccacggccaccaccagcgcacgtcgtccgagagcttcatcgaggagcagccgccgtcgtggctcgacgacctgctcaacgagccagagacgcccgcggcgcggcagagcggccgggctgggcaccgcaggtcgtccagtgactcgtttgcgttgtttgacggtggagctgctggtgctggtgcttacgccaatggttttcgag

SEQ ID NO: 46080 - protein, 110 aa, Zea mays
  misc_feature: Ceres CLONE 1450985-F
MMMANAKLHKQALLPPRSPFPTAAPYADRGPIARPQVGATHHRHGHHQRTSSESFIEEQPPSWLDDLLNEPETPAARQSGRAGHRRSSSDSFALFDGGAAGAGAYANGFR

SEQ ID NO: 46081 - DNA, 784 bp, Zea mays
  misc_feature: Ceres CLONE 1450988-F
  misc_feature: Translation starting site: 320
  misc_feature: Pfam Name: zf-CCHC Pfam Description: Zinc knuckle
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (21)..(21): n is a, c, t, g, unknown, or other
  misc_feature (38)..(38): n is a, c, t, g, unknown, or other
  misc_feature (426)..(426): n is a, c, t, g, unknown, or other
taattcccacannngngggcnagacaaaaaaaaatatntttttttctgtaccacacaaaaaaacagggactccccgcggaggcggccgctctagaactagtggatcccccgggctggaggaattcgcacgagaccattacctagaacatcctaatctaaaaacgttttaccccgtccggccgtcccccacgttctttctctcccccttctctcacgctgcgacgactgggtaggctgccgccgccgccctacgccaggtcccgaggaccaaggcattcgtattcgtcagtctcttcgccgggcgacgccaggtttcagaatgatttgtgcaacaattgtaagcgtcctgggcattttgctagagagtgtcctagcgtggctgtctgtcatacctgcagggttattgggcacattgcaacagaaagnccacccaaaggtacctgcttggaactgcaaagaatttggccacactggctaacagctgcccaaataaagggatagaaccgtaactagaggcaaggtccggacatattgcagagaagactgcactgactctatcaagagcctcccaggactgagagtgatccttttgcaagaaacaagcttacaagctcagggtgattcttccgtggaggaagggcactcaactgagaaagggccttgcgaacttattaagccggcctagagagggtcaatattttgcctcccgaaactgctaccaaagtagatcccttggttttggcaagtccttgtagcaaatagtttttcctgggacccacctcag

SEQ ID NO: 46082 - DNA, 808 bp, Zea mays
  misc_feature: Ceres CLONE 1450996-F
  misc_feature: Encodes the peptide sequence at SEQ ID NO. 46083
  misc_feature (350)..(350): n is a, c, t, g, unknown, or other
  misc_feature (486)..(486): n is a, c, t, g, unknown, or other
acccgcggtggcggccgctctagaactagtggatcccccgggctgcaggaattcgcacgagaccattacctagaacatcctaatcgaaaaatcttatgatttattggttggttcgtagtggctgtcgttggcggtggtgcgaggagcttgcggcatcgggtgtcggtggcggtggcggtgttccggtccccgagtacgcaggttctggcgacgagatggcgccgccggagaggtatggttgtgcggtcggatgtcgtcgccggtggcgcagccgccgcgacagctggggattcgacgcgggcgctcccaggtcagcaattggctttcagagtcagaggggtttgcttctnattggtgactgcagttgcagcaatcttttttgttgtagctatggttgtgggtccatccacttgtggtgctatttgaccgggtaccgtaggaagacgcaaccactacatcgccaaagatttggggctacggtggacnatcttccatgtttctacattccttgaagtcccaaaggatggaaaaatccgcccccccaaaaacctggccgggggtggccaatgttgccaaccacctcaaagcttcctgggaaattttaccccctttcacaccctggggggggggctttccatttttagcgccaacccgcctttttttttttgtccccttttataggggggggaagagattcccccttgggggggaattccccccgccggcgtttaggcacccaggacccctttgtgtgttctcccacgggggggggccttttgagaaaaaaaaaaccctcttgttttttctt

SEQ ID NO: 46083 - protein, 63 aa, Zea mays
  misc_feature: Ceres CLONE 1450996-F
  misc_feature (39)..(39): Xaa is any aa, unknown, or other
MVVRSDVVAGGAAAATAGDSTRALPGQQLAFRVRGVCFXLVTAVAAIFFVVAMVVGPSTCGAI

SEQ ID NO: 46084 - DNA, 1579 bp, Zea mays
  misc_feature: Ceres CLONE 1450997
  misc_feature: Encodes the peptide sequence at SEQ ID NO. 46085
acgttttaggattcacagattccgcgggggcatgctctgctctgccccggccgggcgcggtagcaactcgcagcttggtcaccgtcgccacgggcggcgatgtgcaagcccagggcaagctccgacgcgttggcatcgcagcccgcggctagcccttcttcccgccgctcctcctcgtccgcctccgccaagcgccgccccgccgcgaccggggcctcctcctcctccccctccacgtcctactctgggacagggccttccggcgccgccacgggcacgggcacgggcacggccacggccagcgcgcagcggcgcggcgccacctcgtcgtcctccacctcctccgcgtcctccggccgcgcctcgctcgccgcggcgcgcgcctcgctcccggacccgccggtcctctaccctttccaggagctggccgccgctaccaacagcttcctcgccaagcgcgcaggtggggccgcctccgcctccgccgccgcctactggcgctgctccctccggggccgcgacgccgcccttttccagctcccgcgccgcccgggcgccgcggccgtggacgccgccgcgcttgccagggtcggcaggtaccaccacaccagcctcgcgcggctgctgggcgcgtgccccgcgggcgcccacctctacctcgcgtacgagctcccgccgggcgccgccacgctggcggcgtgcctccgtggcccgcgcaaccccagcttcacggcgctccgctcctgggtctcccgcctccaggtcgccgccgacgtcgcgcaggggctcgagtacgtccaccaccacgcgagcgccgtccacggccgcgtctccgccttcgccgtgatcgtgtccgacccgggcctccgcgcgcggctcacccacttcggcgcggccgaactcgctgcccccgccgacgcccgtgaggtcgcccactccccctacgcggccccgggctccagcggcagcgagccgtcgcgtgaggcggacgtgtacgccttcggggtgctgctgctggagttgctctccggggaggagccggagaagtaccgcttcgacaggggcaccaaggagttccagcgggtgtcggtcgtcgagacggccgctgctgcggcggcggaaggcggcgtgaggaattgggtggacaggaggctgggggactcgttcccggtgtcggccgcggaaaggctggtggaggtggcgctccggtgcgcagcgttggacttagaggatcggccggacatgatgtgggtcgcggggaaggtgtccaaggtgtatctggagtctcgggtgtgggagcagaagcttcaagtgcccaccgaattctccgtgtcggtggcgccacggtgaaccgaaggcaggcccgcaccgacatcgccggcggtgcgaattacaattttttaggtggtagtggtagattcgttgtagtgagctagtggcctagacgcctagtgcggctggggaaggtaggcaaaccaaaattcgctggaaaaatattaaaaaacttgtgacatttcaatctttccaacaaaatgataaaatgtctacgttttgttgtagaacaaaaaaaaaaaaaaaa

SEQ ID NO: 46085 - protein, 416 aa, Zea mays
  misc_feature: Ceres CLONE 1450997
  misc_feature (133)..(389): Pfam Name: Pkinase_Tyr Pfam Description: Protein tyrosine kinase
  misc_feature: SWISSPROT Homolog: EC 2.7.11.1 Non-specific serine/threonine protein kinase
MCKPRASSDALASQPAASPSSRRSSSSASAKRRPAATGASSSSPSTSYSGTGPSGAATGTGTGTATASAQRRGATSSSSTSSASSGRASLAAARASLPDPPVLYPFQELAAATNSFLAKRAGGAASASAAAYWRCSLRGRDAALFQLPRRPGAAAVDAAALARVGRYHHTSLARLLGACPAGAHLYLAYELPPGAATLAACLRGPRNPSFTALRSWVSRLQVAADVAQGLEYVHHHASAVHGRVSAFAVIVSDPGLRARLTHFGAAELAAPADAREVAHSPYAAPGSSGSEPSREADVYAFGVLLLELLSGEEPEKYRFDRGTKEFQRVSVVETAAAAAAEGGVRNWVDRRLGDSFPVSAAERLVEVALRCAALDLEDRPDMMWVAGKVSKVYLESRVWEQKLQVPTEFSVSVAPR

SEQ ID NO: 46086 - DNA, 750 bp, Zea mays
  misc_feature: Ceres CLONE 1451004-F
  misc_feature: Encodes the peptide sequence at SEQ ID NO. 46087
  misc_feature (667)..(667): n is a, c, t, g, unknown, or other
acccgcggtggcggccgctctataactagtggatcccccgggctgcaggaattcgcacgagaccattacctagaacatcctaatcgaaaaagagacagacgctgccgccgtcggccgtcctccgccctccagtccgctgctcgcccgaccggagtgaggcggcgcggcgatggagcacgggtcgttgacagactcgacgtcgtcgactttctccatcatggatgaggaccacaccctcgccaactccgccagattcgtcctcaaccaggacccaagggtagcattttgtggatataccatccctcatccttctgagaagaaagtgaacataagacttcagacgacaggagatgcagcaaaggatgtactgaaagatgccttgcagaatctgatgattatgtgccagcatgtcagagggacaatggacaccgcggtggttaaccatagagcaaaaaatgctgcagaagaaatggatgttgatcagaactagaatgaacgcagtgtttgttgagaccaaacacaatatcattacagcttttagtactggtcagaagctcggagagctcagtcattgttccagttgtttgtaggagtaacggtcgtattcattggcttccacttctgcaatactgaaacttcttcagtttactgcataattgcttttagncacatctatactactgcttatgtctttagtgtaaaaaaaaaaaaaaaagcttatcgataccgtcgacctcgagggggggcccg

SEQ ID NO: 46087 - protein, 106 aa, Zea mays
  misc_feature: Ceres CLONE 1451004-F
  misc_feature (8)..(83): Pfam Name: RNA_pol_L Pfam Description: RNA polymerase Rpb3/Rpb11 dimerisation domain
  misc_feature: SWISSPROT Homolog: EC 2.7.7.6 DNA-directed RNA polymerase
MEHGSLTDSTSSTFSIMDEDHTLANSARFVLNQDPRVAFCGYTIPHPSEKKVNIRLQTTGDAAKDVLKDALQNLMIMCQHVRGTMDTAVVNHRAKNAAEEMDVDQN

SEQ ID NO: 46088 - DNA, 782 bp, Zea mays
  misc_feature: Ceres CLONE 1451007-F
  misc_feature (650)..(650): n is a, c, t, g, unknown, or other
  misc_feature (651)..(651): n is a, c, t, g, unknown, or other
  misc_feature (782)..(782): n is a, c, t, g, unknown, or other
acccgcggtggcggccgctctttcaatagtggatcccccgggctgcaggatttcgcacgagaccattacctagaacatcctaatcgaaaaagggatgactccatctacggatcctgcccctctctcttcgacgactccgccgttgttgtccactcgagggctgcctccatctgtgcggccggcgccgtccctgtcgtcttctacccaggactgtctcctccgatccgccatagccgcagtctcgcacttgtgaaacacaccgatggatggccagccaagtgctgctgcgtcatctacgcctgtccggagatgtaatgcaagcctggacctacgatccgaatcgttttctatctagttgaacaccgggactctgtaagagcaactggacactgtgacaccccaccaccatggcgcgtcctcattgatcacatctcacggcattatgctccccaccacgcccccgacgaggacgtcgattgcgagtctgacagtgaggacgagacgcggctttgtcgacgacccgccttaaaaacctaggaagcaaaagtgacccgtctcaatttaagcacttgaggtggatgaaccttgctataatgtctcatgtgcccatgcgcttgcttcgatcaacgaaattaatggtttttggtcgnnctatggtggaatgaggggtctttaactcgctaacttgagaggtgcagcccccaaaattttttaggcttccgctggcacctcgtcctgggggaccctcggagaaacaaaattatcgggctttaaaagtctcn

SEQ ID NO: 46089 - DNA, 772 bp, Zea mays
  misc_feature: Ceres CLONE 1451008-F
  misc_feature: Encodes the peptide sequence at SEQ ID NO. 46090
aaactggagctccccgcggtggcggccgctctagaactagtggatcccccgggctgcaggaattcacacgagaccatttcctaaaacatcctaatctaaaaaataaaacgaagatggagtttgattctgagatcatctcatgcgtcctcatccttacaatctacgttgcagctccgacacagtcacacataacgtgggtgacactgactaacacactggctcattgcatcaactacttgaccaacggtggtccattgacgtcaagctgctgtgtggcatcccaatcattgaaccttatggactcagaccactccagatccccgaccaatatgtgagtgccttaaatcaccccccccggaaataaaatgcctcaatatcttaccttgtggacccactccctaccacttgtggtgcttcactttcataccccaatgatttcaacgccaattgagacagtatatctattgccgagtcaaagacactacagatgtactaccgaatcatcgaacttggcccgactcttacctcccctatacttctgctatatgctaactcatgacttgacttgcatattacgtgataccctgaccatatcaacacttgatagcgagaaaacatctacctctcctttaccacgctctgatgtctgacacttttcctgccgtcaacgatgacactgtgactgtctctgtcacggactacatccgatcactaggctgcatgacagaatgagctgtcactatagattctatacccaccgttagcgaactgc

SEQ ID NO: 46090 - protein, 73 aa, Zea mays
  misc_feature: Ceres CLONE 1451008-F
MEFDSEIISCVLILTIYVAAPTQSHITWVTLTNTLAHCINYLTNGGPLTSSCCVASQSLNLMDSDHSRSPTNM

SEQ ID NO: 46091 - DNA, 684 bp, Zea mays
  misc_feature: Ceres CLONE 1451009-F
  misc_feature: Encodes the peptide sequence at SEQ ID NO. 46092
ctggagctccccgcggtggcggccgctctagaactagtggatcccccgggctgcaggaattcgcacgagaccattacctagaacatcctaatcgaaaaatctgccgtccctgcactgcgcttataccctgcaggcaacagcagcgatggcggcgagggtaccggcggccgatctcaaccagcacctctcctcgccgttcatcgcacggcgctgccacggcccaggtgaagccgccctcgaggcgcctctcagcgtacgcatcaaatccagaacgccgcggcgacgcgcggaatccacgaccacgaggatcctctgcaggggcgcagaggcgcagcagggcttctggaggagggaggaggagggagccgctgcggcgcggggccgtcagcgcgcgcctcccggtgccggaccacatacgccggccgccctacgtcggcacggccgccgtcccggaggtgtgccccgaccggcaggtgcacgacggcgagagcatcatgcggatgctggacgcctgcgagctcgccgctcgggtgctgcaccatgccggggcgatggtcaagccctccgtgacgacggacgagatcgacagggctgtgcaccagatgatcgtcgacgccggcgcctacccctcccctctcggatacggcgggtcccccaagagcgtgtgcacgtcggtgaacgagt

SEQ ID NO: 46092 - protein, 227 aa, Zea mays
  misc_feature: Ceres CLONE 1451009-F
  misc_feature: SWISSPROT Homolog: EC 3.4.11.18 Methionyl aminopeptidase
GAPRGGGRSRTSGSPGLQEFARDHYLEHPNRKICRPCTALIPCRQQQRWRRGYRRPISTSTSPRRSSHGAATAQVKPPSRRLSAYASNPERRGDARNPRPRGSSAGAQRRSRASGGGRRREPLRRGAVSARLPVPDHIRRPPYVGTAAVPEVCPDRQVHDGESIMRMLDACELAARVLHHAGAMVKPSVTTDEIDRAVHQMIVDAGAYPSPLGYGGSPKSVCTSVNE

SEQ ID NO: 46093 - DNA, 739 bp, Zea mays
  misc_feature: Ceres CLONE 1451015-F
  misc_feature: Encodes the peptide sequence at SEQ ID NO. 46094
ctggagctccccgcggtggcggccgctctagaactagtggatcccccgggctgcaggaattcgcacgagaccattacctagaacatcctaatcgaaaactgatctcattcagcagtacctggatgagaacaagcagctgatcctggccatcctcgacaaccagaacaacggcaaggtggaggagtgtgcacggaaccaagctaagctccagcagaacctcatgtacctcgccgccatcgccgacagccagccgccgcagacggcgtcgctgtctcagtacccgtccaacctgatgatgcagtccgggccgcggtacatgccgcagcagtcggcgcagatgatgtcgccgcagtcgctgatggcggcgcggtcgtcgatgatgtacgcgcagcaggccatgtcgccgctccagcagcagcagcagcagcagcagcagcaccaggcggcctcgcacggccagctggggatgtcctccggcgcgaccaccgggttcaacctcctccacggtgaggccagcatgggcggcggcggcggcgccactggcaacagcatgatgaacgccggcgtcttctcggactacggccgcggcggcagcggcgccaaggaggggtcgacctcgctgtcggccgacgctcgcggcgccaactctggcgcgcacagcggcgacggggatactcaggggggcaccggaggaagagggaagctaggccagcggcatcgtcgctagcaccggcatagc

SEQ ID NO: 46094 - protein, 168 aa, Zea mays
  misc_feature: Ceres CLONE 1451015-F
MYLAAIADSQPPQTASLSQYPSNLMMQSGPRYMPQQSAQMMSPQSLMAARSSMMYAQQAMSPLQQQQQQQQQHQAASHGQLGMSSGATTGFNLLHGEASMGGGGGATGNSMMNAGVFSDYGRGGSGAKEGSTSLSADARGANSGAHSGDGDTQGGTGGRGKLGQRHRR

SEQ ID NO: 46095 - DNA, 808 bp, Zea mays
  misc_feature: Ceres CLONE 1451026-F
  misc_feature (328)..(328): n is a, c, t, g, unknown, or other
  misc_feature (351)..(351): n is a, c, t, g, unknown, or other
  misc_feature (360)..(360): n is a, c, t, g, unknown, or other
ggagctccccgcggtggcggccgctctagactagtggatcccccgggctgcaggaattcgcacgagaccattacctagaacatcctaatcgaaaaatcacatgccgctgatgcttcgcgtctcctactccctcctgcttccacctattaatccaccccactctcttccctccccgttccacccgcctctaccgccgcgagatccggctccgcttccagaaacttctggaacgcccgttccatgagcgtctgatcggccgccgccatgggctgcgctggatccacccccaaagtcgacgagaacagcaagaaactgaaaagggcctaangcttgaaagcatacccaaccaanttacaaccnggcacgctgaaacagatgcgtgatgagtttctgggacaccgctccgcactaccgagggccaaaaagagatctggaatgctctgaagggttgccgcggaaatcggaattctagccttgcacaaaaccatcgtggaacgtgcttgaaatcatcgggtccaaaccttgaaatgaaccttttgttaccaacaaaaaaagggccaaagcacaacttgcccaaattttgttttggggagaccccgaaacctattcccgcaagggggattttggacccccaaaagtttttctccccaccaaaaaaggcccccggatattttcgcggagggtgtaatccccgcccgggtctggagtagaactttttgggggaaaaaaacccctccttcccccggggtgttttatagagtttttttttaacacaaggttttccctctaacacccgctcgtgggagcc

SEQ ID NO: 46096 - DNA, 760 bp, Zea mays
  misc_feature: Ceres CLONE 1451031-F
  misc_feature (358)..(358): n is a, c, t, g, unknown, or other
ctccccgcggtggcggccgctctagaactagtggatcccccgggctgcaggaattcgcacgagaccattacctagaacatcctaatcgaaaaaccttcttctcgaccagatccggaagttctgtgggtagaggactagagactgcagatcgagggtctggcagcgggccgtggcagttgggtgattacgacgaagagagatgggcctcctcgacaagctgtgggacgacaccgtcgcaggcccgcgcccggacaccgggctcggccgcctccgcaagcagcctgtgcgtcccgccgcccgtcagatcagtgatcccggccggggacgctgcagcgttcgtgccgccctcgccggcttncggtagcgaggagacgctggtgaaggtgacgcgcaacatcatgatcaagccgccccgcggggtacccgtcgtccccaaaggagccggaaagcacccccgccgggcccccccctgggggacaaccccccccattctcccgtttgccgggcccggggtgcgttcaaaaaagaaaaccccccccccaccaaaaaaaggggccccccccgggggaaaaaacccccccccccctttaaaagggggaaacgcccccccccccccttgtgtgtgcccctccaaagatctttttgggggaaggggggggccggaaaaaaaaaaaccctgggggggcgggggggtttctaccggggggggcccccccccggggggaaaattttaaggaaaaaattggggggggcccccccc

SEQ ID NO: 46097 - DNA, 737 bp, Zea mays
  misc_feature: Ceres CLONE 1451033-F
  misc_feature: Encodes the peptide sequence at SEQ ID NO. 46098
aaagctggagctccccgcggtggcggccgctctagaactagtggatcctccgggctgcaggaattcgcacgagaccattacctagaacatcctaatcgaaaactctctcccagtccccagtccccacccaccaccagtcttcctcgctctccaaatctcgcgacgagaaagcccatctaggaccacaggggcgcgccagccggcaggaacgacgggagaggagggcatggagccggctgagcggatcgagtcggctgggacggcgctggggaagcgtccgaggagcagggtgctgccgcgcacggccagcatggtgacggtgccgtcggcggcgaagcaggggcgccaggagcggggcgccggcgtgccgtcgtcctgctcactgccggctgcctgcgccgggatggtggccgtgccggggggttactactactgtggcacctcgttcgcggcggtggagacggcggccttcctgaaggcgtgcggcctctgcaaacgccacctcgggcccggccacgacaccttcatctacaggttccagtcggcgtggttttttttttttgtttttttttttttttttttgcttaagatcgcatcttttcccttcatattcatggcccctattttactttacattatgaggcacataatagtttttttttaatcagctgtcacagtactccgctgagtgtgtgtgaatctaattccctctagtattttttttttggtggaaggaa

SEQ ID NO: 46098 - protein, 145 aa, Zea mays
  misc_feature: Ceres CLONE 1451033-F
MEPAERIESAGTALGKRPRSRVLPRTASMVTVPSAAKQGRQERGAGVPSSCSLPAACAGMVAVPGGYYYCGTSFAAVETAAFLKACGLCKRHLGPGHDTFIYRFQSAWFFFFVFFFFFLLKIASFPFIFMAPILLYIMRHIIVFF

SEQ ID NO: 46099 - DNA, 740 bp, Zea mays
  misc_feature: Ceres CLONE 1451042-F
  misc_feature: Encodes the peptide sequence at SEQ ID NO. 46100
  misc_feature (348)..(348): n is a, c, t, g, unknown, or other
  misc_feature (351)..(351): n is a, c, t, g, unknown, or other
  misc_feature (353)..(353): n is a, c, t, g, unknown, or other
  misc_feature (354)..(354): n is a, c, t, g, unknown, or other
  misc_feature (365)..(365): n is a, c, t, g, unknown, or other
  misc_feature (376)..(376): n is a, c, t, g, unknown, or other
  misc_feature (527)..(527): n is a, c, t, g, unknown, or other
tggagctccccgcggtggcggccgctctataactagtggatcccccgggctgcaggaattcgcacgagaccattacctagaacatcctaatcgaaaacccactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgcctcggctcccgcgtccgacgccgcagccgccgtacccctcgccgnggncnntcctcgcgctngtcgcttcggntacctcttctgctagatccgcgctggatacccggctcctgctccaaaatatgattcgtctggtctggcccgcgtgaatccagctcggggtccggcgggtccctgggtgaggtgccggccggcctggtggtattattgaatctcgccccccncccccaaaaaagaaggggcccctggggggggaaactgtttccccccccctggttttgccgggaaaaaggaaaccccggggggttttcggggtacccggggaggattttttgttttcaaaaaaaaaaaaaatctttttttccccccaccccgggggggggcccgcaccccttccccccaaagggggtaatacccccccccgggcggccgtttaa

SEQ ID NO: 46100 - protein, 57 aa, Zea mays
  misc_feature: Ceres CLONE 1451042-F
  misc_feature (44)..(44): Xaa is any aa, unknown, or other
  misc_feature (45)..(45): Xaa is any aa, unknown, or other
  misc_feature (46)..(46): Xaa is any aa, unknown, or other
  misc_feature (50)..(50): Xaa is any aa, unknown, or other
MAGLRMKFVAVAAMAAALVASAAAAEAPASAPASDAAAAVPLAXXXPRAXRFGYLFC

SEQ ID NO: 46101 - DNA, 803 bp, Zea mays
  misc_feature: Ceres CLONE 1451049-F
  misc_feature: Encodes the peptide sequence at SEQ ID NO. 46102
  misc_feature (381)..(381): n is a, c, t, g, unknown, or other
  misc_feature (413)..(413): n is a, c, t, g, unknown, or other
  misc_feature (681)..(681): n is a, c, t, g, unknown, or other
cacctggagctccccgcggtggcggccgctctagatctagtggatcccccgggctgcaggaattcgcacgagaccattacctagaacatcctaatcgaaaacccagcctcgccgccccaccaccccagcattgccttaccttgccttgccttcccctccatcccacctccacctcgccgctcgaatcccccccaacccaacaatcccccatggggtcgcaggccatcgaggcgcaccgcgcgggcgcggaggtgtaccgcggcgcggcgctgtgcgcggagaagtcgacggagctgctggcagaggcgcacctcccgctgggcctgctgccgctggccgacatggaggaggtcggctacaaccgtgttatgggcttcgggnggctgcgcgggaggaaagtgctcacgcacacnttccccccccatcccgcgtcaggtctggtaagccgccgaagtcaacgccctttcttggaagaaccggccgaagaaggcgcatgacccggggtcaagacccaaggaggcccctcatccgggtccaccctcctcccaaatgttccttccacagggataaaccggtccaagaatcccttctaaaatccccaccgggattcgggaagaacttaacgcgagtcatccgtcttctcaccacagatggccgtcttgctgaaaaaagggtctgccngcaaacgcgcgaggaagagaggggctcgcccaccagcagccacccacacgctcattgaaactatgaagtaataccacaaaaacatcccaaccatatattcctccgccctaaaccaccacaag

SEQ ID NO: 46102 - protein, 95 aa, Zea mays
  misc_feature: Ceres CLONE 1451049-F
  misc_feature (58)..(58): Xaa is any aa, unknown, or other
MGSQAIEAHRAGAEVYRGAALCAEKSTELLAEAHLPLGLLPLADMEEVGYNRVMGFGXLRGRKVLTHTFPPHPASGLVSRRSQRPFLEEPAEEGA

SEQ ID NO: 46103 - DNA, 691 bp, Zea mays
  misc_feature: Ceres CLONE 1451051-F
  misc_feature: Encodes the peptide sequence at SEQ ID NO. 46104
  misc_feature (417)..(417): n is a, c, t, g, unknown, or other
  misc_feature (501)..(501): n is a, c, t, g, unknown, or other
  misc_feature (569)..(569): n is a, c, t, g, unknown, or other
  misc_feature (570)..(570): n is a, c, t, g, unknown, or other
  misc_feature (573)..(573): n is a, c, t, g, unknown, or other
tggagctccccgcggtggcggccgctctagaactagtggatcccccgggctgcaggaattcgcacgagaccattacctagaacatcctaatcgaaaagcccaaatcccccgactcctcgcttcctcccgttccgtcgccgccgcgcgcctcggagaagagatagaggcggccgctgcatcgaccccgcgccacccccgcctgcctcccccggcaccgatcgggtttgatcgatggcgtcgaagaggatcctgaaggagttgaaggacctgcagaaggacccgcccacctcctgcagcgcaggtcctgttggtgaggacatgttccattggcaagcgaccatcatggggccttcggacagcccatttgcaggtggggtattcttggtgaacattcacttcccaccggattaccctttncagccaccaaaggtgtctttccgcaccaaggttttccacccgaaacatcacagcaacggcagcatttgccttgacatttctaanggacagtggagtcctgggcttactatctcaaagggtctcctggtcatctgctcactgctccacgaccnnaanccttgatgatcctcttgtccctgaaattgctcacatgtacaaaaccgacgggggccagtatgagtccaccgcacgctcctgaaccagaaatgcctgggttaaaccaggttaacctgcc

SEQ ID NO: 46104 - protein, 115 aa, Zea mays
  misc_feature: Ceres CLONE 1451051-F
  misc_feature (5)..(112): Pfam Name: UQ_con Pfam Description: Ubiquitin-conjugating enzyme
  misc_feature: SWISSPROT Homolog: EC 6.3.2.19 Ubiquitin--protein ligase
  misc_feature (62)..(62): Xaa is any aa, unknown, or other
  misc_feature (90)..(90): Xaa is any aa, unknown, or other
  misc_feature (113)..(113): Xaa is any aa, unknown, or other
  misc_feature (114)..(114): Xaa is any aa, unknown, or other
MASKRILKELKDLQKDPPTSCSAGPVGEDMFHWQATIMGPSDSPFAGGVFLVNIHFPPDYPXQPPKVSFRTKVFHPKHHSNGSICLDISXGQWSPGLTISKGLLVICSLLHDXXP

SEQ ID NO: 46105 - DNA, 790 bp, Zea mays
  misc_feature: Ceres CLONE 1451063-F
  misc_feature: Translation starting site: 284
  misc_feature (353)..(353): n is a, c, t, g, unknown, or other
  misc_feature (418)..(418): n is a, c, t, g, unknown, or other
  misc_feature (444)..(444): n is a, c, t, g, unknown, or other
  misc_feature (445)..(445): n is a, c, t, g, unknown, or other
tggagctccccgcggtggcggccgctctagaactagtggatcccccgggctgcaggaattcgcacgagaccattacctaggacatcctaatcgaaaagaatcgcctctcagaaccgagatcctcaaaacccttttccctcctcccttctcccctctcggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcatgtgacgtgggaagaccagcagatcatcaaccgcttcgggntcgctcacaaccgccctcacgagctccagaagaagatcagctcgcaaaggagacgaatgaaaccnttgatgatgctgggaatgaactcatnnctgtccatgaagaactttgtaccttccaaattgggggatggggttgctcccatgcccagggaataactccaaacatagcgggaacaaatgaaaaagagtcggcctaaaaacctggaaggtttaaggaggaaaaggaaacccccccggcccaagaggccaaattgaaaaaaaaatggggcgggaaaccaagggcgcccccccccgggggaaaataaaccccccgggggcggggccatttggggggtttttcttccacagagggggtgtttttccccgcgcgccccgccccccaaaaaaaaatgtgggggggggggcggggggggggagggctctaacaaaaaaaaa

SEQ ID NO: 46106 - DNA, 767 bp, Zea mays
  misc_feature: Ceres CLONE 1451073-F
  misc_feature: Encodes the peptide sequence at SEQ ID NO. 46107
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
ctggagctccccgcggtggcggccgctctagaactagtggatcccccgggctgcaggaattcgcacgagaccattacctagaacatcctaatcgaaaaaaccaaacttccggtcttctcttctccactaccacccgcctgcccgcgcgccttctcctccaccactgccccgtcgtggaataggggcaagttcaggcatctcgcttctgtcctggtcgaggggatcggagaaaaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggggtccgggtccgggtccgaccgtagcgacctgagccacggcgccggccaggtttatcgccccgtggcgcggtccggcgggttcgagcggggatgcagaaaannnncnnngtgc

SEQ ID NO: 46107 - protein, 178 aa, Zea mays
  misc_feature: Ceres CLONE 1451073-F
  misc_feature (11)..(57): Pfam Name: Myb_DNA-binding Pfam Description: Myb-like DNA-binding domain
  misc_feature (63)..(108): Pfam Name: Myb_DNA-binding Pfam Description: Myb-like DNA-binding domain
  misc_feature (175)..(175): Xaa is any aa, unknown, or other
  misc_feature (176)..(176): Xaa is any aa, unknown, or other
  misc_feature (177)..(177): Xaa is any aa, unknown, or other
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSDRSDLSHGAGQVYRPVARSGGFERGCRKXXXC

SEQ ID NO: 46108 - DNA, 674 bp, Zea mays
  misc_feature: Ceres CLONE 1451084-F
  misc_feature: Encodes the peptide sequence at SEQ ID NO. 46109
ctggagctccccgcggtggcggccgctctagtactagtggatcccccgggctgcaggaattcgcacgagaccattacctagaacatcctaatcgaaaaacgtccccgtcggccatcgtccacggatcctatcggtctctcctctgtcctcttcagtctccacgccgttccagaagtcgccaaccttccctcgccgccgcgccgcaacagccgcctcccctccaaggtagcccaatcgaaaccactcgcccgaccaccatggcctttgccagctcgctgcttcccgtgccgccctcccgcgtctgcgcgacccccgcgtcggaggtcgccgccttctcgccggccaagaagagcgtctcgctcgccgctgcgcgccagcgccgaggatcccgtcacggagtgagggcagaagtaaatgaatctggaagtgttttggctgttgatgcactctcgcaagttaaacatgttctgcttccagtccttgatcgcaacccttacctttctgaaggcacaagacagttattgatgataaaccaaaggagtctgtcccagagcatgatactcaaatgtcaagcattagatggcatctctcagaaggcggattttcggagtttagattgatggagcgtcttggggaagggcagaaaccaacagttatcatcggggaagttgctg

SEQ ID NO: 46109 - protein, 120 aa, Zea mays
  misc_feature: Ceres CLONE 1451084-F
MAFASSLLPVPPSRVCATPASEVAAFSPAKKSVSLAAARQRRGSRHGVRAEVNESGSVLAVDALSQVKHVLLPVLDRNPYLSEGTRQLLMINQRSLSQSMILKCQALDGISQKADFRSLD

SEQ ID NO: 46110 - DNA, 723 bp, Zea mays
  misc_feature: Ceres CLONE 1451085-F
  misc_feature (356)..(356): n is a, c, t, g, unknown, or other
aagctggagctcaccgcggtggcggccgctctagaactagtggatcccccgggctgcaggaattcgcacgagaccattacctagaacatcctaatcgaaaaacaatcccgctgttcgcgagccactccctctcacgagtgacgacgaaaccctaggccatggcttggcgcggcgccgcctcccgctccattatcgccgccgtccgtgctcgcgccgcatccccgtcttccaccgccgcctcgcgcctccgctcgacggctccacttcccgccccctcgcgccggtccgtccccgccttcgctttcgcgaccgcgaggccgttggcggcgatgtcggggtcccggggcgcgtcgtgntgaagctcaccgggcactcggcgacaagcgtgcgggcctgctgtgagctctcccaggcccaaaatggaaggattgttgatgagaaatcaaacggaaggttccaactctggggccttaaaggcgccttttgccctaaaaggaagattgggatctttggagggggaccccttggaaaaccacggggtggggcctttttcgggggttttggaaaaaatttccccctgggggtgggaaaaaaaaaatatttcgtgtgtttttaaaaaaaattttgtgggcgggggggtacctccccccccccaattggaaaaaaaaatgggggggggccccttttttgtgaaacccccccgcgtggggtgaaacaacccca

SEQ ID NO: 46111 - DNA, 712 bp, Zea mays
  misc_feature: Ceres CLONE 1451091-F
  misc_feature: Encodes the peptide sequence at SEQ ID NO. 46112
ctggagctccccgcggtggcggccgctctagaactagtggatcccccgggctgcaggaattcgcacgagaccattacctagaacatcctaatcgaaaacaccgcagccctagcgcgccgccaccttcaccttcgcagccctagccgccgccgccgcctccattgctgctatacccgcaaccatgggtcccgtgctgaagcgcccgaccccgggcacagtgcagtgtttcgggcgcaagaagacggccgtggccgtggcctacacgaagccaggccgagggatgatcaaggtgaacggcgtcccgatcgagctgccccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcatactaccagaagtacgtcgacgaggcggcgaaaaaggagatcaaggacatcttcatgcgctacgagcgcaccctcctcgtcgccgacccccgccgctgcaagcccaagaagttcggcggccgcggcgcccgcgccaggttccagaagtcctaccgctgagcgccagcgcctgccggaccgctgtcgtggctccgtttagctacgactttacagaactctgataataacatggttggcgaa

SEQ ID NO: 46112 - protein, 149 aa, Zea mays
  misc_feature: Ceres CLONE 1451091-F
  misc_feature (17)..(149): Pfam Name: Ribosomal_S9 Pfam Description: Ribosomal protein S9/S16
MGPVLKRPTPGTVQCFGRKKTAVAVAYTKPGRGMIKVNGVPIELPRPEMLRLKAMEPVLLAGRSRFKDIDMRIRVRGGGKTSQIYAIRQAVAKGLVAYYQKYVDEAAKKEIKDIFMRYERTLLVADPRRCKPKKFGGRGARARFQKSYR

SEQ ID NO: 46113 - DNA, 670 bp, Zea mays
  misc_feature: Ceres CLONE 1451102-F
  misc_feature: Encodes the peptide sequence at SEQ ID NO. 46114
tccccgcggtggcggccgctctatatctagtggatcccccgggctgcaggaattcgcacgagaccattacctagaacatcctaatcgaaaagcaagcgcagaagcacaaccacaacacctcgcctcgtcagatcgaccgggaagaagggagcagaagccaaccggctcgtccgcccgttgcctgtcgtcgctatggccgccgtggaggtgtgcgtgaaggccgccgcggggaaccccgacacgctcggcgattgcccgttctcgcagagggtgctgctcacgctggaggagaagaaggtcccgtacgaggtgaagctcgtcgacctcggcaacaagcccgaatggtttctgaacatcagcccagagggtaaggtgcctgtgttcaacggtggagatggcaaatgcatcgccgattctgatgtaatcatccaagtcattgaggagaagttcccgactccttctctggtcacccctccagaatatgcctcagtgggatcaaagattttcccagccttttgtcagtccttgaagagcaaggatgggagtgatggggccaaaaaggcgcttctggatggactgccggcactggatgaatcatctcaaagctcatgggcccctacattaattggggagaacgtgtccaccgaactgatctttaagcctggggccc

SEQ ID NO: 46114 - protein, 159 aa, Zea mays
  misc_feature: Ceres CLONE 1451102-F
  misc_feature (16)..(84): Pfam Name: GST_N Pfam Description: Glutathione S-transferase, N-terminal domain
  misc_feature: SWISSPROT Homolog: EC 2.5.1.18 Glutathione transferase
MAAVEVCVKAAAGNPDTLGDCPFSQRVLLTLEEKKVPYEVKLVDLGNKPEWFLNISPEGKVPVFNGGDGKCIADSDVIIQVIEEKFPTPSLVTPPEYASVGSKIFPAFCQSLKSKDGSDGAKKALLDGLPALDESSQSSWAPTLIGENVSTELIFKPGA

SEQ ID NO: 46115 - DNA, 737 bp, Zea mays
  misc_feature: Ceres CLONE 1451114-F
  misc_feature: Encodes the peptide sequence at SEQ ID NO. 46116
aagctggagctccccgcggtggcggccgctctagatctagtggatcccccgggctgcaggaattcgcacgagaccattacctagaacatcctaatcgaaaaatcccaaatctcaacccaagaacaaaaatggccaccgccaccactgaagccgaagtccgtgagtccctcggcacgaagttcggtcgcctcaaggaacaggcgaaagacatggcctccaggcaccccgtcgctggagccgcggccgtcatcgctgtcagcgccgtgggcgcctacttcttgtggcccgtggcagccccggccgtggccatgatgaaggcgcctggatccgggcgtgtgctcgtctcccgcgcggcgtttctcgcggagaaggagctgtacttcaagctcctgcccacggggggcgttgcggcggcgtcccccccttgggcgtacctgcccatgcaaaaggggaactgcctgttcgggaaaaaagggggggcccaaaatttcaggttttttgtttaccaagggggttttaaactttcccttctctggggggggaaccccccacccccgggtgggatatttccggcaaaaacctttttgtgcgcgggggaaacctttttagaaaaagaagaaacctctttaaaaaaaaaagggggttgtggcgccaaaaaaaaaaaaaaaattttttttttccccccccccccccgggggggggggcgccacccccccccccccccaattatttttttt

SEQ ID NO: 46116 - protein, 203 aa, Zea mays
  misc_feature: Ceres CLONE 1451114-F
MATATTEAEVRESLGTKFGRLKEQAKDMASRHPVAGAAAVIAVSAVGAYFLWPVAAPAVAMMKAPGSGRVLVSRAAFLAEKELYFKLLPTGGVAAASPPWAYLPMQKGNCLFGKKGGAQNFRFFVYQGGFKLSLLWGGNPPPPGGIFPAKTFLCAGETFLEKEETSLKKKGGCGAKKKKKIFFFPPPPRGGGRHPPPPPIIFF

SEQ ID NO: 46117 - DNA, 620 bp, Zea mays
  misc_feature: Ceres CLONE 1451117-F
  misc_feature: Encodes the peptide sequence at SEQ ID NO. 46118
agtggatcccccgggctgcaggaattcgcacgagaccatacctagaacatcctaatcgaaaacttttcggactaaacatttcgtctaacgccagcggtgaggcgagctcgagctcgagccccagtcaccgcagccatgctcctcacgaaaccctacctctccaactcgctccttccagtcccatccccgccgccgtcgggccctactctcagctccaaccatgcaagcccccttgccgcccctacttgccgtcgcagccgcctccgcatctccgccacatccacgggtgcgccgtctccttcgtcggctgccgctgccaccgcgtcgctgagtcgagtggacgtgctctcggaggcgctcccttttattcagcgcaccaaaggcaagacggaggtggtcaagtacggcggtgcggcgatgaagtccccggagctgcaggcgtccgtgatccgcgatctcgtgctgctctcctgcgtcggcctccgccccgtgcttgttcacggcggcggtccggagattaattcctggctgctgcgcgtcggcgtcgagccgcagttccgcgacgggctccgcgtcacggacgcgctcaccatggaggtcgtcgaagaggtgctagtcgg

SEQ ID NO: 46118 - protein, 161 aa, Zea mays
  misc_feature: Ceres CLONE 1451117-F
  misc_feature: SWISSPROT Homolog: EC 2.7.2.8 Acetylglutamate kinase
MLLTKPYLSNSLLPVPSPPPSGPTLSSNHASPLAAPTCRRSRLRISATSTGAPSPSSAAAATASLSRVDVLSEALPFIQRTKGKTEVVKYGGAAMKSPELQASVIRDLVLLSCVGLRPVLVHGGGPEINSWLLRVGVEPQFRDGLRVTDALTMEVVEEVLV

SEQ ID NO: 46119 - DNA, 668 bp, Zea mays
  misc_feature: Ceres CLONE 1451126-F
  misc_feature: Encodes the peptide sequence at SEQ ID NO. 46120
ggagctccccgcggtggcggccgctctagaactagtggatcccccgggctgcaggaattcgcacgagaccattacctagaacatcctaatcgaaaaatagggacagagacagtagtcttagatcctgacacggccaccgggagtagctctggccatgaggacctctacggctacatgtgctatcctccttccacctaactgatcctcccgtcgtttcccgctccacagcttcatcggtctccggaggtccgccccccgtttccaggttagggagcgagctgatgcatccgtaaagattgtcaatgtcaagcccggatgcaccttcagactctgagtacgctacttcaatgtctagaaatgtcatcaactggcaaccgtcactataaatgaacatgctcttaatgctgaccttccacgagattattcgaaaagagagatgaatcgctttcctatcccactgctggtgttaaagcaccgaccaaaggataggatgaaggcatcacaaagtaaacctaaacactcaatgcgtccacataaaacgggatgctagtgcgtcatactattacagttgcataccaagtgaaaatgcaagaatcttgctgatcaacaactttaaaggttgatgaaagtataccagtaaaaagctgcaagtatggcccgaaataaag

SEQ ID NO: 46120 - protein, 37 aa, Zea mays
  misc_feature: Ceres CLONE 1451126-F
MNRFPIPLLVLKHRPKDRMKASQSKPKHSMRPHKTGC

SEQ ID NO: 46121 - DNA, 763 bp, Zea mays
  misc_feature: Ceres CLONE 1451138-F
  misc_feature: Encodes the peptide sequence at SEQ ID NO. 46122
  misc_feature (763)..(763): n is a, c, t, g, unknown, or other
aaagctggagctccccgcggtggcggccgctctagaactagtggatcccccgggctgcaggaattcgcacgagaccattacctagaacatcctaatcgaaaactagcacaccagacgccgccgcgagcccccagcatcccagcccagatgttcctcgccgacaagtacagctcgctgctgcccttccaccaccaccattccaagcccagccgacgccagcagcagaagggggaggcgcaccggttcggcacggcgctggccgcgcgcctccggggcctgctgccgatgccggcctccccgctcgcggcgctcgtgcgggtggacgacctcctcgcgctcacgctcgtcgaggcggggccagtgatcgcttgcacaggcaagggcgctcacatcaccgccgacctagacacaccccacgcgctcctatacacctgcgacaccatacgcgcgcggctcgacggcctcaccaggttccgactcgtcgaaaggctcaagctggacgtactcatctgctgcatctcgccatttcggcttaggcacacgcgcggcggcgctcggaaaccgggacactccggacccaccgccgtggccgatggctccgttcaagagcccgctggtcatgcacaagctgacgggttcgacaacgccccgttggaccccagctcctcacttgaggggaggccggaattacccttttccacggaagacctgttaccttcgctcgggctgccagaagcgctagcaacttccctggggaagaccn

SEQ ID NO: 46122 - protein, 205 aa, Zea mays
  misc_feature: Ceres CLONE 1451138-F
MFLADKYSSLLPFHHHHSKPSRRQQQKGEAHRFGTALAARLRGLLPMPASPLAALVRVDDLLALTLVEAGPVIACTGKGAHITADLDTPHALLYTCDTIRARLDGLTRFRLVERLKLDVLICCISPFRLRHTRGGARKPGHSGPTAVADGSVQEPAGHAQADGFDNAPLDPSSSLEGRPELPFSTEDLLPSLGLPEALATSLGKT

SEQ ID NO: 46123 - DNA, 685 bp, Zea mays
  misc_feature: Ceres CLONE 1451139-F
  misc_feature (366)..(366): n is a, c, t, g, unknown, or other
  misc_feature (393)..(393): n is a, c, t, g, unknown, or other
aaactggagctccccgcggtggcggccgctctagaatagtggatcccccgggctgcaggattcgcacgagaccattacctagaacatcctaatcgaaaagactgtgagcttcgttcgttcagttcatccgtgttcttgtttgcgaggtcgagagagagaggatgtcgtgctgcggaggaactgtgggtgcggctccggctgcagtgcggcacggctgcggaggtgcagcaagtgtacccggaatggctgacaggtgacaccaccacccaggctctcatcatgggtgtcgcaccatcaaggggcacgccgagggcgggttcgaggcggccgccggagctgagaacggcggggtgcagtgcggcggcnactgccagtgcgacccctgcaactgcngcaagtgagctaggtgctccaccctgcaggccggccggaggaagctagctaattattatagcctaaataaagtataccggcgtccctgggtgtggtttccagtccgtccgtccagttaattggctgcccatgcctggcatgctccggatcctaaaatgataataatgccgaatggcgggcccccgggcccgtgaacccccccctggccccctcgggccttttggggggaaaaaaggggtttgggtttggttttggggggggcccacgggtaaagggttaccctgggccccgt

SEQ ID NO: 46124 - DNA, 722 bp, Zea mays
  misc_feature: Ceres CLONE 1451144-F
  misc_feature: Encodes the peptide sequence at SEQ ID NO. 46125
  misc_feature (441)..(441): n is a, c, t, g, unknown, or other
  misc_feature (541)..(541): n is a, c, t, g, unknown, or other
aagctggagctccccgcggtggcggccgctctagaactagtggatcccccgggctgcaggaattcgcacgagaccattacctagaacatcctaatcgaaaaaatcatttctgggatcatttctcaggtcgcgcagcaaagtagcaaactcctgcgaccctacccaccgcacctaccattctggagaggagaggaacagagccaagaaacaagcccggaagatggcaggcggcggggtggtgaagcacatcctgctagcaagcttcaaggaggaggtgacgcaggagcgcctggacgagctcatccgcggatacgccgcgctcgtcggcgtggtcccctccatgaaggccttccactggggaactgatgtgagcatagaaaacatgcatcaaggggtcacgcacgtcttcgagtccacgtttgaaagcatggaaggaatcanggagtacattgagcaccctgcacacgtcgaatttcgcagtgtggtctttgctgtgctggaaaaggtcctcatatcgactacaaacgacgtcgggcattantggtagacatgctctgtacttgttcctcggaggatccaggtgggtctaccctttattttgcaaaaaactccgctcggttggcccttggaaaaagggactttgaattttcggagggcaatggggagcttcccggttttccagggggattcccttcccaaaaaaaaaaaaaagcttttcttcc

SEQ ID NO: 46125 - protein, 108 aa, Zea mays
  misc_feature: Ceres CLONE 1451144-F
  misc_feature (7)..(103): Pfam Name: Dabb Pfam Description: Stress responsive A/B Barrel Domain
  misc_feature (74)..(74): Xaa is any aa, unknown, or other
  misc_feature (107)..(107): Xaa is any aa, unknown, or other
MAGGGVVKHILLASFKEEVTQERLDELIRGYAALVGVVPSMKAFHWGTDVSIENMHQGVTHVFESTFESMEGIXEYIEHPAHVEFRSVVFAVLEKVLISTTNDVGHXW

SEQ ID NO: 46126 - DNA, 724 bp, Zea mays
  misc_feature: Ceres CLONE 1451148-F
  misc_feature: Encodes the peptide sequence at SEQ ID NO. 46127
  misc_feature (452)..(452): n is a, c, t, g, unknown, or other
  misc_feature (461)..(461): n is a, c, t, g, unknown, or other
  misc_feature (462)..(462): n is a, c, t, g, unknown, or other
aaagctggagctccccgcggtggcggccgctctagaactagtggatcccccgggctgcaggaattcgcacgagaccattacctagaacatcctaatcgaaaaagaagatcttgcaagacctgatgtcgtcgcagatgaatggtgttggccactcggggaatgacacgaagacaccgaacggactaacccatggtgctaatggggttaactgcttactcggcaatgctgccgcgaataactcggggataggaggaatgggatttggcgccatgagcgggttcggtcatgggatgaggacggcaatggcgaacaatccgatggcgatgggtgcaaggatgggaatgaaccacggtgcacacgacctatcgcagctgggtcagctacagcaccagcagcaacatcagcagcagcatgacataggaagccagctgctgggcggatttagatcaggnaacagcttnncatacatgcagtatgattgggacccctacaatagagcgagcgaccggaaacataggagtgcattgtgacggtgcatctgcctttgctggaacccgtgggaacatttatggggcaaaagcccccctttgggttccccattatgctgccggaaagggccctaacgaaacgggggccccggtgggacagcaaagctgaactgtgatttcccatcccttttgatttccccccgggtttaccacaaaaaaaaaaaaacttttctccc

SEQ ID NO: 46127 - protein, 135 aa, Zea mays
  misc_feature: Ceres CLONE 1451148-F
  misc_feature (113)..(113): Xaa is any aa, unknown, or other
  misc_feature (114)..(114): Xaa is any aa, unknown, or other
MSSQMNGVGHSGNDTKTPNGLTHGANGVNCLLGNAAANNSGIGGMGFGAMSGFGHGMRTAMANNPMAMGARMGMNHGAHDLSQLGQLQHQQQHQQQHDIGSQLLGGFRSGNSXXYMQYDWDPYNRASDRKHRSAL

SEQ ID NO: 46128 - DNA, 505 bp, Zea mays
  misc_feature: Ceres CLONE 1451152-F
tggagctccccgcggtggcggccgctctagaactagtggatcccccgggctgcaggaattcgcacgagaccattacctagaacatcctaatcgaaaaaatctaagggcccacctgaaaaaacccttgcgccgctgagctgagtctccttcctttctcccgtcgcctccgcctccgccttcagtttagcctccaagcaggggcgccgcgcggggtattctgtccgtcgttgagggtagagagtcacttgcacctgggggagcggagatgaacccgggttgtggggatcggggttgtcgaacaagatggccaaaatccgggggggtttgccatgggaacgtttttttccccaccagggttaaaacccgttctttcagggggccccttccggttttttgggggcccccccaacaagggcaacatcctcgggcaacttttgggccccccggggtaagggggggggttctcttttgggggccccttttggggaaaaaacaaaaggtgtgg

SEQ ID NO: 46129 - DNA, 754 bp, Zea mays
  misc_feature: Ceres CLONE 1451153-F
  misc_feature: Encodes the peptide sequence at SEQ ID NO. 46130
  misc_feature (399)..(399): n is a, c, t, g, unknown, or other
  misc_feature (416)..(416): n is a, c, t, g, unknown, or other
  misc_feature (437)..(437): n is a, c, t, g, unknown, or other
  misc_feature (478)..(478): n is a, c, t, g, unknown, or other
  misc_feature (504)..(504): n is a, c, t, g, unknown, or other
tggagctccccgcggtggcggccgctctagaactagtggatcccccgggctgcaggaattcgcacgagaccattacctagaacatcctaatcgaaaactctcacttcgcgggcacgcagagagccgcaagacgcacctcgctcgcaacttgttggactcgaaggggcaataggcagcaggcagggccccgaactgcgggaggagattcccaaggatcccgtcggcctggtagaggaagggacggggactggcgatggcggtggacggcggcggcggggtggactgggagagcctggcggaggccacctccggggcaatcggctcgctcgtcagcaccaccgtgctctacccgctcgacaccctgcagacctagttcaggccgagctccagacgcaccanggcgcgcagaagtatangaaccttttcagatgtctttnggggaagcgatttgtaaaaagcaatttttgtccctatatcnagggcctgaccccgaagacattccgnccttttgcccccccgtttttttattttttaaggggaaaggctatttaaaaaaccctccctgggaaaaaatgggaccaaaaccttttggaaccacccccaatttgttatttcccccccccgggggggggctttcccgtgtttccgggcacccccccttaaaaacccccctcttctaaaagaacaaaaagggttttttgggaaccctaaaggggggaaaaaaaacctttcaaaaaaaattttttagggaaaa

SEQ ID NO: 46130 - protein, 39 aa, Zea mays
  misc_feature: Ceres CLONE 1451153-F
MAVDGGGGVDWESLAEATSGAIGSLVSTTVLYPLDTLQT

SEQ ID NO: 46131 - DNA, 728 bp, Zea mays
  misc_feature: Ceres CLONE 1451154-F
  misc_feature: Encodes the peptide sequence at SEQ ID NO. 46132
aagctggagctccccgcggtggcggccgctctagaactagtggatcccccgggctgcaggaattcgcacgagaccattacctagaacatcctaatcgaaaaactcgagccagccagccagccagcaagccgcttgggcgccatctctctaaagcttcgtaccctcgaagagagatccggcgcggcccagtaaaaagccggcttactacggactcacagatggccggcctcaggatgaagttcgtcgccgtcgccgccatggccgccgcgctcgtggagtccgccgaatccgccgaggcccccgtcccgggtcccgtgtccgacgccgtggacgccgtacccctcgtcgcggactccctcgacgccgccgtcttcggctaccactactgctgtatccgcgctggatacgtggttcctgctccgaaatatgattgcgctggtctggcgcgcgtgagtccagctcgtgtgtcgtgcgtgtctctgtgccacgcgtccgccgtcttgtgtgtatgcatggagtccgccgcaacaacaagctcagatgatgtgtgcccttcggtgctggtacgagcttcgacgcgccactgtctgtcgcgtcgatcatgtaggaccgtgctgggttttctgctaccaatggagagatttatttgatccactcactgaacaaaaaaacttatcgatacgactgacatgacggtgggccccgtacctaaattcgcctgtagcgag

SEQ ID NO: 46132 - protein, 143 aa, Zea mays
  misc_feature: Ceres CLONE 1451154-F
MAGLRMKFVAVAAMAAALVESAESAEAPVPGPVSDAVDAVPLVADSLDAAVFGYHYCCIRAGYVVPAPKYDCAGLARVSPARVSCVSLCHASAVLCVCMESAATTSSDDVCPSVLVRASTRHCLSRRSCRTVLGFLLPMERFI

SEQ ID NO: 46133 - DNA, 584 bp, Zea mays
  misc_feature: Ceres CLONE 1451155-F
  misc_feature: Pfam Name: Ligase_CoA Pfam Description: CoA-ligase
  misc_feature: SWISSPROT Homolog: EC 6.2.1.4 Succinate--CoA ligase (GDP-forming)
cccgcggtggcggccgctctagaactagtggatcccccgggctgcaggaattcgcacgagaccattacctagaacatcctaatcgaaaatattggtcttgatggagagattggttgcatggtgaatggagcaggattggccatggcgaccatggatattataaagttgcatggtggtacgcccgccaattttcttgatgtcggtggaagtgcatcagaggggcaggttgtggaagcttttaagatactgacttcagatgatagagtgaaggcaattctagtgaacatttttggtggcatttatgaatgtgatgtgatagccaagtggaattgtttaatgctgccaaacaagtttgacttgaaaattccctggttgtttttccgttgggaaggccccattggttaccccgggaaaaggggattttttaacgaaaaggaaagctttttatccttgcaaaaaatttttggaagggcccaaaaaaactctgtaaaaaccccccccaaaaaaaaagggggggccccctccgaatttttttttttttttttccggggaaaaaaaaaaaaaaagggttttttttttttagg

SEQ ID NO: 46134 - DNA, 696 bp, Zea mays
  misc_feature: Ceres CLONE 1451165-F
  misc_feature: Encodes the peptide sequence at SEQ ID NO. 46135
  misc_feature (574)..(574): n is a, c, t, g, unknown, or other
  misc_feature (579)..(579): n is a, c, t, g, unknown, or other
  misc_feature (603)..(603): n is a, c, t, g, unknown, or other
  misc_feature (648)..(648): n is a, c, t, g, unknown, or other
  misc_feature (652)..(652): n is a, c, t, g, unknown, or other
ctggagctccccgcggtggcggccgctctagaactagtggatcccccgggctgcaggaattcgcacgagaccattacctagaacatcctaatcgaaaaatcaacacaatttacccttcgtcttcccgcttccagcgcacccccatcttgagtctcgccgccgcaagcttgtgtaaggtgtaaccctaaccctaaaacacttaccttcgcctccagcaccacgcttccatggaggggcgcggaggctaagtatagccaacctctacaccatatccccatggattgagcggattcccaaggcatgggtacaaaccctcacctgcaagagctggccgcttcggcggtggcggcttctgaaccaccaccgcgggcgcgcgtggtgcggatcctagtgcacgatgctgacgccaccgattcgtcctccagcgaggatgaggcaccgccacttcttcctcggcggaggtcgaggggtggtagcagcagcctgagcgtgaggcgccgtgttatggaactggctggggcaagctcggccgttcggttccgtggcgtccgtcgtaagccgtgggggcgctggnctgcnaagaatcgcgatccgcacaactgncgcagactgtggctcggcaccttcgacacgctgaggaaagctgcnacgnctacgacgctgcgaacatccgctttccgcgtgtcagcgccacta

SEQ ID NO: 46135 - protein, 132 aa, Zea mays
  misc_feature: Ceres CLONE 1451165-F
  misc_feature (92)..(92): Xaa is any aa, unknown, or other
  misc_feature (101)..(101): Xaa is any aa, unknown, or other
  misc_feature (118)..(118): Xaa is any aa, unknown, or other
MGTNPHLQELAASAVAASEPPPRARVVRILVHDADATDSSSSEDEAPPLLPRRRSRGGSSSLSVRRRVMELAGASSAVRFRGVRRKPWGRWXAKNRDPHNXRRLWLGTFDTLRKAATXTTLRTSAFRVSAPL

SEQ ID NO: 46136 - DNA, 629 bp, Zea mays
  misc_feature: Ceres CLONE 1451167-F
  misc_feature: Translation starting site: 235
  misc_feature: SWISSPROT Homolog: EC 5.3.1.5 Xylose isomerase
ctccccgcggtggcggccgctctagaactagtggatcccccgggctgcaggaattcgcacgagaccattacctagaacatcctaatcgaaaaattagaaaagaaaactctgttcaaccacccgccgagttcagcagcactctcctccgccctcttccaggtccagcagagattggggacgcgtaggcatcggagattgcctcgggagcgcgtttcctggtcaactaaggccggcatgaagggctgctcagcgcttgctgtttctgctgctgctgctggcatcgtcgtcgttactgtccgctgtgattgccgcgcagcagacttgccccgccgacctcgacagctaatgcgatggtggcgcgtctgatgatgattgggagggagagttcttcctcggcgtcccgaaaaatcagtatgagggtcctaacaggcagaatcctcttgcttataagtggtataacaagaggaaagtgatctccggtaaaaaaatgaaggattggaagccccttcagggtttgcgtttcgggcccccctttcccgggggacttggcgcctgaatcttttccggggggctccaaaaaagaaatttgggccttggggagggaaggggcccaaatttctttttgggcc

SEQ ID NO: 46137 - DNA, 768 bp, Zea mays
  misc_feature: Ceres CLONE 1451168-F
  misc_feature: Encodes the peptide sequence at SEQ ID NO. 46138
  misc_feature (305)..(305): n is a, c, t, g, unknown, or other
  misc_feature (325)..(325): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (629)..(629): n is a, c, t, g, unknown, or other
  misc_feature (700)..(700): n is a, c, t, g, unknown, or other
  misc_feature (701)..(701): n is a, c, t, g, unknown, or other
  misc_feature (708)..(708): n is a, c, t, g, unknown, or other
  misc_feature (709)..(709): n is a, c, t, g, unknown, or other
tggagctccccgcggtggcggccgctctagaactagtggatcccccgggctgcaggaattcgcacgagaccattacctagaacatcctaatcgaaaaatcgcacgcactcctcatcttatcccccgcctcctccggtcctcccgccgctgttgctcacttctgagtcccgacgcacgagctcccaagagctagccatggcgtccaccaccctctcctccgccttcaccctcctctcccgcccctccacctccccgtgccccgccgcctcgctcccgaggtcctcccacgccgcgccccacatccngcgggggctgcgcgccgtcnccgtcgcgtgcaccgccaccgagtccccaagatcctggacctcggggacgccgtggccgggttcaagttcaaggaagcccccaccctcttcgaccaccttcaagaagcggtttgggggtccccgccgggggcttttctgccggcgcccgttttctcggtccccgggggggggtggggggccccctttccaaaaagaagcccccctcctaaaaaaccgagttcttctctgatatataaaaaagtgtgttcaatcttggcgggnnnngccccaaccaagggggtggggtgtctgccactaaacccngccctggggggggggcggggcctttatggggcgtcttttcttcccggggagtgctggagtgcgttgttggnntggattnncgcgtctataaatataaaagacaactgcttgcggcaggagagcctaccaccatatattt

SEQ ID NO: 46138 - protein, 119 aa, Zea mays
  misc_feature: Ceres CLONE 1451168-F
  misc_feature (37)..(37): Xaa is any aa, unknown, or other
  misc_feature (44)..(44): Xaa is any aa, unknown, or other
MASTTLSSAFTLLSRPSTSPCPAASLPRSSHAAPHIXRGLRAVXVACTATESPRSWTSGTPWPGSSSRKPPPSSTTFKKRFGGPRRGLFCRRPFSRSPGGGGGPPFQKEAPLLKNRVLL

SEQ ID NO: 46139 - DNA, 712 bp, Zea mays
  misc_feature: Ceres CLONE 1451172-F
  misc_feature (182)..(182): n is a, c, t, g, unknown, or other
  misc_feature (246)..(246): n is a, c, t, g, unknown, or other
  misc_feature (247)..(247): n is a, c, t, g, unknown, or other
  misc_feature (277)..(277): n is a, c, t, g, unknown, or other
  misc_feature (286)..(286): n is a, c, t, g, unknown, or other
  misc_feature (291)..(291): n is a, c, t, g, unknown, or other
  misc_feature (311)..(311): n is a, c, t, g, unknown, or other
  misc_feature (314)..(314): n is a, c, t, g, unknown, or other
  misc_feature (344)..(344): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (613)..(613): n is a, c, t, g, unknown, or other
  misc_feature (614)..(614): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (634)..(634): n is a, c, t, g, unknown, or other
  misc_feature (635)..(635): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (702)..(702): n is a, c, t, g, unknown, or other
  misc_feature (703)..(703): n is a, c, t, g, unknown, or other
aagctggagctccccgcggtggcggccgctctagaactagtggatcccccgggctgcaggaattcgcacgagaccattacctagaacatcctaatcgaaaatccatcacagctagctagcatacagacgaataatctcttcttcacctcactaacaccagctagcaactctttctctcctgncataatgggcgctcgctcctcctccctccagcgcagctggtcgcggcggcggcggtcctggcanncgccctgctgctgctgggcgcggggccggnaacgcttcngcgcngtgaactgcggcaagtgacntcntcggggcccctgccctcggaacccaagggnagcgggggttcccctcccgggtgggttaaagggggggccttctaaaacgccccggtccataaaggggaaagggggggccccctgaatttcccaaaaaaaaaaaaggccccttttgggggggtttttaatgtaaaaacaccccccaaaaaacccctccccaagagggggggtttccccggggggggccccctcccccccccccgcgggggggggggnnnttaaaaattttttttaaaaacaaaaaaaggggcccttttggtgggggaaannccccccaccaaacnnnnncnnaaaaaaaaaaaaaaaaaaannnnnnnnnnnnnnnnnnnnnnnnnnnnnnnnnnnnnnnnnnnnnnannacaccaccg

SEQ ID NO: 46140 - DNA, 747 bp, Zea mays
  misc_feature: Ceres CLONE 1451185-F
  misc_feature: Encodes the peptide sequence at SEQ ID NO. 46141
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaaacgccagttaccactcaccagtcaccagtctccactctggagtctggaactcccctcatcctccacatctccaccgcatcggaactaggaaggcgaagccgaaggcgcggcgcggcgcggcacggatcgagcgatggcggtggcccctcctacggcggcggcgctggagcagctaagcagcagcaagatgttcgacggcttcaatctccgcttccgccaccagagcgccacccttggctgcgccatgactttctccatctacctgcccccgtccccggcgtccaccttncccgtgctgtactggctctcgggtctcacctgcaccgacgagaaattcatcataaagtccggcgcccagcgcgccgccgctgcccacggcatcgccctcgtgggcacctgaacctcccacgtggggtaatattggaggaaagccaaacggcttgatttttggggtggtggccgggtttttttgaaagcccaaatgaaaggggaaaaactggccctgggtgactacctgggaagggactcccaaagtttaggggaaactttaaaaaccccccccgccccgggtcaatttttgggccccaggggggggggggggccgcgacatttttttggaaaaccggaaaaaaaccggggtgccc

SEQ ID NO: 46141 - protein, 88 aa, Zea mays
  misc_feature: Ceres CLONE 1451185-F
  misc_feature: SWISSPROT Homolog: EC 3.1.2.12 S-formylglutathione hydrolase
  misc_feature (52)..(52): Xaa is any aa, unknown, or other
MAVAPPTAAALEQLSSSKMFDGFNLRFRHQSATLGCAMTFSIYLPPSPASTXPVLYWLSGLTCTDEKFIIKSGAQRAAAAHGIALVGT

SEQ ID NO: 46142 - DNA, 770 bp, Zea mays
  misc_feature: Ceres CLONE 1451198-F
  misc_feature: Encodes the peptide sequence at SEQ ID NO. 46143
  misc_feature (699)..(699): n is a, c, t, g, unknown, or other
  misc_feature (770)..(770): n is a, c, t, g, unknown, or other
aagctggagctccccgcggtggcggccgctctagaactagtggatcccccgggctgcatgaattcgcacgagaccattacctagaacatcctaatcgaaaattttttgcagttgcagacttgcaggtaagcaagcagaacagagtggcatggcacatctctcaagtcccaactgactgcctgccatggtagtgtagtgtctgagttctgaacagagcaggcgcaggagaagtgaaacatttgttcacttgtgcagcccaggtgcatgttgtccagagataagcaggtgatggctgcgccgatggccgcggcggacggcgggcttaggcggctgttcgagaagccgctgccggagaacccgacgctgctggaggcgctctcggcgtggaaccgcaacgtgcaccaccccagcagcaagcccatcgacacggcgtccttcacggagatcttcggcgagctccacttccaggagaagcagcagcccgaccgaggcgccctcctgccgccgtcgccgtcgcccccgccgacgccgtcgcccccgccgacgccgctccctccttcccgcacgctgtcgtggctcgacatcgcggccgaggccgagaagagcaaggacgactcgtcgctggacgcgctgctgaggcccaagccagcgaccaccgtggccacggtgaagaggagcgcgagcttctgcaccaagaanggctcctccgcgtcgctgctgctctgcaccgaggggctcggctccgagagcaccgtggacgctgacgacan

SEQ ID NO: 46143 - protein, 168 aa, Zea mays
  misc_feature: Ceres CLONE 1451198-F
  misc_feature (145)..(145): Xaa is any aa, unknown, or other
MLSRDKQVMAAPMAAADGGLRRLFEKPLPENPTLLEALSAWNRNVHHPSSKPIDTASFTEIFGELHFQEKQQPDRGALLPPSPSPPPTPSPPPTPLPPSRTLSWLDIAAEAEKSKDDSSLDALLRPKPATTVATVKRSASFCTKXGSSASLLLCTEGLGSESTVDADD

SEQ ID NO: 46144 - DNA, 773 bp, Zea mays
  misc_feature: Ceres CLONE 1451211-F
  misc_feature: Encodes the peptide sequence at SEQ ID NO. 46145
  misc_feature (401)..(401): n is a, c, t, g, unknown, or other
ctccccgcggtggcggccgctctagaactagtggatcccccgggctgcaggaattcgcacgagaccattacctagaacatcctaatcgaaaaataatcacaaataactctatactcgctgtaggcaggcacctccgctcctgtcctcttctctcgtcgcttcctccgtctctcggcgtcgaatctcctccagccaccgcgcacactctactcgacgcccggtggaaggagttctccgggatttgagctgtttctgccctcacctccgctgggccggcgtcgagtggggatccaatcgaaaatcgaactgacttcatctttctgtgcatccccatcagggatagccatgtcaggagtgatcacaaagttcgcggttacatccatggtgatgtggatggcccngttgccatcgtttatggggtctaactacaagggtttcccaggtgggagtcggaatgcatcctcgaacaaaaactctcccgggggttccctggctggcaaaccaattaaacggggggaacggctttgacaatattttggggaaaaagggaaattttgaacccgggaaccccagccaaccccatcttttggggaaaaaccccaagggggttttaaaaacccaaaatttcttcttaaagagagaggggttcccgggggaggggaaggggggtaaaacccccccccccgcggggggggtttttgccccggggaaaaaaaacagcggcttttaaaaaaaaaaaatatttccccccccaacaccaccccttctttttt

SEQ ID NO: 46145 - protein, 60 aa, Zea mays
  misc_feature: Ceres CLONE 1451211-F
  misc_feature (19)..(19): Xaa is any aa, unknown, or other
MSGVITKFAVTSMVMWMAXLPSFMGSNYKGFPGGSRNASSNKNSPGGSLAGKPIKRGERL

SEQ ID NO: 46146 - DNA, 726 bp, Zea mays
  misc_feature: Ceres CLONE 1451218-F
  misc_feature: Encodes the peptide sequence at SEQ ID NO. 46147
  misc_feature (405)..(405): n is a, c, t, g, unknown, or other
ctggagctccccgcggtggcggccgctctataactagtggatcccccgggctgcaggaattcgcacgagaccattacctagaacatcctaatcgaaaaacacaagagaaaagcagagggggccagatgaggagggacctcgcatcctccttcgctaccgccgcatcctcttcctcggcagccgacgcgctccggggctggtgggatgacgtcaacgagtcgccccagtgccaggacgcggccttcttctccctcgccgccgcctacgccctcgtctccgccgtcgcactgattcagctcgtcaggatccagcgccgggtgcccgagttcggatggaccacgcagaaggtcttccacctcatgaacttcctttgtcacgggggtccgtgctctggtattcggcttncatgtccacgtcttcctcctcggcggcaaagatacaagttgggggtgctagatctccctgggtctggtggtttttccccactaaacctggctcgggctccttcgggccgaaatttaccctcagggtagggattctcccaagaaaaagtgaggcctgggaacattggcggttaacccctcaaaaccgttgtcccggttgggaataggaaaaccctgggaaaaaagaaaggggggggggcaaccccccccaaaaatttctgggaaggggcccccttcgggggccttgggggttttaaaaaggggggggggggttttttttttg

SEQ ID NO: 46147 - protein, 135 aa, Zea mays
  misc_feature: Ceres CLONE 1451218-F
  misc_feature (9)..(135): Pfam Name: DUF1084 Pfam Description: Protein of unknown function (DUF1084)
  misc_feature (94)..(94): Xaa is any aa, unknown, or other
MRRDLASSFATAASSSSAADALRGWWDDVNESPQCQDAAFFSLAAAYALVSAVALIQLVRIQRRVPEFGWTTQKVFHLMNFLCHGGPCSGIRLXCPRLPPRRQRYKLGVLDLPGSGGFSPLNLARAPSGRNLPSG

SEQ ID NO: 46148 - DNA, 699 bp, Zea mays
  misc_feature: Ceres CLONE 1451219-F
  misc_feature: Encodes the peptide sequence at SEQ ID NO. 46149
  misc_feature (523)..(523): n is a, c, t, g, unknown, or other
  misc_feature (649)..(649): n is a, c, t, g, unknown, or other
  misc_feature (657)..(657): n is a, c, t, g, unknown, or other
  misc_feature (699)..(699): n is a, c, t, g, unknown, or other
tggagctccccgcggtggcggccgctctagaactagtggatcccccgggctgcaggaattcgcacgagaccattacctagaacatcctaatcgaaaaacgaatcgcctcttccaccttctctctcccccccttcctggcttggtccgccgcactgttgacgggccgcttgtatctgcgtaccacccgcaggtttcgcgagcgctggcttgtcggttaagggaaacggagcggcgttcccgttggtcgccgccgcggggccggccgcggcggcaccggtggccgacctggacggccgcccggccacggagaagcagcccatcatcgtcatcgacaactacgacagcttcacatacaacctctgccagtatatgggggagcttggattgaacttcgaagtataccgcaatgatgaactgaccatagaagatgtgagaaggaagaacccaaggggaatacttatttctccaggacctggtgaaccacaagattcgggaatatcattgcagactgttcttgaattangcccaaccatcccaatttttggagtttgcatgggtctgcaatgcattggagaggcatttggaggaaagattatcgtgctccttctggagtgatgcatgggaaaagctctccagtttattacgatgnagaattangaaaggcatttgttcatggcttggcaaacccttttactggcn

SEQ ID NO: 46149 - protein, 81 aa, Zea mays
  misc_feature: Ceres CLONE 1451219-F
  misc_feature: SWISSPROT Homolog: EC 4.1.3.27 Anthranilate synthase
  misc_feature (52)..(52): Xaa is any aa, unknown, or other
MGELGLNFEVYRNDELTIEDVRRKNPRGILISPGPGEPQDSGISLQTVLELXPTIPIFGVCMGLQCIGEAFGGKIIVLLLE

SEQ ID NO: 46150 - DNA, 748 bp, Zea mays
  misc_feature: Ceres CLONE 1451221-F
  misc_feature (245)..(245): n is a, c, t, g, unknown, or other
  misc_feature (247)..(247): n is a, c, t, g, unknown, or other
  misc_feature (251)..(251): n is a, c, t, g, unknown, or other
  misc_feature (260)..(260): n is a, c, t, g, unknown, or other
  misc_feature (266)..(266): n is a, c, t, g, unknown, or other
  misc_feature (268)..(268): n is a, c, t, g, unknown, or other
  misc_feature (350)..(350): n is a, c, t, g, unknown, or other
  misc_feature (353)..(353): n is a, c, t, g, unknown, or other
  misc_feature (364)..(364): n is a, c, t, g, unknown, or other
  misc_feature (365)..(365): n is a, c, t, g, unknown, or other
  misc_feature (416)..(416): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaaaaaataaaccaaaccccacgcgaagatggccctccctgccctggctggctctcctctcgtcttcgccgcccctccatacttcccgctccgtccctctcccccgctttgaccacctcctccgccatatctctcctccccctccttncngccnacacacgcngcatcncnattgagagagagagagagaaaaccaagaggggtcgacagcactgacacgcccatgttcatgtgggggtttcccgttccctcnttncggcgcttcgnnggtgggccgggcccggccccaaccgggggtcccgcccccttggcccttgancgtttgggattaccttttttcccaaaacgcaaaaaaggaccggaaaaaaaaaagtaacccccccaaaaggaaggccccttaacctcttccccccaaaaaaagggctctaagcccccccttggaaaggggggggtgttccccctacaaaactttttgggggggggaaaaaatacacggggggcccaaaaaaacccaaaaaaggggggttttttttgcccccccttaaaaaagaggggggggnnnnnnttttcttccggggccccccccaaaattttaagaaacccccccccaaaaagggagaaaaaccccccggggagaaaaccaccccgccg

SEQ ID NO: 46151 - DNA, 701 bp, Zea mays
  misc_feature: Ceres CLONE 1451225-F
  misc_feature: Encodes the peptide sequence at SEQ ID NO. 46152
  misc_feature (647)..(647): n is a, c, t, g, unknown, or other
  misc_feature (665)..(665): n is a, c, t, g, unknown, or other
  misc_feature (693)..(693): n is a, c, t, g, unknown, or other
ggagctcaccgcggtggcggccgctctagaactagtggatcccccgggctgcaggaattcgcacgagaccattacctagaacatcctaatcgaaaaatatgacagttctaggagagacaacctagcccattgcgttgttcatagagaagtgataatgggaggacattcgctcccccagtaagtttttttttctgctccgtttgtcctccaactatttggccgcaaaagcttttttttttctgctccatttgtcctccaactatttcgccgcaaaggcctctagaagcaatcaggcgagcggcggctgcggcgcgatgggagagcaggtcgtgacggagcgtatccagcggaagctggaggaggccaacgctaccgtccaacagcacctcgccggcatccaggaccacgtcaacttcaccatgcagcaagcatacttcaagtgcgcatatgattgcttcgatcggcgccgtactcaggaagcgatcaacaattgtgtggagaattgtggtatgcctgtccttgctgtcaacaatgtttttgagagtgagatggccaagtttcaggaacggttgaaccggtcattgatggtctgtcaagataagtttgaagctgccaagctccagaagatgaaaacagatgcaactcangaactggaatcctgtgtncacagatctatcgatgacagcatcaggnccctccca

SEQ ID NO: 46152 - protein, 129 aa, Zea mays
  misc_feature: Ceres CLONE 1451225-F
  misc_feature (10)..(129): Pfam Name: DUF842 Pfam Description: Eukaryotic protein of unknown function (DUF842)
  misc_feature (111)..(111): Xaa is any aa, unknown, or other
  misc_feature (127)..(127): Xaa is any aa, unknown, or other
MGEQVVTERIQRKLEEANATVQQHLAGIQDHVNFTMQQAYFKCAYDCFDRRRTQEAINNCVENCGMPVLAVNNVFESEMAKFQERLNRSLMVCQDKFEAAKLQKMKTDATXELESCVHRSIDDSIRXLP

SEQ ID NO: 46153 - DNA, 729 bp, Zea mays
  misc_feature: Ceres CLONE 1451227-F
  misc_feature: Translation starting site: 119
  misc_feature (393)..(393): n is a, c, t, g, unknown, or other
  misc_feature (402)..(402): n is a, c, t, g, unknown, or other
  misc_feature (432)..(432): n is a, c, t, g, unknown, or other
  misc_feature (458)..(458): n is a, c, t, g, unknown, or other
  misc_feature (501)..(501): n is a, c, t, g, unknown, or other
  misc_feature (502)..(502): n is a, c, t, g, unknown, or other
  misc_feature (508)..(508): n is a, c, t, g, unknown, or other
  misc_feature (518)..(518): n is a, c, t, g, unknown, or other
  misc_feature (525)..(525): n is a, c, t, g, unknown, or other
  misc_feature (526)..(526): n is a, c, t, g, unknown, or other
acccgcggtggcggccgctctagaactagtggatcccccgggctgcaggaattcgcacgagaccattacctagaacatcctaatcgaaaagtagccgtgaccccccacgaaaaccctaatggcgtcccgcctccttcacctccgccgcctcattactcctccctccaccgtccccgccgcttccttctccaccgccgtcagcgcgaccccgcgcgtctccgcgctcgtcgacgagatctgcgggctcaccctcctcgaggcctcttccctggccgatgccctgcgcggccgcctcggcgtcgaccagttgccgccactagctatcctcacgggcggcggcgcaccgctcgtcggcggcggagtaggtcccggcgcggccggcaagaagcaaangttcaagangagaagatggcgttcgacgtgaagctgganggggtcgacgctgctgcgaagctcangatcatcaaggagctgaaggcgttcacgaatctgggtctgaanngaggcnaagattctcntggaaanngcccctgtccgtgctaaaggctggaattcccaaagaaggaggcggaaaaatatcccccaaaaaaatgcggccggctcgggcccaaaaattgttctccaaggaaacaaccaaaacctggaaagcccctcgtttcttggatttggttccggggtttcttgaagaaaaaaaaaaagaaattttggaaccgggaataaatatttttt

SEQ ID NO: 46154 - DNA, 788 bp, Zea mays
  misc_feature: Ceres CLONE 1451341-F
  misc_feature: Encodes the peptide sequence at SEQ ID NO. 46155
aaagctggagctcaccgcggtggcggccgctctagaactagtggatcccccgggctgcaggaattcgtctcacccctaatcgaaaaatagcactgccgcatgagaagatagcagtatagcaccgcccgctgcaatgaaccgcgcttcttggttgctccttgttctggtgcagctctcttgcttgcactgctactcagccacccaccatggcggcggccggaagcacggacgcccactactacccgcgcccgccaacgtcgtcgtcggctccgttgtcgtcgtccactccggcagctccgaggctaccaccaccgccgtttcttcaggcaccctggtcggggtccgctgccacgacgggaacggccggacggtgttcccgaagggacgcgtcgtgacggaccgcagcggcaggttccgcgtgcacctcgcgcacgggccaagcagcggcagcagcagcagccaccagctccggtccgtcacgtcctgctcggtgggcggtgacctccccgcagcttccctgcctgtggtcccccaccgccagtcccgttcggggggtccaccctcgtcgcccacccaaaaaaaaaaaaaacacggggggggggcttccgggtttttcccgcgggggccttttccttcccccccggaattttgaaaaaaaaggggcgtttttttccccccggtcccccttttggtcgaaaacacccaaagggggggggggcccactcccccaaaaccggtgagtccccccccccgctccccttgggggcccctccttaaaccccgttttc

SEQ ID NO: 46155 - protein, 172 aa, Zea mays
  misc_feature: Ceres CLONE 1451341-F
MNRASWLLLVLVQLSCLHCYSATHHGGGRKHGRPLLPAPANVVVGSVVVVHSGSSEATTTAVSSGTLVGVRCHDGNGRTVFPKGRVVTDRSGRFRVHLAHGPSSGSSSSHQLRSVTSCSVGGDLPAASLPVVPHRQSRSGGPPSSPTQKKKKHGGGASGFFPRGPFPSPPEF

SEQ ID NO: 46156 - DNA, 791 bp, Zea mays
  misc_feature: Ceres CLONE 1451342-F
  misc_feature: Encodes the peptide sequence at SEQ ID NO. 46157
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (430)..(430): n is a, c, t, g, unknown, or other
  misc_feature (453)..(453): n is a, c, t, g, unknown, or other
  misc_feature (516)..(516): n is a, c, t, g, unknown, or other
aaagctggagctccccgcggtggcggccgctctagaactagtggatcccccgggctgcaggaattcgtctcacccctaatcgaaaaaaatccaatgaaaaagtaacaacagcagcccccggggccacagggcgaggcccgcagccatggaccaggaccacaagaggctagcactcccgtcgccggcgccgcagtccccgccggcatccgccgcgtcggcgtcgaccacggcctcgccgtactccgcgctacacccgctcctcttgccctccccgaacccgcaccttttcctcaagtccaagacgctcactctctccctctcgtcctcctccctcacnnntcatgtctcctcctcgctgccccgccccgtcaccgatgtctgggaggtcgtcacccccactgccccatctgttgaccacgtggacggcggncttgatgactgccgcatctcccngcccggctgcatgaagggctgggcctggaacgcaaccccaagaagtccccccaatgccccccngtggcaaggggggaaaccaggaggttgggtataaccagggggaagacaaaaaaattgctttggggaaaggaaaaaaggcaattttgggcaaaagccccctttgggggcccggttccgaaaattttaaaaaaagggtgccctctaatggcctggtgtggccccccgggagaaccccccccgggtgttttttttggggggcctcctttgggggaaccaactttctccccccccccggggaaaaagagaaagaaaaccccctctgtttccttccaaaa

SEQ ID NO: 46157 - protein, 134 aa, Zea mays
  misc_feature: Ceres CLONE 1451342-F
  misc_feature (65)..(65): Xaa is any aa, unknown, or other
  misc_feature (103)..(103): Xaa is any aa, unknown, or other
  misc_feature (124)..(124): Xaa is any aa, unknown, or other
MDQDHKRLALPSPAPQSPPASAASASTTASPYSALHPLLLPSPNPHLFLKSKTLTLSLSSSSLTXHVSSSLPRPVTDVWEVVTPTAPSVDHVDGGLDDCRISXPGCMKGWAWNATPRSPPNAPXWQGGKPGGWV

SEQ ID NO: 46158 - DNA, 794 bp, Zea mays
  misc_feature: Ceres CLONE 1451347-F
  misc_feature (418)..(418): n is a, c, t, g, unknown, or other
  misc_feature (427)..(427): n is a, c, t, g, unknown, or other
aaagctggagctccccgcggtggcggccgctctataactagtggatcccccgggctgcaggaattcgtctcacccctaatcgaaaaaaaacaccacttcttaccgattagtagaaaaaaaaactcctcggccccagcattttcgtgcaaggggcgagccgccagctactgctggccttttccctcacacaagtcacacgcacacccgctagcccccgtcccccgtcccgcccgtaccttcctccgccgcctccgtcctcgttccaaccgtgggcagcaggcaggcccaagtatctgcagtagattggtggagaggaagaagacggcaggcacccacgcagatcaaacgtgctccgccacccttggtttcggcgaaatcgcgccgtacgcccgtaatcgagccgtctccaaccccaccnacgcgttgnataacaattcgacccgttctcgggcaaatcgacgtccaaagctgcaaattgacccatctcccgcctaacctccgcttgtgcctgccaggaacgccaaatttaccccctccccggaaaaaaaccctgggaccgctcccaatttatggatcctctttgaaaaaaccaatttttccgaaaagaatttttgggcaaaaatttttaaaaaaaaaaaatgtaatctttcaaaaaaaaaactagggggggacctttttttctctaaaaaaaacccttgttcggggggggcaacacggggttctcctcccccccccctcagggagaaagaaaaaaatccctccaaaaaatatctctcccccccgctggggggaaa

SEQ ID NO: 46159 - DNA, 775 bp, Zea mays
  misc_feature: Ceres CLONE 1451353-F
  misc_feature: Encodes the peptide sequence at SEQ ID NO. 46160
  misc_feature (333)..(333): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (350)..(350): n is a, c, t, g, unknown, or other
  misc_feature (351)..(351): n is a, c, t, g, unknown, or other
  misc_feature (382)..(382): n is a, c, t, g, unknown, or other
  misc_feature (383)..(383): n is a, c, t, g, unknown, or other
  misc_feature (414)..(414): n is a, c, t, g, unknown, or other
  misc_feature (427)..(427): n is a, c, t, g, unknown, or other
  misc_feature (441)..(441): n is a, c, t, g, unknown, or other
aagctggagctccccgcggtggcggccgctctagaactagtggatcccccgggctgcaggaattcgtctcacccctaatcgaaaaagagtcctaccaagtggcaccaaagctcgttctcccgaccccgactgtccccaatgcgcagtccgcgaggcctcctcaccgcctccggctaccttgcgggccggcacgctccgtcggcctccgtgtccaccactggccacaactccctactcgctcgcaccttccaaatcctagcccagccggagtccgtccgtctgcagaagcacccggcacccaactccgggatcttagagctgaggctggagcgngnnnnnnncccgggggnnaaaaggtcccaagaaaaccggggccccccanntttaaaattgggatatgatgaagatgctgcngaagcgccatagnagaagaattcaggnccgacacgacggcgaaaggtcgtcccttgttgccagctccggtgccggggggctttctctgcaggcgccgatcccaagggaaaggaggctaatgagttccttctaaccttggggggtatgccaaaacccctggaggccacctttttccccttttgagggcctttccatttcccaaaattggggtctttaaaaggaccgccccctggggggggggaaaaaacggggtttggcacggccacctcccaaattggggaaaaaatgggaaaattggggcgccaaaaaaaccccctgttttatacccgcggggggggaggccccaccccccccttatgaa

SEQ ID NO: 46160 - protein, 95 aa, Zea mays
  misc_feature: Ceres CLONE 1451353-F
  misc_feature (66)..(66): Xaa is any aa, unknown, or other
  misc_feature (67)..(67): Xaa is any aa, unknown, or other
  misc_feature (68)..(68): Xaa is any aa, unknown, or other
  misc_feature (71)..(71): Xaa is any aa, unknown, or other
  misc_feature (82)..(82): Xaa is any aa, unknown, or other
MRSPRGLLTASGYLAGRHAPSASVSTTGHNSLLARTFQILAQPESVRLQKHPAPNSGILELRLERXXXPGXKRSQENRGPPXLKLGYDEDAAEAP

SEQ ID NO: 46161 - DNA, 731 bp, Zea mays
  misc_feature: Ceres CLONE 1451361-F
  misc_feature: Encodes the peptide sequence at SEQ ID NO. 46162
ggagctccccgcggtggcggccgctctagaactagtggatcccccgggctgcaggaattcgtctcacccctaatcgaaaaatacgccccaatcgccgccgccagagccgcggagctctccactcctctcttacccttcctctccccacccacgaagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatgggtgagtactctctggaatttgctgtagggagagaatcattcgtgctttcttggccgagaccaaaaattgtcaagaggtcctgaaatacaaaaacccaggacaagacgctggaaggaaatctccgggatggggaacctaacccggtttggaacccgcaaaattaatttgggggaaggaaaaccagggggcttggtggcctttaaccggggatttagaatttgggccccgaaccccttcccctttaaatggggaaaaggggaaatgtgccccaaggggtttttttaaaaacagacccccttgtgaaaaatcc

SEQ ID NO: 46162 - protein, 79 aa, Zea mays
  misc_feature: Ceres CLONE 1451361-F
  misc_feature (5)..(79): Pfam Name: Ribosomal_L34e Pfam Description: Ribosomal protein L34e
MVQRLTYRKRHSYATKSNQTRVVKTPGGKLVYQYTKKRASGPKCPVTGKKIQGIPHLRPAEYKRSRLPRSRRTVNRPYG

SEQ ID NO: 46163 - DNA, 751 bp, Zea mays
  misc_feature: Ceres CLONE 1451371-F
ggagctccccgcggtggcggccgctctagaactagtggatcccccgggctgcaggaattcgtctcacccctaatcgaaaaacgccattccccctcctgctgttttccccaaggtacagcaaccacaagatgggacctcgctcctgctcgcccatggcaccctggtggccgagctgccccttccttgtccatggctggatgctcccctgctggagctccttgccggcgcccccaaatccctggtttcccttgcgcaggagcagagactctcatggacgccccctcccaagctcctgagcgtgcagggcagcaacaccttcatcccctcggatccaagtcgctgggaggtttttctcggtgctggaacccgatgcagccacccatggtgccctctcacccagccatggccgccaccctaaccctctgtacacgcgcgaccttcatcttcaagcacagcaagcagccgcggccacatgcagcgcggcaatctgcctgtgcgtgcacaaggcagaggaagaagatgactccctgagcctatgacaagtggacccagggcggatgaccgagagaggatgatcgtgcaagtgatgtggtgccaaccacaaggtgcagtcggtggacgacccaaggaaggatggacttaaccagtggatgctcgccaagcgagtacctcccccagcaaacactacctaagtgttaaattaaaggtacctccttgatttggttgatggtgtgacttggcctccatccct

SEQ ID NO: 46164 - DNA, 687 bp, Zea mays
  misc_feature: Ceres CLONE 1451372-F
  misc_feature: Encodes the peptide sequence at SEQ ID NO. 46165
  misc_feature (527)..(527): n is a, c, t, g, unknown, or other
  misc_feature (532)..(532): n is a, c, t, g, unknown, or other
  misc_feature (600)..(600): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagatcgtcccaggcatacgacaacgcgccggaagaccggagagaaataggggacaagtacaaggacgcggcggaggaggcgaaggacgccaccggggacgccaaggagcacgccaagaggatggccggggagacgaagagcaggncgcangacaaggccggccgcgtggcggaacaagcgtcgggcatggccgagcgggccaaggaccaggcaaaggncgttggcgaagactcctncgaaacggcgtcccgggcgacggagcgagccgagaacgaaacccgtgaaccggcgcaagaagcccccga

SEQ ID NO: 46165 - protein, 159 aa, Zea mays
  misc_feature: Ceres CLONE 1451372-F
  misc_feature (107)..(107): Xaa is any aa, unknown, or other
  misc_feature (108)..(108): Xaa is any aa, unknown, or other
  misc_feature (131)..(131): Xaa is any aa, unknown, or other
  misc_feature (137)..(137): Xaa is any aa, unknown, or other
MSRLMAAMLLGGARVAGAAKLTGNGNAAGMQALPMPACFLPPRPQAATWTRLCLQAAPRSSQAYDNAPEDRREIGDKYKDAAEEAKDATGDAKEHAKRMAGETKSRXXDKAGRVAEQASGMAERAKDQAKXVGEDSXETASRATERAENETREPAQEAP

SEQ ID NO: 46166 - DNA, 751 bp, Zea mays
  misc_feature: Ceres CLONE 1451379-F
gctctagaactagtggatcccccgggctgcaggaattcgcacgagaccattacctagaacatcctaatcgaaaaatctactcccatttctctgcacgcagctcagtctcgtccatccagtgctgtacaattttctttggtctgttggcaaggcagccatgaaaccccctcagctgccggcaggggagggggcctcctgggctcacgaggtcaagcatgccctcctcgagaaattccggcgctcctacggcgccggatctgcccccgcccacccggagccatggccggccgcaaacccaaaaatggcccttacttcccgccgttttttgtttttataactttataaaccagagggatgacccccagttcctggggggaaaaaaaccaccaaccgggtgggttgccgcctgcatatattcccccccccacgctaccctagtcccccccttcgcttcccgtcaacttatattgctcatcgccacccccacaaaaaatatttgcccgtgccccgattatagatatatcgccccccataggcctatatatatcattccccgccaaaatggaccacacattccggtaaataatccccccatccgccgggtttgttttcccgcgccccctacaatatatccgttatacccacgcaaggccccctaataaatatgtagatataaccctccccccccctcgccccattcctaccctactatgtaaaaacaacataatccttcttccatccccgagttggt

SEQ ID NO: 46167 - DNA, 773 bp, Zea mays
  misc_feature: Ceres CLONE 1451381-F
  misc_feature (409)..(409): n is a, c, t, g, unknown, or other
  misc_feature (551)..(551): n is a, c, t, g, unknown, or other
ggagctccccgcggtggcggccgctctagaactagtggatcccccgggctgcaggaattcgtctcacccctaatcgaaaattcctgccggctgccgactgccgtcccggcatcctgttgttgcccatctcatcgcccgcggccggccgcccagtgccgcacaaccaccatatctccctcacagtcacagcctcactccatgacgctcgttgcctgccagccagcctaatctataagctcatcgccgtcgaggcagtgcccagctgctctcttctatttctacaagcggtcaggtagtattattagtatgttgtatggctaatggctaatggctaatggccgatggcctgcgagacaacacaactgcgccgagctgccgcagaacacaccaactgcacactgctgcatangaggtcaggagaaagcgctccagcgcagcacggcagcaaggatttctggacggatctgattgaataaaccgtgaaggaaaatgccctggatagaatcatggcccttcccttcaaaatgtggacttctaccgttaaaacatcntcaacaattcacctttttccccggcctttcccccgaaaaaaccaagttattttgggcccttggcaacccggggaaaaagttccactcccccggccaacgcgggtttttaaaaaaaaaaaggttttgccaaaacccggggaaacccccagaaaaaatttttttaaaaaccttttgggagagagggggtaaaaggaacccttgtttttttgaaacccccaataa

SEQ ID NO: 46168 - DNA, 682 bp, Zea mays
  misc_feature: Ceres CLONE 1451384-F
  misc_feature: Encodes the peptide sequence at SEQ ID NO. 46169
  misc_feature (556)..(556): n is a, c, t, g, unknown, or other
cagagctggagctccccgcggtggcggccgctctagaactagtggatcccccgggctgcaggaattcgcacgagaccattacctagaacatcctaatcgaaaaagacaagagcgcggcaacaccgcgcatatacatggaatgagaagggctcagctacagccaagcgaataaatatactgtgaattaaccctaacctaaccgaagcgtccgcctcccacacacgggactccggccgcgagaacccgcgactaagccaggacgcgggacgccacagccaccggcctcagcatccgcctaggacgaataacccttctaggctgccgccgccgccgtccttagctcatattgttgccggcgaagagcgccccagatccgcccctgctatggagtcggcggtgaacctcgaggcgtacccgctggctgatgcgcagctgacgataggtatcatcgatatcatccagcaggcccgctaactacagcagctcaagaatggagctaacgaagcgacgaagacccctgacagggggatatcggaagttcgtagtgatggcggcngacaccgaagccgctcgagatcctccttcaactcccctttgctagctgaggataaaaacctgccctattgtatttgttccatcgaaacaagctccttggcggtcctttgggggtgacaaagccttt

SEQ ID NO: 46169 - protein, 29 aa, Zea mays
  misc_feature: Ceres CLONE 1451384-F
MESAVNLEAYPLADAQLTIGIIDIIQQAR

SEQ ID NO: 46170 - DNA, 698 bp, Zea mays
  misc_feature: Ceres CLONE 1451389-F
  misc_feature: Encodes the peptide sequence at SEQ ID NO. 46171
  misc_feature (443)..(443): n is a, c, t, g, unknown, or other
  misc_feature (444)..(444): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaaatactagatcggttaaatcaactattctacattttcagcttagaaatttggtatgggcaacgtccaagcacgacatctacctagtatctcattactcaattcgtcactggtcagcattgagtggtgtggatactgaacttatcaacgtccaaggacatgtggcaccaagggagaagcatgcaggaagtttattagaggggttttatcagactcaagttagtaccttgacagtcaaggacaatttactggtagctggtgggtttcaaggagagctgatctgtaacaccttgatcaggaagggtatagtttttgctgtcgaaacacttatgatgataatgctnnatacaatgcgggtgagatatttaatacctctagtggcggcgttcacttcatggcatcaaataacgactctggtgtgagatactatgacatggagagattccagctatcaagcattttcagtttgattgccagtgaaacatgctccgttgaagcctgaccaaaagtgggtggtaatgtgggggaggacccggagggcccactaatgaggaaactcttgaaagacagtcatccctaaaaggattcgggcttccatn

SEQ ID NO: 46171 - protein, 35 aa, Zea mays
  misc_feature: Ceres CLONE 1451389-F
MASNNDSGVRYYDMERFQLSSIFSLIASETCSVEA

SEQ ID NO: 46172 - DNA, 492 bp, Zea mays
  misc_feature: Ceres CLONE 1451397-F
  misc_feature (243)..(243): n is a, c, t, g, unknown, or other
tggactccccgcggtggcggccgctctagaactagtggatcccccgggctgcaggaattcgcacgagaccattacctagaacatcctaatcgaaaatcgttcttccagcgaagcaagcagcctaaaaaaaccgtatcgtctcgcctgttcagtttccttctcttcccgcagcccggtttgccgaccaggttccaccgttccagagtagccaagcgaatcccgtgtctggttcgcgcgatggcnggaagagcagtccaatcccccagcaccagcaagcgggaaggaaggggaggttattgttgagcagcagcagtcgagggaggcccccaaaacttgaagtaccctggaacttctctcccaggggggggggtgtccccaaagcccccggggggggggcccccccccctggggggtttttaaagggggccctctccaaaaaagaaaaaaaaaagggggggggcgttttttccccccccccggtttttaaaaccc

SEQ ID NO: 46173 - DNA, 695 bp, Zea mays
  misc_feature: Ceres CLONE 1451401-F
aaactggagctccccgcggtggcggccgctctagaactagtggatcccccgggctgcaggaattcgcacgagaccatacctagaacatcctaatcgaaaaatcaggattttccttgcctctgctcgttctcatggccgagcacacctcttcctcaagtgtcgcctgctgtaccagtgtccagctccccacgcccgccgctactcctagcccctctcctccttggatttcgcccagcctccatctctctttccagccatggatgccgcccctccctagcaccctcatctccacgggagctcaccctagctccagcttcaaccatggaagggggcctctcctgcctacagcaggtcagcgccccatctcctcaacatctcggctccctgtcccatctctctctcacgagccactctcctcgttctccatgacgtcgacatggggctcgcccctgcaacctcgcctcgctgggtctcctcagggcgccggggtgttgcttcctatacatcatgcgacttcctagtgcttgctctcgccctaggccatggagcagcagcagccacgacactccttcgtgtcgcgccctcgacgtgttcgatgaaataccgcagcgagctccaactcgatcttcacagcccctgcacgacgtcacaaactccgctcgttgtcgatgtcgtgcttcgtgcatcgcgtgttc

SEQ ID NO: 46174 - DNA, 761 bp, Zea mays
  misc_feature: Ceres CLONE 1451405-F
  misc_feature: Encodes the peptide sequence at SEQ ID NO. 46175
ctggagctccccgcggtggcggccgctctagaactagtggatcccccgggctgcaggaattcgtctcacccctaatcgaaaaagattagtcacactcttcgcaagcaaaaaaaaaaaaaaaaaatccccaaatttcggataagcctcgccggcgacgaaatcagggtttcatcgaacaacaagatggctcacgcttgcgtctccacatcagcttcctctctcaggttcacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggcccatcagagatgatttacaagtcccttcttcgccgtattttcctgtgtacgctcaaggacaaggaccacctcctatggtgcaagagcgtttccagagtatcataagccagctcttccaatataagattattcgttgtggtggtgctgtggatgatgatatgggccacataatcgtagctcagcttctttacctcgatgctgttgaatctactaaggatattgttatgtatgtgaactctccttgggggatcagttacagctggtatgggctatatccgatactatgaggcatatcccaactgatgtctccactgtttgtgtccggcctaactgcttacatgggaac

SEQ ID NO: 46175 - protein, 70 aa, Zea mays
  misc_feature: Ceres CLONE 1451405-F
  misc_feature: SWISSPROT Homolog: EC 3.4.21.92 Endopeptidase Clp
MVQERFQSIISQLFQYKIIRCGGAVDDDMGHIIVAQLLYLDAVESTKDIVMYVNSPWGISYSWYGLYPIL

SEQ ID NO: 46176 - DNA, 761 bp, Zea mays
  misc_feature: Ceres CLONE 1451411-F
  misc_feature: Encodes the peptide sequence at SEQ ID NO. 46177
ggagctccccgcggtggcggccgctctagaactagtggatcccccgggctgcaggaattcgtctcacccctaatcgaaaaatcggactcatctccttcgattcagcagaggacagcgctctgcctctccactacttgacagccacggatccttccatccctcgcctagcgaacagacctggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgagctctgccatcgcattcatgttacctctgaaagcactcagacaatcctctagatttattgtcaataacagctgcgtatttggcattggcttcatcaaagttgccactatcaaagttaacacgacgctagaaacactgtttgtcaggaagatgaacatcttcaacgaggccaaagtttacacttggaaaatcgaggatttctctgctctgaagaacccgtcccactcaccggagtttgagatcgctggatacacatggattatctctttgaatccatcctacgatggtaacagcctgtcc

SEQ ID NO: 46177 - protein, 165 aa, Zea mays
  misc_feature: Ceres CLONE 1451411-F
MRYLKLNPKYEVSNEECVSLRLELSQSSVKLDTIFEASFKFMIYDQLIGKHKVHLGNHSFQTASTSSAIAFMLPLKALRQSSRFIVNNSCVFGIGFIKVATIKVNTTLETLFVRKMNIFNEAKVYTWKIEDFSALKNPSHSPEFEIAGYTWIISLNPSYDGNSLS

SEQ ID NO: 46178 - DNA, 862 bp, Zea mays
  misc_feature: Ceres CLONE 1451413-F
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (423)..(423): n is a, c, t, g, unknown, or other
  misc_feature (427)..(427): n is a, c, t, g, unknown, or other
  misc_feature (429)..(429): n is a, c, t, g, unknown, or other
agtcactccaaccaacccaaaaaactaaaaaaacnnnnnacnnnnnnnttcacagctggactccccgcggtggcggccgctctttaataatggatcccccgggctgcaggaattctcttaaaaaagtttcatcgacgatctgactggaaagaactgcatgaacggaacacctctagtgctgaagaacaaaggtccacgttggtatgagcagctgcagtgttggtgactcaacttcagggggcgtgtcaccgtcgcgtcagtgaagaacttccagctcgtcgactctgttgatcattccctaaacatcctcgcagcggaccacgagaaggtgatcctccactttgggaagataggcaaggatatattcaccatggactaccggtacccactctcagcggcccaagcctttgtgatttgtttganaaancnccacaccaaaaaagaaaagagaaagaacccaacccatcttcaaaatcactggacgaaacttattgtcgacgtgcgggggtatattacacggcgattttagaattccgtaaccctgcaaatgcatagcccctctcgattgaccccgacataaataattaattttttcctcaatgacacattgacgcgaataaacattttttttctcagtatcaaagcaagactcggagcggaaactatgaactaacccccccttgttccagatgatatatacctgcttacgtaaaaccctcgagaaagatcaaaaattatcccctttcccgatatatctcaacaaagcgaatatattgtaatcagctcttttcgtctttttggaaaattaagctatttttgcgccgtattatatttgtagatcctagcctgatattcttcttag

SEQ ID NO: 46179 - DNA, 671 bp, Zea mays
  misc_feature: Ceres CLONE 1451416-F
  misc_feature: Encodes the peptide sequence at SEQ ID NO. 46180
  misc_feature (483)..(483): n is a, c, t, g, unknown, or other
  misc_feature (486)..(486): n is a, c, t, g, unknown, or other
  misc_feature (523)..(523): n is a, c, t, g, unknown, or other
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgtttgagtactatgctaagctgaggagctgcattcacatcatgtggtggagcgcgaggnaangcttctttatcgacgcctcactgtcacgacgcatcangcacccccccaagcgtggactacgctgggtttggctttgcatgagaacgacgctgtgtttgtcatagtcatatcgaactaaagaacaagtacctttttatcccaatgatccccctcctacaaaacttggaagctcctggacaaaggcc

SEQ ID NO: 46180 - protein, 72 aa, Zea mays
  misc_feature: Ceres CLONE 1451416-F
AGAPRGGGRSRTSGSPGLQEFVSPLIENKWERQRFGLQGGFVTNPLAEPNISSAGKTMVTHEGRKKDKTLQK

SEQ ID NO: 46181 - DNA, 734 bp, Zea mays
  misc_feature: Ceres CLONE 1451419-F
  misc_feature: Encodes the peptide sequence at SEQ ID NO. 46182
  misc_feature (391)..(391): n is a, c, t, g, unknown, or other
  misc_feature (407)..(407): n is a, c, t, g, unknown, or other
  misc_feature (460)..(460): n is a, c, t, g, unknown, or other
ggagctccccgcggtggcggccgctctagaactagtggatcccccgggctgcaggaattcgtctcacccctaatcgaaaatgtattagaaaaagatttgaacatgagtgagcatcatcattttgcgtttgtgcacggtgcagggcatggaggatggtgttggtacaagctcgccaattcactgagagagaatggacataaggccacctgcatcgacctcaagggcgctgggatcaacctaactgatccaaacactgtctcctctcttgatgactacaaccagcctctctatgacttcctctcccaacttcccctcgaccaaaaggtcattctggtgagccacagcgttggaggagggagcatgacggctgccatgtgccagtatccttccnaagtctccatggctgnttacgtcgcagcagccatggtcaaacctggtacccatattcccccaatctcangaagtactaaagatatgttcagggatgatagaaacggaagctgaaaaaattggaacttcccttttggaatggacccgaaaattcccccccagttgaagatgaaacttgatttttccgggaaaatttttaaaccaaggccccctggggaataacctgtggtaccaaattttgggtccaacccctttagggtttttgggggaatggaaaaccccgcgcccccaggggggaaaatccccgggggtttattataaagggggagaaatttttttcccct

SEQ ID NO: 46182 - protein, 133 aa, Zea mays
  misc_feature: Ceres CLONE 1451419-F
  misc_feature: SWISSPROT Homolog: EC 3.1.1.78 Polyneuridine-aldehyde esterase
  misc_feature (97)..(97): Xaa is any aa, unknown, or other
  misc_feature (102)..(102): Xaa is any aa, unknown, or other
  misc_feature (120)..(120): Xaa is any aa, unknown, or other
MSEHHHFAFVHGAGHGGWCWYKLANSLRENGHKATCIDLKGAGINLTDPNTVSSLDDYNQPLYDFLSQLPLDQKVILVSHSVGGGSMTAAMCQYPSXVSMAXYVAAAMVKPGTHIPPISXSTKDMFRDDRNGS

SEQ ID NO: 46183 - DNA, 791 bp, Zea mays
  misc_feature: Ceres CLONE 1451429-F
  misc_feature: Encodes the peptide sequence at SEQ ID NO. 46184
  misc_feature (135)..(135): n is a, c, t, g, unknown, or other
  misc_feature (260)..(260): n is a, c, t, g, unknown, or other
  misc_feature (401)..(401): n is a, c, t, g, unknown, or other
  misc_feature (407)..(407): n is a, c, t, g, unknown, or other
  misc_feature (424)..(424): n is a, c, t, g, unknown, or other
  misc_feature (427)..(427): n is a, c, t, g, unknown, or other
  misc_feature (431)..(431): n is a, c, t, g, unknown, or other
  misc_feature (507)..(507): n is a, c, t, g, unknown, or other
  misc_feature (660)..(660): n is a, c, t, g, unknown, or other
ggagctcccctaggtggcggccgctctttaatagtggatcccccgggctgcaggaattcgtctcacccctaatcgaaaattcattaccggaagagaaaaaaataactcgtaaaagaaggagacgccgaaaattcnaaaggggagggggaaagcaaagctgatggcggaggcccaggggaaagcaaagcaaatggcggaggccccgagcaagatcgaatccatgaggaagtgggtcgtcgagcacaagctccgagccgtangttgcctctggctaggtgggatcagcagttcgatcgcctacaactggtcgcggcccaatatgaagcctagcgtcaagatcatccacgcaaggttgcatgcgtgagttctaaccctcgctgcattagttggatctgcatgtnagtcancccaacccccacaaaanaanggancttcttgggccaacgggcggacaaactccacacacccaagaccctggaccatctcgcataaagatctaaagggccnccatggttggttcgctgcctgccccaataaatggcggggctcatctccctgtaccttcttgacccgccccatggaaagcccggaatgccaatcgcctttctttttggtctaggtcatttccacaaataggtaggtgttacactacccctccanaaatccccaatgtgatcgtactaacgggctaaatattgtgcgcccgcctccttggcccttatgaccgagaatataaccgaatacccttccgaggtaaaccggatttccgcccttattcgtgggttcgcgag

SEQ ID NO: 46184 - protein, 67 aa, Zea mays
  misc_feature: Ceres CLONE 1451429-F
  misc_feature (34)..(34): Xaa is any aa, unknown, or other
MAEAQGKAKQMAEAPSKIESMRKWVVEHKLRAVXCLWLGGISSSIAYNWSRPNMKPSVKIIHARLHA

SEQ ID NO: 46185 - DNA, 733 bp, Zea mays
  misc_feature: Ceres CLONE 1451433-F
  misc_feature: Encodes the peptide sequence at SEQ ID NO. 46186
aaagctggagctccccgcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgtgtccgacgccgcggccgccgtacccctcgccgcggactccctcgccgccgccgccttcggctacctcttctgctagatccgcgctggatacttgaacccccccccctaccatgattcgtctggtctggcgcgcgtgagtccagctcgtgtgtcgtgcgtgtctctgtgtgaggtgacggcaggcgtgtgtgtatgtatggagtcggccgcgttggcggtcagacgatgaagtgtgctcttggtgggtggaacgggcttccgaccccccactggcttgccgcgggcaaataatgtgactaccgctgctgcggtttcctggcctatcagttccctatgactcatcttgaattcttatttcgcacacagaacaaacatccctcgatatttaacaataagccaaaccttttatccgaatt

SEQ ID NO: 46186 - protein, 57 aa, Zea mays
  misc_feature: Ceres CLONE 1451433-F
MAGLRMKFVAVAAMAAALVASAAAAEAPAPAPVSDAAAAVPLAADSLAAAAFGYLFC

SEQ ID NO: 46187 - DNA, 851 bp, Zea mays
  misc_feature: Ceres CLONE 1451437-F
  misc_feature: Encodes the peptide sequence at SEQ ID NO. 46188
  misc_feature (484)..(484): n is a, c, t, g, unknown, or other
  misc_feature (485)..(485): n is a, c, t, g, unknown, or other
aagctggagctccccgcggtggcggccgctctagactagtggatcccccgggctgcaggaattcgtctcacccctaatcgaaaagtcgcccccctttctctctcgctcaaaagttgctgctggagccctctcccctctctccgaccaccaaccatggatgaggcgcaagttgtggagtcaaaggatggaaccatctcggttgcttctgcatttgctggttatcaggaagctgtgcaagacagggatcacaaattcttgacaaaagcagtggaagaagcatatcgaggagtcgattgcggtgacggaggtccattcggagcaagtgtcctctgtaatgacaacagagtagtcagttgctatatcgtggttattaaaaaaaagtgagccttactgtgaaaatgttaaagaaaaaccccccccacccccccctccccccccctctgtgtggaaaaaaaaagttttcacaacagcaaaaaaaaacccnncaccaccaaagccacggcccaacagagatttttgtgggacattcatctccccccccatttaggaggtttggttttttcccgcgccccacgcgtaaagcccgcccaccccgcctctgggaaccttggagaacattctctgccggtgtgccccttttacagcacactgcgtgttcctccccaacggtcatcactggtgccccccgtcgaggagcgcccgtagcggctttcgggtgcgtcactggagtctcccgcgttactactctctctcttcagctctagttgtggatcaagatctccccccctgccaccccctcgtctgtccacccaccagctgagggcgccctcgccgtccttccttctcccctc

SEQ ID NO: 46188 - protein, 76 aa, Zea mays
  misc_feature: Ceres CLONE 1451437-F
MDEAQVVESKDGTISVASAFAGYQEAVQDRDHKFLTKAVEEAYRGVDCGDGGPFGASVLCNDNRVVSCYIVVIKKK

SEQ ID NO: 46189 - DNA, 751 bp, Zea mays
  misc_feature: Ceres CLONE 1451441-F
  misc_feature: Encodes the peptide sequence at SEQ ID NO. 46190
  misc_feature (419)..(419): n is a, c, t, g, unknown, or other
tggagctccccgcggtggcggccgctctagaactagtggatcccccgggctgcaggaattcgtctcacccctaatcgaaaagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagagaggtagaccttgaggccgctacccggggaggagagcgagagatgtataaacaggggggagcggggggaggggctgggctggaccggaagcggatcaacgacgcgctggataagcatctcgagaaggcggtcgcgtcgccgtccacgtcgagggggtcggcgggcggcgggcgcgaccaccaccgcctcgtcgtgccgtccccccccncccccatccccaagggccgctgctccgaaggggagtctgattctgatagtgaagcatcggatgttagcggctctgatggagaagacaccccatggatttcatggtattgcaacttaagagggaatgagttcttctgtgaagtcgacgatgattatattcaagacgacttcaacctttgtgggctcagcagccaagtcccttattatgattatgctctcgatctcattttaaatatcgaggcatctcatggtgatatgttccctggagaacaaaatgagctcgtagaatcacctgcagagatgctttatggtctgaatcctgcccgattcttt

SEQ ID NO: 46190 - protein, 166 aa, Zea mays
  misc_feature: Ceres CLONE 1451441-F
  misc_feature (87)..(165): Pfam Name: CK_II_beta Pfam Description: Casein kinase II regulatory subunit
  misc_feature (56)..(56): Xaa is any aa, unknown, or other
MYKQGGAGGGAGLDRKRINDALDKHLEKAVASPSTSRGSAGGGRDHHRLVVPSPPXPIPKGRCSEGESDSDSEASDVSGSDGEDTPWISWYCNLRGNEFFCEVDDDYIQDDFNLCGLSSQVPYYDYALDLILNIEASHGDMFPGEQNELVESPAEMLYGLNPARFF

SEQ ID NO: 46191 - DNA, 887 bp, Zea mays
  misc_feature: Ceres CLONE 1451448-F
  misc_feature: Encodes the peptide sequence at SEQ ID NO. 46192
  misc_feature (267)..(267): n is a, c, t, g, unknown, or other
  misc_feature (283)..(283): n is a, c, t, g, unknown, or other
  misc_feature (284)..(284): n is a, c, t, g, unknown, or other
  misc_feature (291)..(291): n is a, c, t, g, unknown, or other
  misc_feature (345)..(345): n is a, c, t, g, unknown, or other
  misc_feature (382)..(382): n is a, c, t, g, unknown, or other
  misc_feature (383)..(383): n is a, c, t, g, unknown, or other
  misc_feature (421)..(421): n is a, c, t, g, unknown, or other
  misc_feature (435)..(435): n is a, c, t, g, unknown, or other
  misc_feature (437)..(437): n is a, c, t, g, unknown, or other
  misc_feature (438)..(438): n is a, c, t, g, unknown, or other
  misc_feature (441)..(441): n is a, c, t, g, unknown, or other
  misc_feature (444)..(444): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (451)..(451): n is a, c, t, g, unknown, or other
  misc_feature (454)..(454): n is a, c, t, g, unknown, or other
  misc_feature (462)..(462): n is a, c, t, g, unknown, or other
  misc_feature (471)..(471): n is a, c, t, g, unknown, or other
  misc_feature (473)..(473): n is a, c, t, g, unknown, or other
  misc_feature (479)..(479): n is a, c, t, g, unknown, or other
  misc_feature (487)..(487): n is a, c, t, g, unknown, or other
  misc_feature (502)..(502): n is a, c, t, g, unknown, or other
  misc_feature (507)..(507): n is a, c, t, g, unknown, or other
  misc_feature (509)..(509): n is a, c, t, g, unknown, or other
  misc_feature (517)..(517): n is a, c, t, g, unknown, or other
  misc_feature (518)..(518): n is a, c, t, g, unknown, or other
  misc_feature (525)..(525): n is a, c, t, g, unknown, or other
  misc_feature (552)..(552): n is a, c, t, g, unknown, or other
  misc_feature (570)..(570): n is a, c, t, g, unknown, or other
  misc_feature (572)..(572): n is a, c, t, g, unknown, or other
  misc_feature (596)..(596): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (644)..(644): n is a, c, t, g, unknown, or other
  misc_feature (670)..(670): n is a, c, t, g, unknown, or other
  misc_feature (676)..(676): n is a, c, t, g, unknown, or other
  misc_feature (678)..(678): n is a, c, t, g, unknown, or other
  misc_feature (687)..(687): n is a, c, t, g, unknown, or other
  misc_feature (704)..(704): n is a, c, t, g, unknown, or other
  misc_feature (721)..(721): n is a, c, t, g, unknown, or other
  misc_feature (738)..(738): n is a, c, t, g, unknown, or other
  misc_feature (752)..(752): n is a, c, t, g, unknown, or other
  misc_feature (774)..(774): n is a, c, t, g, unknown, or other
  misc_feature (784)..(784): n is a, c, t, g, unknown, or other
  misc_feature (787)..(787): n is a, c, t, g, unknown, or other
  misc_feature (799)..(799): n is a, c, t, g, unknown, or other
aagctggagctccccgcggtggcggccgctctagaactagtggatcccccgggctgcaggaattcgtctcacccctaatcgaaaacaagtgggacaggcagaggtttgggcttccgggtgggtttgtcacaaacccattagccgagccgaacatttcatctgcagggaaaacaatggttactcatgaaggcaggaagaaggataaaactttacaaaagtgaagggcgggttaggcttgatgaagacattctgttccaagcgtgaacngatcgagttagcttannatcatgnaagcggctggagttctctattccaccgcgacccctttttgtttctatggaaccnaatttgtcatttttggtgggtttttgagaggggtggnngtgggtgtgtaagtattgatgttttgattgagagcggnaccctcccccccanannaanaanannnncnaanccccatanaacctcaantntccccncccccccncccccgcaccccccncccgnangacttccnnttaattntaataggccctccgccctcaccacccngacatcaattccagtagnanctaacccgcatattgttttgtggnaactacactcttgcgccnnnngcgccatttatatcgactgtccgtatngaccgcatctcgggttttgatggtcnaaggcntnttatcgcgngtcacgttaccatcatnactccttctttatcagnacgtagaaatggtaacncacagattttttanagcttacatgacggattgtgtncttttacacnctngcacccgagaanaagaggccccccccctccccaccgcacttggagtacagtagtgtattggataggttatgcacaatcagaccccctatgactgtcgctt

SEQ ID NO: 46192 - protein, 72 aa, Zea mays
  misc_feature: Ceres CLONE 1451448-F
AGAPRGGGRSRTSGSPGLQEFVSPLIENKWDRQRFGLPGGFVTNPLAEPNISSAGKTMVTHEGRKKDKTLQK

SEQ ID NO: 46193 - DNA, 792 bp, Zea mays
  misc_feature: Ceres CLONE 1451449-F
  misc_feature: Encodes the peptide sequence at SEQ ID NO. 46194
atagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctagggacgtacattgtcattttgggagcttctgaaacatggcctgcgcctggactatgaatgtatgagtccttccgaagcttaactggttaaaaccctagccatagctgagggaactgcctttccccccatgtggggaaaccccaaggaaatctttttttatcggaaaacccccccttttgcccgaaaccaaatgggccccccccccaacccgggaaaaaccccgggtttggcctttgaaaaaaaaacaccacccgggttttttcaaaaaccttttccccccaaaaaaaaaacaatgttttttaaaacccaagtttccccccccccccaaaaaaaggggggcccccttttaaaaagcgccaaaaaaacaccccccaaaaaaaaaaaaaaaaaaagaagcccgggggccccccccccccctcaaaagggagaataaaaccccccccccccccccccc

SEQ ID NO: 46194 - protein, 73 aa, Zea mays
  misc_feature: Ceres CLONE 1451449-F
IAGAPRGGGRSRTSGSPGLQEFVSPLIENKWERQRFGLQGGFVTNPLAEPNISSAGKTMVTHEGRKKDKTLQK

SEQ ID NO: 46195 - DNA, 762 bp, Zea mays
  misc_feature: Ceres CLONE 1451455-F
  misc_feature: Translation starting site: 190
atagctggagctccccgcggtggcggccgctctagaactagtggatcccccgggctgcaggaattcgtctcacccctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggccccccccccccacgccggtgttcctgatcttcagccccgtgctcgtccccgccgcgctgctcatcgggacggccgtcatggggttcctcacgtcgggcgcgctggggctcgggggcctgtcctcgctcacgtgcctcgccaacacggcgcggcaggcgttccagcgcaccccggactacgtgaaggaggcgcaccgcaggatgccggaggcccgcgcgcacgcgggccacaagaccgcgcaggcaagccaggccatccagggcaggccgcaggaagccggcgccgggggaggtgcaggtgccggcccctggcggcggcggcaaggcttccctcgtagcaagtcatcc

SEQ ID NO: 46196 - DNA, 736 bp, Zea mays
  misc_feature: Ceres CLONE 1451456-F
  misc_feature (446)..(446): n is a, c, t, g, unknown, or other
  misc_feature (453)..(453): n is a, c, t, g, unknown, or other
  misc_feature (473)..(473): n is a, c, t, g, unknown, or other
aaagctggagctccccgcggtggcggccgctctagaactagtggatcccccgggctgcaggaattcgtctcacccctaatcgaaaactcactctcactctcacttccacactcctactcctccccgcccccgtcgccttccgccgccgtcttttgcgctaacgcttcgcctttcgatcccctttctgacttcttatagcatcatcccaagtcctcgcccggactccgcagattctctggttgctacgagttcttcgcctggtttttgggcaaggccaaaatttctgatttttttccaccgccgcaaacccctttgctgtgccataccgccattccattcctaagctgggcgtgtgcgggtgaagaaaggaagcgaggccggatgtttcgctgaaaccccgccgccttttttcccccctcttttctggaccctgatgaagaccgtancaaatangggaagggagaagcgcggcngcccggtcgttcgtcagaatgatccactgctggtcctcgggctgtcccgaagggcccggtaacctgctcctcaggtaaaggtccggccctgcgggactcggaaattccccccgggaacaaggaaaaaagggaaagggcccggaaacttaaaacactggaagcacctccggggacccctatgccaaagtgccccgatcttaaaaaacaaaaatgggggttaaattgggacccttccccctaggaaaagggtttctgaaaacccc

SEQ ID NO: 46197 - DNA, 703 bp, Zea mays
  misc_feature: Ceres CLONE 1451457-F
  misc_feature: Encodes the peptide sequence at SEQ ID NO. 46198
  misc_feature (622)..(622): n is a, c, t, g, unknown, or other
ggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactcccaagctaaactgcctgagtactatgctaagctgaggagctgcattcacatcatgtggtggagcgcgagggaggcttctttatcggacagcctcacttgtcaccgacgcaatcaggcacccccccaagccgtggactacgctgggtttggctttggcatgagaacgaccgctgtgtttgtcataagtcatatcgtaactagagaaaacagtagcnttataatccacatgtatcaccatcctacagaactatggatgctctgacatagcgatagcctctaaaaaaaaaacaactcag

SEQ ID NO: 46198 - protein, 71 aa, Zea mays
  misc_feature: Ceres CLONE 1451457-F
GAPRGGGRSRTSGSPGLQEFVSPLIENKWERQRFGLQGGFVTNPLAEPNISSAGKTMVTHEGRKKDKTLQK

SEQ ID NO: 46199 - DNA, 755 bp, Zea mays
  misc_feature: Ceres CLONE 1451461-F
  misc_feature: Encodes the peptide sequence at SEQ ID NO. 46200
  misc_feature (1)..(1): n is a, c, t, g, unknown, or other
  misc_feature (383)..(383): n is a, c, t, g, unknown, or other
natagctggagctccccgcggtggcggccgctctagaactagtggatcccccgggctgcaggaattcgtctcacccctaatcgaaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggggcgggaccgactatgggacggacgacagcaagatctcccccgacgagatccncttcgagggctgcgactacaaccactggctcatcaccctcgtgttcccggatcctaagccgtcgcgcgaagagatgatcgagacatacctccagactctcgccaaggtcgtcgggagttatgaggaggccaagaagaggatgtatgcttttagtacgacgacttatgttggttttcaggctgtaatgaccgaggaaatgtcagaaaaatttcgcggtttgcctggagtaattttcattttgcccgattcatatctatatccagaaccaaaggaattcgggaggagacaaatatgacaatggtgtccatccctccaaaaccaccaccctgttcatttaaagcaaaacctccagaactgaccaggaacccttac

SEQ ID NO: 46200 - protein, 182 aa, Zea mays
  misc_feature: Ceres CLONE 1451461-F
  misc_feature (85)..(85): Xaa is any aa, unknown, or other
MALALRLRRVLAAASTAAPLLRPSTSVARPCPLVPLASPVAPLPLPPWRFLPGGGAGFRSTAAAAARGGTDYGTDDSKISPDEIXFEGCDYNHWLITLVFPDPKPSREEMIETYLQTLAKVVGSYEEAKKRMYAFSTTTYVGFQAVMTEEMSEKFRGLPGVIFILPDSYLYPEPKEFGRRQI

SEQ ID NO: 46201 - DNA, 726 bp, Zea mays
  misc_feature: Ceres CLONE 1451463-F
  misc_feature: Encodes the peptide sequence at SEQ ID NO. 46202
aaagctggagctccccgcggtggcggccgctctagaactagtggatcccccgggctgcaggaattcgtctcacccctaatcgaaaaccaaggagcagaataagcgaggagctttgcatgagaagctcaagattctccgcagcgttactcactctcatgcgggggataaagtgtcgataatagcggacgcgtcatcgtacatcaaggaactaaagcagaagatcgcgaagctaagccaagagatggcatcgtcgtctccgcagcacgccactagtgtctgccaacaacaaccgtcgtcgtcgtcggtgagtgtgggagtcctgctggacaagaagggccgtttcctcgtcagtgtgttcatggacgagagctgcggcccgccgccggccgggctactcgcttccgtcctcgaggccttcgacgagatcggactcacggtgcttgaggctagggctacctgcgctggttcctttcggctagaagctgtaggagaggaagtagtagtagatgggggcctcatcgtcgacgcgcacgcggtggagcaagcagtagttcaggcaatcaagaattgccctgcaaatcattaaactaatcgacctagtcctccaattcgatcgatcgagttgacgatgcgctgctggtggagcacaaagttcatgtcaagctagagactccgagctatatatacatatactgattcgcatcgtacttttttaagagagcaaat

SEQ ID NO: 46202 - protein, 114 aa, Zea mays
  misc_feature: Ceres CLONE 1451463-F
MASSSPQHATSVCQQQPSSSSVSVGVLLDKKGRFLVSVFMDESCGPPPAGLLASVLEAFDEIGLTVLEARATCAGSFRLEAVGEEVVVDGGLIVDAHAVEQAVVQAIKNCPANH

SEQ ID NO: 46203 - DNA, 770 bp, Zea mays
  misc_feature: Ceres CLONE 1451465-F
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
ctaagctggagctcaccgcggtggcggccgctctagaactagtggatcccccgggctgcaggaattcgtctcacccctaatcgaaaacaagtgggagaggcagaggtttgggcttcacggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagctttctgaaaccccnnntgcgcgtgaactatgaatgtatgagtcactcccccccccacctgtttgagtactatgctaacctgaggaactcccttcccatcatgccgtggaaccccgaagggagcttctttatcgaaacaccttcacttgtccccgacgcaatcaaggcacccccccccaacccgtggaatacgcctgggtttggcttttggcacgaataacccaccccctctcttttgttataagtccatactcctaacctacacaaacctagtcgccctttttcaacccacatggcaccccccatccttcaccaaacttatggatgctccctttgtaaccaacacgcctggacaaaacccccttccctcattctactaaaaccatacccgaagcccccccctg

SEQ ID NO: 46204 - DNA, 789 bp, Zea mays
  misc_feature: Ceres CLONE 1451468-F
  misc_feature: Translation starting site: 308
  misc_feature (337)..(337): n is a, c, t, g, unknown, or other
  misc_feature (417)..(417): n is a, c, t, g, unknown, or other
atagctggagctccccgcggtggcggccgctctataactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcngtggtgtacgcgctgtcgccctccagcagaggtgatgccggggctgtggaaggacatcaccaccaagatccaccacacgnccccgagaactggatcttcggcaaggttcttctcaccccgttgtgggaccctaccatacgccaggtggaacaaaagcagggaaagctttccccacaaaacaaaagggaatgccccccagtttgctccgcttggcccacattaaatttcccgaggggggtgaaaaaccggcaaaggcatttctttggcccgttttagtcacacctttttcccctttcaaaaacaaaaaggggattggggccggggaaaaattttttgggggggcccaaaaaagaacccttttgcccccatagggggaaaaaaaaaaaaatttctccaaaaaaaaaaaaaaaaaagaagaccgcgggggcgccccctcccccccaagaaggggg

SEQ ID NO: 46205 - DNA, 777 bp, Zea mays
  misc_feature: Ceres CLONE 1451471-F
  misc_feature: Encodes the peptide sequence at SEQ ID NO. 46206
  misc_feature (370)..(370): n is a, c, t, g, unknown, or other
  misc_feature (371)..(371): n is a, c, t, g, unknown, or other
  misc_feature (373)..(373): n is a, c, t, g, unknown, or other
  misc_feature (377)..(377): n is a, c, t, g, unknown, or other
atagctggagctccccgcggtggcggccgctctatgaactagtggatcccccgggctgcaggaattcgtctcacccctaatcgaaaagaccacgccacgttcgcaattacagagatctagagagagagagagagagagggcagatctacgctagagcgacagagccacaaccaaccgagagggacagtccagtatggtggtggcgctcgggcccggccggttctacggcagcggcctgccgaggccgcgcttcttcccgggcgaccgcgtggacccgccggcgtccgtcaccgacccgctgctcgagtgggcgcgcgaagcgcactggtccatgggcggcatcagcgtgaagcgcctccgcctgcagggnngnatcnagggctccgtcgacaagctccgccgccgcgcgcacccccaccccagggtcaaggccaaggccaaggcccgcgccgctggccacatgccggcttcgctcgccgcgcttgggtccgacgacgacgcctccagcggcgactccgaggacgagcaggaagtggcggcgcgggagcgggccctgaagcgtgagcttgtcgacgacgaccaggactccgacgggtcccgcgagtcggagggagacgaggccctcgcggccattctcacccccgccaagaaaagccgcgcgaagaagctcatcgacaagttcgaccgcttccccgccggaacagcaacatcagctggggttggagagcaagaaaaagccggggggccccgacacccgggaacaaactctacaagagg

SEQ ID NO: 46206 - protein, 194 aa, Zea mays
  misc_feature: Ceres CLONE 1451471-F
  misc_feature (60)..(60): Xaa is any aa, unknown, or other
  misc_feature (62)..(62): Xaa is any aa, unknown, or other
MVVALGPGRFYGSGLPRPRFFPGDRVDPPASVTDPLLEWAREAHWSMGGISVKRLRLQGXIXGSVDKLRRRAHPHPRVKAKAKARAAGHMPASLAALGSDDDASSGDSEDEQEVAARERALKRELVDDDQDSDGSRESEGDEALAAILTPAKKSRAKKLIDKFDRFPAGTATSAGVGEQEKAGGPRHPGTNSTR

SEQ ID NO: 46207 - DNA, 740 bp, Zea mays
  misc_feature: Ceres CLONE 1451473-F
  misc_feature: Encodes the peptide sequence at SEQ ID NO. 46208
  misc_feature (476)..(476): n is a, c, t, g, unknown, or other
  misc_feature (688)..(688): n is a, c, t, g, unknown, or other
  misc_feature (689)..(689): n is a, c, t, g, unknown, or other
aagctggagctccccgcggtggcggccgctctagaactagtggatcccccgggctgcaggaattcgtctcaccccctaatcgaaaaacacaaacctccatgccccttcttcctctcctccccgtcatggcttccaccttctcccccacttccgccgcgagggccctcctcccgggctccacctcccgcccactcttcctcgccgcttcagcttcctcagggcgcattcaaccatccaggaagggactggacttccgccgcggccgattcaccgtctgcaatgtcgccgctcccaccgccgccgaacaggtacgcccccgttctccaatcccgcagcccgcaggaaccggtcggtaatccttcctccgcaaccccgcattttcgatgcctgcttctgcttccgcgcaggaggcgacggcgtcggccgcgaaggagacccagcgccccgtgtacccgttcgcggccatcgtggggcangacgagatgaagctctgcctgctgctcaacgtcatcgaccccaagatcggcggcgtcatgatcatgggcgacaggggcacggggaaagtcacccacgtccgctccctcgtcgacctgctcccggacatccgcgtcgtcgtcggcgaccccttcactccgacccggacgaccccgagtcatggcccccgaggtccgcagcggttcctgcaggnngacaccggcctcccgtcaccaccgcaagatcacatggtcgacctgccctcg

SEQ ID NO: 46208 - protein, 119 aa, Zea mays
  misc_feature: Ceres CLONE 1451473-F
  misc_feature: SWISSPROT Homolog: EC 6.6.1.1 Magnesium chelatase
  misc_feature (31)..(31): Xaa is any aa, unknown, or other
  misc_feature (102)..(102): Xaa is any aa, unknown, or other
MPASASAQEATASAAKETQRPVYPFAAIVGXDEMKLCLLLNVIDPKIGGVMIMGDRGTGKVTHVRSLVDLLPDIRVVVGDPFTPTRTTPSHGPRGPQRFLQXDTGLPSPPQDHMVDLPS

SEQ ID NO: 46209 - DNA, 789 bp, Zea mays
  misc_feature: Ceres CLONE 1451474-F
  misc_feature: Encodes the peptide sequence at SEQ ID NO. 46210
  misc_feature (473)..(473): n is a, c, t, g, unknown, or other
  misc_feature (492)..(492): n is a, c, t, g, unknown, or other
  misc_feature (523)..(523): n is a, c, t, g, unknown, or other
  misc_feature (530)..(530): n is a, c, t, g, unknown, or other
  misc_feature (539)..(539): n is a, c, t, g, unknown, or other
atagctggagctccccgcggtggcggccgctctagaactagtggatcccccgggctgcaggaattcgtctcacccctaatcgaaaagcgttggccgccaatcgcagtatcggcaccgttcttccccgcttctccagtccagctcaccagccgccccccctccgctgctgacactgcgaagtgcgaatcaaagccaccaccgcgcacaaaccatggcaccggtggaggcggagcagcaccggcggagggcgttggcgctcgcggcgcacgacgcctccggcgccgtctcccccatccgcatctcgcgaagggacactggagatgacgatgttgccatacagatactgtactgcgggatatgccactctgacctgcacaccatcaagaacgagtggaagaacgccaactaccctgtcccccctgggcacgagatcgccgggctgatcaccgaggttggcaagaacgtgaagaggntcaacgtcggagacaaggntgggcgtcggtgcatggtcaacacatgccantcctgcnagagctgcnagggagggcacgagaactactgctccaagatcatcttcacctaccactcccacgacagggaacgccaccgtcacctacggtgggctactctgacctggttgtcgtcaatgagcggcctcctcaatcgggttccctgaatggatgcccctcggaaaaaggccccccccctgcccctgggcagggattaaccggggtacaacccccttgaaaccccccggggctaaaagaagggagggcagccaccttcggg

SEQ ID NO: 46210 - protein, 154 aa, Zea mays
  misc_feature: Ceres CLONE 1451474-F
  misc_feature (37)..(152): Pfam Name: ADH_N Pfam Description: Alcohol dehydrogenase GroES-like domain
  misc_feature: SWISSPROT Homolog: EC 1.1.1.255 Mannitol dehydrogenase
  misc_feature (88)..(88): Xaa is any aa, unknown, or other
  misc_feature (94)..(94): Xaa is any aa, unknown, or other
  misc_feature (104)..(104): Xaa is any aa, unknown, or other
  misc_feature (107)..(107): Xaa is any aa, unknown, or other
  misc_feature (110)..(110): Xaa is any aa, unknown, or other
MAPVEAEQHRRRALALAAHDASGAVSPIRISRRDTGDDDVAIQILYCGICHSDLHTIKNEWKNANYPVPPGHEIAGLITEVGKNVKRXNVGDKXGRRCMVNTCXSCXSCXGGHENYCSKIIFTYHSHDRERHRHLRWATLTWLSSMSGLLNRVP

SEQ ID NO: 46211 - DNA, 835 bp, Zea mays
  misc_feature: Ceres CLONE 1451482-F
  misc_feature: Encodes the peptide sequence at SEQ ID NO. 46212
  misc_feature (381)..(381): n is a, c, t, g, unknown, or other
  misc_feature (393)..(393): n is a, c, t, g, unknown, or other
  misc_feature (395)..(395): n is a, c, t, g, unknown, or other
  misc_feature (410)..(410): n is a, c, t, g, unknown, or other
  misc_feature (435)..(435): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (499)..(499): n is a, c, t, g, unknown, or other
  misc_feature (666)..(666): n is a, c, t, g, unknown, or other
  misc_feature (678)..(678): n is a, c, t, g, unknown, or other
  misc_feature (692)..(692): n is a, c, t, g, unknown, or other
gcatagctggagctccccgcggtggcggccgctctatatactagtggatcccccgggctgcaggaattcgtctcacccctaatcgaaaactctctttttcctattctcctccttctgcctcctcgcccggcaggccgcggccggcgggtacggcggctggcagagcgcccatgccaccttctacggcggcggcgacgcctccggcaccatgggcggggcatgcgggtatggcaacctgtacagcactgggtacggcacgaacacggcggcgctgagcacagcgctgttcaacgacggcgcggcgtgcgggtcgtgctacgagctgcgctgcgacaacgccggcagctcgtgccggccggggtccatcttggtgattgttanaaatttttggcngncaaaatacggggtgnacagggtacgccccccccccggtgnaaacccgcccccaaccccacttcgacatggaccaacccccgccctccccccacancnnngcaanaaccgcccccggacttcctggccccgtctccctaccaaaaagggtgcctgttgcttggaaagaagggagggcattccgggttcacccatttaaagagggcactcgcttcctgccatccctggtggctgggagaaccaaacaagggcccaggctcccgggcgaactcncgggtccgcggncccctccaaagggnttacctctaccgcgcttggctgggctcatgtctccggcaccctggcgctttctaacttggcagaatcactctccttcccttcgaacggacaagagcgcctcctcctacacggggcgacctccctacaaacggtcgctcccgga

SEQ ID NO: 46212 - protein, 127 aa, Zea mays
  misc_feature: Ceres CLONE 1451482-F
  misc_feature (19)..(72): Pfam Name: DPBB_1 Pfam Description: Rare lipoprotein A (RlpA)-like double-psi beta-barrel
  misc_feature (58)..(58): Xaa is any aa, unknown, or other
  misc_feature (62)..(62): Xaa is any aa, unknown, or other
  misc_feature (63)..(63): Xaa is any aa, unknown, or other
  misc_feature (68)..(68): Xaa is any aa, unknown, or other
  misc_feature (76)..(76): Xaa is any aa, unknown, or other
  misc_feature (94)..(94): Xaa is any aa, unknown, or other
  misc_feature (95)..(95): Xaa is any aa, unknown, or other
  misc_feature (96)..(96): Xaa is any aa, unknown, or other
  misc_feature (97)..(97): Xaa is any aa, unknown, or other
MGGACGYGNLYSTGYGTNTAALSTALFNDGAACGSCYELRCDNAGSSCRPGSILVIVXNFWXXKYGVXRVRPPPGXNPPPTPLRHGPTPALPPXXXXNRPRTSWPRLPTKKGACCLERREGIPGSPI

SEQ ID NO: 46213 - DNA, 809 bp, Zea mays
  misc_feature: Ceres CLONE 1451483-F
  misc_feature: Encodes the peptide sequence at SEQ ID NO. 46214
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccacgcgacctcttttttttctaggaacgtacattgtcatttttggaagcttctgaaagcatggcgtgcgcgtgaactatgaatgtatgagtcactccacacccaactgtttgagtactatgctaaactgaggacctgcatccaaatcatgtggtgaaacccaagggaagctcctttttccggaagcccccctttgtcaccaagcaatttggggccccccccaagccggggacacccctgggtttggctttgggaaaaaaaaaccaccccttggtttgcccaaaggccatatcccaaccaaagaaaaacggggtcttttaaaccccctggtccccccccccccaaaaaatatgggagcccctttttaaaaagcggccgaaaaaaccctctccaaaaaaaaaaaaaaaaaaaaaggccccggggggcccaccctcccccccatagggggagcattataccgccccgccccggcgccgctatttataaacagcggagg

SEQ ID NO: 46214 - protein, 73 aa, Zea mays
  misc_feature: Ceres CLONE 1451483-F
KAGAPRGGGRSRTSGSPGLQEFVSPLIENKWERQRFGLQGGFVTNPLAEPNISSAGKTMVTHEGRKKDKTLQK

SEQ ID NO: 46215 - DNA, 725 bp, Zea mays
  misc_feature: Ceres CLONE 1451484-F
  misc_feature: Encodes the peptide sequence at SEQ ID NO. 46216
aagctggagctccccgcggtggcggccgctctagaactagtggatcccccgggctgcaggaattcgtctcacccctaatcgaaaacaagcgtcagacgcggatgttcgccctttccggggtcttcgtcgtactaccctttaaacgagcggagctttcgtctgctcgtaaaacagtggttactcctgaaggcaggaagaatgataaaactttacgaatgtgaagggtgggttacgcatgatgaagacattctgttacaagcgtgaactgctggagtttgcttattatcatggaggcggctgtagttctctgttctaccgcgacctcttttttctcataaggaacgtacattgtcatgtgtgcaagcttcggagagcatgacgagcgcatgaactatgaatgtatgagtgactccaaccctaccctgtttgagtactatgctaagctgatgaagctgcatcacatcatgtgttggagcgctagggaggattctttatcggacagcctcgcttgacaccgaacgcatcaggcaccccccccgagccctggactaccctgggtttggctctggctcgataaacgacccctctgtaagccggaaggcgtatcggaacgtccgtaacgaggggcttataaatcctttgtgtcaccatcctacaaaccttgggagcatcttgaacttgggcggataaagcccctcctaacaagaataatgaaacaaaccctc

SEQ ID NO: 46216 - protein, 52 aa, Zea mays
  misc_feature: Ceres CLONE 1451484-F
MCASFGEHDERMNYECMSDSNPTLFEYYAKLMKLHHIMCWSAREDSLSDSLA

SEQ ID NO: 46217 - DNA, 766 bp, Zea mays
  misc_feature: Ceres CLONE 1451488-F
  misc_feature: Encodes the peptide sequence at SEQ ID NO. 46218
  misc_feature (765)..(765): n is a, c, t, g, unknown, or other
ctggagctccccgcggtggcggccgctctagaactagtggatcccccgggctgcaggaattcgcacgagaccattacctagaacatcctaatcgaaaaaaaacgaacagaagagaagtctccagcaggcagcagcccatcgtcccacaccaagaacaaccagagaggcaagcaggggagaatcgcggaggtctgggaaacaccatcctgcagagatgacagtgctgctctccccgagctcctccctgttcctcgccaaaccttctgccgtcgccaagggcagggcggcggttgtgacgtgcttcagcgggccctccctgtcagtggggcgtgaagatcaggagggtgtagcagtggtggtggggaggcgtgcgttggcttccgcagcagctgtcgcctcagtgcttgggtttgcaggccgtggtctggcggccaaccagggcctgctcgccgggagggtccccggcttgtctgaacctgacgaaaatgacaggttggagaacataccgcaggccagacgacaagtccggtggccacggagttggctggagccccatcatcccgtacagcttcaaagttccagacggctgggatgaggtcccggtgtccattgctgatctgggcggcacggagatcgacctgcgcttcgcaaaccccaaggaaggccggctatgacctggacgacgcgaccatcgagaagatcggcagcccggaagaagtgatcaccgccttcggtccggaagtcatcggagaagacgtggaaggna

SEQ ID NO: 46218 - protein, 126 aa, Zea mays
  misc_feature: Ceres CLONE 1451488-F
MTVLLSPSSSLFLAKPSAVAKGRAAVVTCFSGPSLSVGREDQEGVAVVVGRRALASAAAVASVLGFAGRGLAANQGLLAGRVPGLSEPDENDRLENIPQARRQVRWPRSWLEPHHPVQLQSSRRLG

SEQ ID NO: 46219 - DNA, 713 bp, Zea mays
  misc_feature: Ceres CLONE 1451501-F
  misc_feature: Encodes the peptide sequence at SEQ ID NO. 46220
aagctggagctccccgcggtggcggccgctctagaactagtggatcccccgggctgcaggaattcgcacgagaccattacctagaacatcctaatcgaaaattgtctcgtccatgagctgagctgcgcccgttttagcgagcgagataggtccgcgcgcgtgggccggccaggattggattggaaccgtcgcccgtcggtcgaccatggggatccacctggtggcgttcgtggcggcgaggggcttcctgcacgtgttccaggtgtcggcgccactgctgtggccgctcaacctctggctgccgctcgcgcgccacctgcccgaggcctgtgccgccttctacgacgccctcgtctcacacgccgacagcctgcgcgccaccgtccggctcctccgacacgacattggggacgccctcgacgagtacctccgcagcgccatcatgctaaccctctccgactgagactcttgagccgagcgcgcggtcactggccactgccaggcaacggtcactaccggatggtgacgtgcacacgccgatcggccggcgcacgctgtgatgtgactaatcatacctaggatctgagatatcgcgtttgcttgtctgttctttccgtggctcgctcttcttttgctgcttttcggtcggtgcttaatctagctatctactactagcactagctagctagcatctcaagactgagcattgtgga

SEQ ID NO: 46220 - protein, 85 aa, Zea mays
  misc_feature: Ceres CLONE 1451501-F
MGIHLVAFVAARGFLHVFQVSAPLLWPLNLWLPLARHLPEACAAFYDALVSHADSLRATVRLLRHDIGDALDEYLRSAIMLTLSD

SEQ ID NO: 46221 - DNA, 766 bp, Zea mays
  misc_feature: Ceres CLONE 1451502-F
  misc_feature: Encodes the peptide sequence at SEQ ID NO. 46222
  misc_feature (704)..(704): n is a, c, t, g, unknown, or other
  misc_feature (714)..(714): n is a, c, t, g, unknown, or other
ctggagctccccgcggtggcggccgctctagaactagtggatcccccgggctgcaggaattcgcacgagaccattacctggaacatcctaatcgaaaaattccatcctagggctcgcgtcccccaaagtgaatacagaaacctccagctccaggccaattcctcgaccgcatcgccacccatcccatatccatggccacctccgccctcgccgctctgtccgccaccgcggccgccgccggtaagcgcatcctcctgtcgcgccccgtctcctcctcctccctctccttcgcctcccgccgcctggccgccggggcacccctccgggggttccttggcgcgccaatccgggccgtggcgtcgtcggcgtcggcgccccccgcggcggcggccaagaccatcgcggtcggggaccagctccccgacgcgatgctctcctacttcgacacctcctcccccgacggcgagctgaagacggtgacggtccgcgacctcaccgcggggaagaaggtggtgctcttcgccgtgcccggcgcgttcacgcccacctgcacccagaagcacctccccggggtcgtggccaaggccggggagctccgcgccaagggcgtcgacgccgtggcctgcgtctccgtcaacgacgccttcgtgatgcgcgcgtggaaagagagtctggggatcgggaacgaagtgctgctcctgtcngaacgcaacngcgagctggcgcgcgccatgggcgtcgagctcgacctctccgaacagcccgt

SEQ ID NO: 46222 - protein, 191 aa, Zea mays
  misc_feature: Ceres CLONE 1451502-F
  misc_feature (71)..(191): Pfam Name: Redoxin Pfam Description: Redoxin
  misc_feature: SWISSPROT Homolog: EC 1.11.1.15 Peroxiredoxin
  misc_feature (175)..(175): Xaa is any aa, unknown, or other
MATSALAALSATAAAAGKRILLSRPVSSSSLSFASRRLAAGAPLRGFLGAPIRAVASSASAPPAAAAKTIAVGDQLPDAMLSYFDTSSPDGELKTVTVRDLTAGKKVVLFAVPGAFTPTCTQKHLPGVVAKAGELRAKGVDAVACVSVNDAFVMRAWKESLGIGNEVLLLSERNXELARAMGVELDLSEQP

SEQ ID NO: 46223 - DNA, 722 bp, Zea mays
  misc_feature: Ceres CLONE 1451511-F
  misc_feature: Pfam Name: HEAT Pfam Description: HEAT repeat
ggagctccccgcggtggcggccgctctataactagtggatcccccgggctgcaggaattcgcacgagaccattacctagaacatcctaatcgaaaattggtgcagagatcacttgtcaaaagctgcttccagtcgtcattaattcttcaaaggacagggttcctaacatcaagttcaacgttgcaaaagtactaaagtcacttgtaccgatcctcgatcaatctgacgtggagaagaccgtgaaaccatgccttgttgagctcagagaggaccctgacgtccatgagaggtactacgccaaccaagcactgcaggcgtgcgatcaaaagatggtgtcaagctaactagacgtgtgcctaagaaattagacttcgatgcctcatacaccaattttggattacgagtaccttgttgggccttttagaatgaagagttttccgtctagcctcggtgaacagatcgacactgcccatgctgaaaaatggactgtcctgagccattgtccgctgagatcttaatggagtatacttgagcaagaccctacacggacgtaacaaaaaaaaaaaaaaaggttatcgatagcgatcaacctcgagggggggcccgggacccaattcaccctatactgagtcctattacgagaagctaacttgacccgtcgatataccaccgtccatgagtggaaaaaacccttgtcgttccccaaacttaaatcggcatgc

SEQ ID NO: 46224 - DNA, 977 bp, Zea mays
  misc_feature: Ceres CLONE 1451516-F
  misc_feature: Encodes the peptide sequence at SEQ ID NO. 46225
  misc_feature (13)..(13): n is a, c, t, g, unknown, or other
  misc_feature (28)..(28): n is a, c, t, g, unknown, or other
  misc_feature (463)..(463): n is a, c, t, g, unknown, or other
  misc_feature (467)..(467): n is a, c, t, g, unknown, or other
accacctttacancgccgatcatccaanaaaaaaacccataactggagctccccgcggtggcggccgctctagaactagtggatcccccgggctgcaggaattcgcacgagaccattacctagaacatcctaatcgaaaaaggcggcgaacgctatgggcaacgccgggagtgcgccggaccagcccaagaactcggcggatggggccggcgctgccgacgcggagtctcgccgcgggccgccgtctacggtgcgtttcttccccgatggggagcgccacaaggcacggcagccgccgccaataaagctcgaggaggaggagggcgtcccgccgccgcccgccaccgaggaggagatggccccgcgcaacctctgggaaggtgtatgccgcttgggggcgttcattgtgtttgacccccccctcttgcttacaagaaaggagaaccagtgaatgaattggggnccanccccaacctgggaaaggggaattggccccgaacagaaaccaacttaaatccaccgattacccgcatagatggaaaatacgagtttccccccgaaaaaaggaatgcgccccttctccccgtgaaatccccgcgcgataggaaggggtactctctcttcggtcttaaaggcccccctgtaaaattggggcctattactgaatcttagctgcgagaattagtattgtttctcccctataaatatgaaagagagagtatagatatcgcccctactttattcaccacgtgaggggcagcgtctcttctacgcatggtggagcgtgccgcactgtgttggtgtgttgtgctcggcttagttgaagtgagctcctccgcgatcagcttcataccatcagcagcatatctcaactgctggtgatcttgtttttcttggtcacctatacaaatataacaagaatatttatttaccgcgcgcctcgactctctgtagcggtggcctccaccctactctcc

SEQ ID NO: 46225 - protein, 98 aa, Zea mays
  misc_feature: Ceres CLONE 1451516-F
MGNAGSAPDQPKNSADGAGAADAESRRGPPSTVRFFPDGERHKARQPPPIKLEEEEGVPPPPATEEEMAPRNLWEGVCRLGAFIVFDPPLLLTRKENQ

SEQ ID NO: 46226 - DNA, 913 bp, Zea mays
  misc_feature: Ceres CLONE 1451519-F
  misc_feature: Encodes the peptide sequence at SEQ ID NO. 46227
  misc_feature (15)..(15): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (314)..(314): n is a, c, t, g, unknown, or other
  misc_feature (428)..(428): n is a, c, t, g, unknown, or other
  misc_feature (469)..(469): n is a, c, t, g, unknown, or other
  misc_feature (470)..(470): n is a, c, t, g, unknown, or other
  misc_feature (475)..(475): n is a, c, t, g, unknown, or other
  misc_feature (490)..(490): n is a, c, t, g, unknown, or other
  misc_feature (492)..(492): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (507)..(507): n is a, c, t, g, unknown, or other
aaataatgtaacccnccccacaaacaaaaaaaannnnnnnnnnccatactggaactccccgcggtggctgccgctctagaactagtggatcccccgggctgcaggaattcgcacgagaccattacctacaacatcctaaccaaaaaagaaaaaaaacgtgctgctcttcccgtcatcttcccaatgcggcagtcacgctctcctacttcctcctgcctctcctcctcgccaccggcgtcaccacggcgtcagcggagccagcgacccctcccgcctctcctcctcctcctcctcctccaccagcatgtgggcgnttatccacactaaacacaaaccaacaccaaaaacccaccaaaggctacccatcacacaaaacaacactcactcaatccatcaacggaggtgttatctgtttgtttggtgttganaaaaaagtgttatatagtggaagaataaaaaaatgtagtcnncccantcttataaaaaaaananannnataaaaattanaaaaaagtgtgttctaattctacaaacaaacccctaacaacttttgatattactgagttataggcggatagataccttactataaacactccatatatagttaattgtataatgaattgttatattattatgctccacctccattcttaaatatgcactactcaggcgataaactgtatcttagagtgatataggagagttacataacgcaataatcttgatgtatctcttccagcccgctcagcgcgatatagctgaatcagactatatcgcgcgtctttcccagatttccacaagatttaattgaatctataaacattaacctgtaaatagaggtaataccttcaaatacgcttaatagccatacctaaatgggtattgctcttcatttatcactgcaccccga

SEQ ID NO: 46227 - protein, 40 aa, Zea mays
  misc_feature: Ceres CLONE 1451519-F
  misc_feature (4)..(4): Xaa is any aa, unknown, or other
MWAXIHTKHKPTPKTHQRLPITQNNTHSIHQRRCYLFVWC

SEQ ID NO: 46228 - DNA, 961 bp, Zea mays
  misc_feature: Ceres CLONE 1451521-F
  misc_feature (28)..(28): n is a, c, t, g, unknown, or other
  misc_feature (29)..(29): n is a, c, t, g, unknown, or other
ccccccataatattcataaaaaaaaacnnccccccaccataaaaactggagctccccgcggtggcggccgctctatactagtggatcccccgggctgcaggagttcgcacgagaccattacctagaacatcctaatcgaaaaacaagaacactcctatctgacgatctcgagtgcaacgcaacgttggcgcttggcggccagtaacaacagcaaacttagcgtctctccttcctactagacgagagatcgagaaaccatggccaagctccaagtcagtcctggcgccgcgttcaccgagtgcaatgaactcaatttccagggcctggacatgtaccatcacgcccctgggttccaagggcaaccaagattcgatcgctagagagcacggccaaagtcgggatgtttgtgtctatgtaaccccccacctggggcaggggcttgacctggggctgggataagggtgccccccccccacccacacattgaccggctggattaggaagtgacccgcccccagtaagaacgggccctgcacccatttcaaactcctgattttgttcgtaacgtattatcttagggtgttcagtgggtatgcccagagtcgtccgtaagtgtgaggggagctatctactggagttttacacccgtgtttacatcgcggcactgattttctgagttcacccatatgcgagagtgaggctgtgcgcaaggatggctgggaggcttgttcctcacacagaccttctggtttataacactacaccccctcatcgtcgctatgttgcttgtgttgcactgagatgaacagctgtgttctatgtggcctaatatgcacacccctctctctctatagtggtgtatctccgacttctctctcgagccaggtatggcgcctgggggcgcccatggtctccgccatagccctgtgtgattctagaatcgggccgacgttctaagatg

SEQ ID NO: 46229 - DNA, 729 bp, Zea mays
  misc_feature: Ceres CLONE 1451522-F
  misc_feature: Encodes the peptide sequence at SEQ ID NO. 46230
  misc_feature (371)..(371): n is a, c, t, g, unknown, or other
  misc_feature (417)..(417): n is a, c, t, g, unknown, or other
  misc_feature (466)..(466): n is a, c, t, g, unknown, or other
aagctggagctccccgcggtggcggccgctctagaactagtggatcccccgggctgcaggaattcgcacgagaccattacctagaacatcctaatcgaaaactctgatcctctccgccatttctgtgcgcatctggagctgttgttctaaacccccaaaccctccgtcctaacctctgcgccaccggcgtcaccaccgccggagccgcagccatgaacgccttcaggttcctcggggacatgacccacctcttctcggtcctcgtcctcctcctcaagatctacgccaccaagtcctgctcaggggtgtcgaggaagacgcaggagctgtacatgttggtgttcgtggcgagttacctggacctcttcacnggatatgtctcgctctacaaactcgtgatgaaggtgggtgtcatcnacagctcggcggccatcgtgtggtgcatgcgccgccacccgcaggtacnaagaacgtacgaaaaggagcaggacacttccgtaaaacgtggttcgtcgccgccgcattcctggtcggcttgattcccccaaccgttccccttccccgaaaattgtgggaattttaaaccatttggagggcctggctttcccccccaaattaggtttcccccaaaaacacaaaaggggaaaaaattaagggggaaatatttttttccctccggggcccaacccggggttttatttttaaaaggggattttttttttttttccc

SEQ ID NO: 46230 - protein, 108 aa, Zea mays
  misc_feature: Ceres CLONE 1451522-F
  misc_feature (1)..(106): Pfam Name: ER_lumen_recept Pfam Description: ER lumen protein retaining receptor
  misc_feature (69)..(69): Xaa is any aa, unknown, or other
  misc_feature (85)..(85): Xaa is any aa, unknown, or other
MNAFRFLGDMTHLFSVLVLLLKIYATKSCSGVSRKTQELYMLVFVASYLDLFTGYVSLYKLVMKVGVIXSSAAIVWCMRRHPQVXRTYEKEQDTSVKRGSSPPHSWSA

SEQ ID NO: 46231 - DNA, 736 bp, Zea mays
  misc_feature: Ceres CLONE 1451523-F
  misc_feature: Encodes the peptide sequence at SEQ ID NO. 46232
  misc_feature (346)..(346): n is a, c, t, g, unknown, or other
  misc_feature (359)..(359): n is a, c, t, g, unknown, or other
  misc_feature (381)..(381): n is a, c, t, g, unknown, or other
  misc_feature (406)..(406): n is a, c, t, g, unknown, or other
  misc_feature (407)..(407): n is a, c, t, g, unknown, or other
aagctggagctccccgcggtggcggccgctctagaactagtggatcccccgggctgcaggaattcgcacgagaccattacctagaacatcctaatcgaaaaatccagtctccgtgtccagtcgagtctcagcaaggaagatgtgggggagaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggncagactctccccnaccgcaaaggtatatcactccnattagatcagtggaagaatatgaannggacacatcaagccataaatgaggccatcgaggaaaatacttgatggggagccgccaagcagtcccgtgacgggggagcttttgctccctcccttgttgaaggctgatgaccgaaaatattttttgttgccaatagcggcccggtggcttttgccatttaaccccctgttttttaaggggcccccgtgcccaaagggtttggttttcccccccgggtaaagaaaattaaaagcggggagggggagagacactttcccctttttttttggcccaaaaaccttttgtggggttggaaaacaaatatttgtgaaaaaaggaccctgtttttt

SEQ ID NO: 46232 - protein, 103 aa, Zea mays
  misc_feature: Ceres CLONE 1451523-F
  misc_feature (10)..(99): Pfam Name: PC4 Pfam Description: Transcriptional Coactivator p15 (PC4)
  misc_feature (74)..(74): Xaa is any aa, unknown, or other
  misc_feature (81)..(81): Xaa is any aa, unknown, or other
  misc_feature (89)..(89): Xaa is any aa, unknown, or other
  misc_feature (90)..(90): Xaa is any aa, unknown, or other
MWGRGKKRFGGGGSGEPAAKRQAARDDGPSESAEDGTVVAEISKNKKVSVRSWKGRVFVDLREFYFKDGQTLPXRKGISLXLDQWKNMXXTHQAINEAIEENT

SEQ ID NO: 46233 - DNA, 828 bp, Zea mays
  misc_feature: Ceres CLONE 1451526-F
  misc_feature: Encodes the peptide sequence at SEQ ID NO. 46234
  misc_feature (18)..(18): n is a, c, t, g, unknown, or other
  misc_feature (20)..(20): n is a, c, t, g, unknown, or other
  misc_feature (22)..(22): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (40)..(40): n is a, c, t, g, unknown, or other
  misc_feature (125)..(125): n is a, c, t, g, unknown, or other
  misc_feature (528)..(528): n is a, c, t, g, unknown, or other
cttttcttctcaactagngncncccnnnnncccacccccnacatactggagctccccgcggtggcggccgctctagattcctggatcccccgggctgcaggaattttcacgagaccattacctanaacatcctaatcgaaaagggcgactgggcgtagggcgagctgagctcccaagtcgacgtggcggggatggctgcgacggccggcgtcggcggtggtggaggggctaacgcggcggtggcagagcagatagcacaggcagtgcggtccacctccaatctcctccagctcatggagcagtcctcccccgctcaggttcacttggcaaaactacccaagaacctgttggaaaaagcatcctttgcaaagaacacggagcatgtactgcaccagctacctcaagtaatttcatccttggacccccacatggacaggagtttgcaaagtgcatctcaaattaacacccccaccacctcttgtcaaacatggagaagacacagctgaagtccatgttgccttcctctcnaaggaaggaagatcagaagagtactgaacccttaagaactcagggttgattgacgtcaccgagacatagtggaaggataagcttttgccgccttatgcttgagagatctgagtatgatggtttggctgattggctctatgcatcctaccggcataaggattcttcgctgcctacccgtttgcgcccccactttaaaattttggctcgcggaatgccggtaatggtgtaaagggagccgttttcttaacgaattgggatgctgctacacagtcacaaccatggtccgtttatataaaaaaa

SEQ ID NO: 46234 - protein, 104 aa, Zea mays
  misc_feature: Ceres CLONE 1451526-F
MAATAGVGGGGGANAAVAEQIAQAVRSTSNLLQLMEQSSPAQVHLAKLPKNLLEKASFAKNTEHVLHQLPQVISSLDPHMDRSLQSASQINTPTTSCQTWRRHS

SEQ ID NO: 46235 - DNA, 720 bp, Zea mays
  misc_feature: Ceres CLONE 1451531-F
  misc_feature: Encodes the peptide sequence at SEQ ID NO. 46236
aagctggagctccccgcggtggcggccgctctagaactagtggatcccccgggctgcaggaattcgcacgagaccattacctagaacatcctaatcgaaaaagtgaagctagccatcagtacacgaacacgctcatcagggtcaggccacagacaccatggtgaagctggccacggcgcgcgagtgccgcgcatacagcctcggcgccggcgcggggaccggcacggcgttgcgcaaccggagggagtacatcaacgccggggtgaacatcttcgcggcggtccaccaggtcggcgggttcctcgcgcacctcctgccgtggggcgggcccaccagcccggggctcgtggtctccgcgatcgggctcgccggcttgctggccgtcaacacgcacgacctcctcacgcacgccgctggcgtccattaccgcctcgggatggtggtcgggcttgacgcgcagatggggctcgtcgagctcggcgtccccgccgtgcagatcgtcagcaccgtgctcatgctcgtcgctgtcgtcttctttgtgattcagatggagagaggctaccggcacagcctagccatgcacggcctgaacctgctcatagccgggccggcactgtggtgcctggggactgtgaaaaacatctgccagttctacgagcgtgcgagcgggcacgtccagctcctgcaaagagcgtgcacatcccgctgctgcatgagagc

SEQ ID NO: 46236 - protein, 187 aa, Zea mays
  misc_feature: Ceres CLONE 1451531-F
MVKLATARECRAYSLGAGAGTGTALRNRREYINAGVNIFAAVHQVGGFLAHLLPWGGPTSPGLVVSAIGLAGLLAVNTHDLLTHAAGVHYRLGMVVGLDAQMGLVELGVPAVQIVSTVLMLVAVVFFVIQMERGYRHSLAMHGLNLLIAGPALWCLGTVKNICQFYERASGHVQLLQRACTSRCCMR

SEQ ID NO: 46237 - DNA, 723 bp, Zea mays
  misc_feature: Ceres CLONE 1451540-F
  misc_feature: Encodes the peptide sequence at SEQ ID NO. 46238
  misc_feature (630)..(630): n is a, c, t, g, unknown, or other
  misc_feature (723)..(723): n is a, c, t, g, unknown, or other
acccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactacggncgcgcgctcgcgctccccggggtctgccgcgtcgccaccccgccccgtctcacctgcacagcgctcgggtatcacgtccgcgtgggcccagcn

SEQ ID NO: 46238 - protein, 149 aa, Zea mays
  misc_feature: Ceres CLONE 1451540-F
  misc_feature (58)..(137): Pfam Name: Tryp_alpha_amyl Pfam Description: Protease inhibitor/seed storage/LTP family
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADSYGIAVDYGRALALPGVCRVATPPRLTCTALGYHVRVGPA

SEQ ID NO: 46239 - DNA, 827 bp, Zea mays
  misc_feature: Ceres CLONE 1451551-F
  misc_feature: Encodes the peptide sequence at SEQ ID NO. 46240
  misc_feature (333)..(333): n is a, c, t, g, unknown, or other
  misc_feature (363)..(363): n is a, c, t, g, unknown, or other
  misc_feature (375)..(375): n is a, c, t, g, unknown, or other
  misc_feature (392)..(392): n is a, c, t, g, unknown, or other
  misc_feature (411)..(411): n is a, c, t, g, unknown, or other
  misc_feature (484)..(484): n is a, c, t, g, unknown, or other
ggagctccccgcggtggcggccgctctagaactagtggatcccccgggctgcaggaattcgcacgagaccattacctagaacatcctaatcgaaaaatccccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaagatgactgcgccgacnacggcatccctcttcctaacgttaactccnagatcctatccnagggtatcgagtactgncacaagcacgtacatgccngcgccccgcgcgtcgccgcctcgaaaggccgggtccgaacgacgtgggtgccggcctcggccaacaggaccgncggcctccggggaggacctcaagaaactggaatgcggaacttcgtcaagggccaaccaagcccagctttttcaacctcactttggctggaaaattactgaaaactaaggggtctcgctccacctgaaccgtgaaaagggttgttgaacttgtccagggggaaaaaccccaaaaaaaatccccaagacctcccaccccaaaagaaagccccccccccggaagaagaaaaaaaaaccccccgggagaaacacggggggcctccaaaagaaagaggggggggttttttttggcccaaattttggggggggacacaaacataaaccttatttttggcgcgggagggt

SEQ ID NO: 46240 - protein, 126 aa, Zea mays
  misc_feature: Ceres CLONE 1451551-F
  misc_feature (8)..(68): Pfam Name: Skp1_POZ Pfam Description: Skp1 family, tetramerisation domain
  misc_feature (44)..(44): Xaa is any aa, unknown, or other
  misc_feature (54)..(54): Xaa is any aa, unknown, or other
  misc_feature (58)..(58): Xaa is any aa, unknown, or other
  misc_feature (63)..(63): Xaa is any aa, unknown, or other
  misc_feature (70)..(70): Xaa is any aa, unknown, or other
  misc_feature (94)..(94): Xaa is any aa, unknown, or other
MAAEGEKKMITLKSSDGEEFEVEEAVAMESQTIRHMIEDDCADXGIPLPNVNSXILSXGIEYXHKHVHAXAPRVAASKGRVRTTWVPASANRTXGLRGGPQETGMRNFVKGQPSPAFSTSLWLENY

SEQ ID NO: 46241 - DNA, 746 bp, Zea mays
  misc_feature: Ceres CLONE 1451553-F
  misc_feature: Translation starting site: 153
  misc_feature: Pfam Name: BAP Pfam Description: Basal layer antifungal peptide (BAP)
  misc_feature: SWISSPROT Homolog: EC 3.2.1.23 Beta-galactosidase
aagctggagctccccgcggtggcggccgctctataactagtggatcccccgggctgcaggaattcgcacgagaccattacctagaacatcctaatcgaaaaatcaacacatttttggtattagactattgtagctcatatcatctgtcacccatggcgaagtgcagcagcttccaaggattattctggttgctttccatgattcttctagcatcctttgttgctcatgcacgcacaagtgggcaaaccaaagaggacagcaatgctaggaacatgacgatgaccaagacgagggcatcgggcaacatacttgttagccgtaatgacgacgggccatgctatctagattccggtcttaatgagtacgtctgcagaaagactaataagtgctataagagcttggtgctctgcgaccccaccccccaaccatcatcatgaattcatgatactgcggagacatcatgatactgcggagacagacggcgagagatgaggctagctagatgctgtttcaccaaaatattatgtaacacccaaatctcccattttaagaaataaataagattttcgaaaaaaaaaaaaaaaaaagcttatcgataccgtcgacctcgagggggggcccggtacccaattcgccctatagtgagtcgtattacgcgcgctcactggccgtcgttttcaacgtcgtgactgggaaaaccctggcgttacccaacttaatcgccttgcagcacattccccctttcg

SEQ ID NO: 46242 - DNA, 725 bp, Zea mays
  misc_feature: Ceres CLONE 1451554-F
  misc_feature: Encodes the peptide sequence at SEQ ID NO. 46243
aaagctggagctccccgcggtggcggccgctctagaactagtggatcccccgggctgcaggaattcgcacgagaccattacctagaacatcctaatcgaaaaaatgtcaacgacgacggaggcggcacagagcggctcagccgcaccggtgcggtgccagcggatcggctgcgacgccatattcaccaacgatgacaaccgcgagggctcctgccaataccacccctccgcacctatgtttcatgacggcatgaaagaatggagctgctgcaagcaaagaagccatcatttcagcttatttttgcagatgcctggatgcacaacatgaaagaatgccaccgaaaaaccattcgtcgaagctgtttcatttaacctaacaaaggtaacaccgatccagtaatctccgcacccccccggaatgatgggtgtagaaggtgaccccaaggcttcatttgctcccatcatggatctccctccaaggtccagaacccgggtgtccccgcgatacaacgatggaacctggtcacgaataccccggctccgccgccaaaaaaaagggatgacttatcggagcggaggcattggcaaaccaaggggggggggaaatccttaccggaaaagggaaaaccggggttcccccggggcacccccttttaagggctcccgctttttcaaaataaaaaaaaacagggtggaaaaagccggtttctccccaacaaacagaa

SEQ ID NO: 46243 - protein, 74 aa, Zea mays
  misc_feature: Ceres CLONE 1451554-F
  misc_feature (14)..(74): Pfam Name: CHORD Pfam Description: CHORD
MSTTTEAAQSGSAAPVRCQRIGCDAIFTNDDNREGSCQYHPSAPMFHDGMKEWSCCKQRSHHFSLFLQMPGCTT

SEQ ID NO: 46244 - DNA, 741 bp, Zea mays
  misc_feature: Ceres CLONE 1451556-F
  misc_feature: Encodes the peptide sequence at SEQ ID NO. 46245
  misc_feature (405)..(405): n is a, c, t, g, unknown, or other
  misc_feature (433)..(433): n is a, c, t, g, unknown, or other
  misc_feature (445)..(445): n is a, c, t, g, unknown, or other
ggagctccccgcggtggcggccgctctagaactagtggatcccccgggctgcaggaattcgcacgagaccattacctagaacatcctaatcgaaaaaaaaaaaaaaaacggcgcgcgcactcccgcgacaaaaaaaaaggaagtggcggaagagaagcaagaaataaaaaaaaagaagcgagtggagaccgcagcacacccgggcggcgtctggggatgacgcgcgcccgccgccaatggccgcaccgacgcagacgctagtgctggcggggatcatcctcctcaacttcgtcctcgccgcggcagcgctctaccgccgcatccgcggccgccgcaggccccggcagcacgtcccgccgccgccgccgctcgagccggccgccgcggaggaggcggagctttaangcgaaggatgaggaaggaggctgttggngaaaagcggcanaatccattcggaggatgaggaaagcgcgaagaaagcgtaatcaacaaggaagaggtggcggcttccaaaggggggtggagctgactgccggaaggggacccacgctaaagggaaggttaaaatgaaattgatgccctctttgccaaaataaccacttacccccgggagtttccgggcctaagcccaaaatcccccccccttcactaaaaccatcctggggggcgtcaaggtccgaagcccctcctagaacaagaaagaaaaatttttagagggttgtgggaaaaaatataacaacc

SEQ ID NO: 46245 - protein, 55 aa, Zea mays
  misc_feature: Ceres CLONE 1451556-F
MAAPTQTLVLAGIILLNFVLAAAALYRRIRGRRRPRQHVPPPPPLEPAAAEEAEL

SEQ ID NO: 46246 - DNA, 752 bp, Zea mays
  misc_feature: Ceres CLONE 1451559-F
  misc_feature: Encodes the peptide sequence at SEQ ID NO. 46247
atagctggagctccccgcggtggcggccgctctagaactagtggatcccccgggctgcaggaattcgcacgagaccattacctagaacatcctaatcgaaaaaggctgtacgtagggccgtgccgtcgcccctccttccttcgtcgatctctctctcggcgacgactgggcgaccgctgcctcctgttgccctggtctccattgggccctttgccagattttctttcgcctctccgccggcgacgaacaccaccaccaggaatgggcttgtggacgttgctggagggttttttgcttcttgcaaatgcgttggctatattgaatgaagaccgctttctcgctccaaggggatggagcatgtctgaagtatcaggaaatgggcaaacgaagtcgttgaagggccagatcgtgccccccccccatgctacacaatttctgaggatgcccttaatagcactcaatgttctgatcattgttgtgaaactggtgtctggctgaagctcattatctagttttcactgttgtgttggattgatatctgttccagcatgatgtaaaagttagtaatactcaaagctgctggaaatatgttcattttttactctaatgtgaatttctgttatttcttctggtaaattaattctgggcagaagatggttctaatcatttatactattcaaggcattgtgcaatggtgttaacaatttattccaaaatattcctatgtagtttgtgaggacaataaaaaaaaa

SEQ ID NO: 46247 - protein, 78 aa, Zea mays
  misc_feature: Ceres CLONE 1451559-F
  misc_feature (3)..(78): Pfam Name: Yos1 Pfam Description: Yos1-like
MGLWTLLEGFLLLANALAILNEDRFLAPRGWSMSEVSGNGQTKSLKGQIVPPPHATQFLRMPLIALNVLIIVVKLVSG

SEQ ID NO: 46248 - DNA, 942 bp, Zea mays
  misc_feature: Ceres CLONE 1451571-F
  misc_feature: Encodes the peptide sequence at SEQ ID NO. 46249
  misc_feature (1)..(1): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (63)..(63): n is a, c, t, g, unknown, or other
  misc_feature (140)..(140): n is a, c, t, g, unknown, or other
  misc_feature (212)..(212): n is a, c, t, g, unknown, or other
  misc_feature (311)..(311): n is a, c, t, g, unknown, or other
  misc_feature (314)..(314): n is a, c, t, g, unknown, or other
  misc_feature (317)..(317): n is a, c, t, g, unknown, or other
  misc_feature (429)..(429): n is a, c, t, g, unknown, or other
  misc_feature (511)..(511): n is a, c, t, g, unknown, or other
  misc_feature (523)..(523): n is a, c, t, g, unknown, or other
  misc_feature (524)..(524): n is a, c, t, g, unknown, or other
  misc_feature (559)..(559): n is a, c, t, g, unknown, or other
  misc_feature (569)..(569): n is a, c, t, g, unknown, or other
  misc_feature (570)..(570): n is a, c, t, g, unknown, or other
  misc_feature (651)..(651): n is a, c, t, g, unknown, or other
  misc_feature (707)..(707): n is a, c, t, g, unknown, or other
  misc_feature (722)..(722): n is a, c, t, g, unknown, or other
  misc_feature (723)..(723): n is a, c, t, g, unknown, or other
  misc_feature (861)..(861): n is a, c, t, g, unknown, or other
ncatttttaaaaaaaaaaaaccccccnnnnaaacaannnaaaaaaactgagactcaccaccgnggcggccgctctaaattctaaaaatcccccgcgctgcaagaattcgcacaagaccattacctacaacatcctaaacnaaaaaaaaagcacactgcaccaccaacctttcctggcttcatctcctcctttcctccccaaaaacacaaaanggggaagacagagagaggacaggcagagagaagagggggaggcagtccagtgtccacgcaggtacgctccacaaaagagagatggcgatgcggatggcngcngcngcagagccactggtggcagagatgagcgtgctgggccccccaaacggccgcacaaaaccccaaactgcccagaaaaacttaaccccgtgcttgtcttttatttaacacaacngccaaccccgctcggaatattttttgtgtttttttacccccccctccccccaaaaaataaaattaaaaggataaagggaaanataaagaaaaannaaaaaaaaaataaaagggttttaaaaaaataaaanaaaaaaaaannaaataagagaatttttaaaaatatttttgagttttaataaaaaaataaaaaaatgtgtatataatataagggatttttttntataaaaaaaaaaaattttttaaatatattaggagaagtatatatgaggagagaanagagaaaataaatannaaaaaaagaattatattatagataagtatttttatatttgataaagattaaaaaaagtataagataaatatattatttgaaattattaaattggttgattaaaaatataaatagtatttaatattttaaagataatanaataaattaagtagattgttgttgatttaagatagataataaataattatattattgtttatataattatatattatattg

SEQ ID NO: 46249 - protein, 42 aa, Zea mays
  misc_feature: Ceres CLONE 1451571-F
MAMRMAAAAEPLVAEMSVLGPPNGRTKPQTAQKNLTPCLSFI

SEQ ID NO: 46250 - DNA, 735 bp, Zea mays
  misc_feature: Ceres CLONE 1451572-F
  misc_feature: Encodes the peptide sequence at SEQ ID NO. 46251
  misc_feature (369)..(369): n is a, c, t, g, unknown, or other
  misc_feature (374)..(374): n is a, c, t, g, unknown, or other
ctggagctccccgcggtggcggccgctctagaactagtggatcccccgggctgcaggaattcgcacgagaccattacctagaacatcctaatcgaaaactgaagtttcggcggcggcgtaggtagcggcggtgtgcttgtgatctcaatctcaaccccaggcgagctcggctccggtcacccgtcgatccacgcaaccatgtcgaggaggaagaccagggagcccaaggaggagaacgttacccttggacccactgtccgtgaaggagagtttgtctttggtgttgctcacatctttgcatccttcaatgacaccttcattcatgtcactgatttgtctgggagggaaactttggttcggatcactggngacangaaggttaaggctgatcgtgatgagtcgtctcccccaccccctatgcttgctgcccaagatgttgcacagcgttgcaaggagctcggtatcacagcgctgcacattaagcttcgtgccactggaggcaacaagaccaagacccctggacctggtgctcagtctgctctcaaggctcttgctcgttctgggatgaaaattggacgcattgaggatgttacccccgttcccactgacagcactcccaaaaagggtggtatgaggggaaggagcctgtaagcgtgtatccttgctatttgccatcactttgcactggtctctggagaattcttgctattattagcctggccaaagggactttta

SEQ ID NO: 46251 - protein, 150 aa, Zea mays
  misc_feature: Ceres CLONE 1451572-F
  misc_feature (28)..(146): Pfam Name: Ribosomal_S11 Pfam Description: Ribosomal protein S11
  misc_feature (59)..(59): Xaa is any aa, unknown, or other
MSRRKTREPKEENVTLGPTVREGEFVFGVAHIFASFNDTFIHVTDLSGRETLVRITGDXKVKADRDESSPPPPMLAAQDVAQRCKELGITALHIKLRATGGNKTKTPGPGAQSALKALARSGMKIGRIEDVTPVPTDSTPKKGGMRGRSL

SEQ ID NO: 46252 - DNA, 762 bp, Zea mays
  misc_feature: Ceres CLONE 1451574-F
  misc_feature: Encodes the peptide sequence at SEQ ID NO. 46253
  misc_feature (379)..(379): n is a, c, t, g, unknown, or other
  misc_feature (665)..(665): n is a, c, t, g, unknown, or other
aaagctggagctccccgcggtggcggccgctctagaactagtggatcccccgggctgcaggaattcgcacgagaccattacctagaacatcctaatcgaaaaatgctgtgtcatggatgagcgaggggatccggtacaagaagaatgaagtcttcttggatgtagtggagagtgttaacattctagttaacagcaatggccacattgtgagatcagatgtggttggggcactgaagatgcgaacatatttgagtggaatgccggagtgcaaacttggcttgaatgatagggttcttttggaggctcaaggcacagcaactaaaggcaaagcgatagacctctatgatatcaaatttcatcagtgtgtacgttcggctanatttcagaatcacccaactatatcgttgagtgctggtgagtggatcttttgatctaacgacatacacgcttaccactcacgtaaaacctcttatctgggtcgaagcacatatgagaaacattctagaagccgtatagaactcatgctgaacgcaaggagtcagtttagagaaagaagcacatccacgaatgttggaattgaagtgcctgttccttcagatgccacgcagcacaatatacgaacttcatggggtctgctgcatatgctcctgagagagatgcaatgntttggaaaataacatcattcccctggtgcaacggatacatgtgcatagcaaaaattaatcttactagcctaacaacggaagaagtgccccacaaaaa

SEQ ID NO: 46253 - protein, 104 aa, Zea mays
  misc_feature: Ceres CLONE 1451574-F
  misc_feature (1)..(105): Pfam Name: Adap_comp_sub Pfam Description: Adaptor complexes medium subunit family
  misc_feature (88)..(88): Xaa is any aa, unknown, or other
MSEGIRYKKNEVFLDVVESVNILVNSNGHIVRSDVVGALKMRTYLSGMPECKLGLNDRVLLEAQGTATKGKAIDLYDIKFHQCVRSAXFQNHPTISLSAGEWIF

SEQ ID NO: 46254 - DNA, 787 bp, Zea mays
  misc_feature: Ceres CLONE 1451582-F
  misc_feature (332)..(332): n is a, c, t, g, unknown, or other
  misc_feature (377)..(377): n is a, c, t, g, unknown, or other
  misc_feature (379)..(379): n is a, c, t, g, unknown, or other
  misc_feature (380)..(380): n is a, c, t, g, unknown, or other
  misc_feature (425)..(425): n is a, c, t, g, unknown, or other
  misc_feature (427)..(427): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (440)..(440): n is a, c, t, g, unknown, or other
  misc_feature (451)..(451): n is a, c, t, g, unknown, or other
  misc_feature (467)..(467): n is a, c, t, g, unknown, or other
  misc_feature (472)..(472): n is a, c, t, g, unknown, or other
  misc_feature (482)..(482): n is a, c, t, g, unknown, or other
  misc_feature (483)..(483): n is a, c, t, g, unknown, or other
  misc_feature (506)..(506): n is a, c, t, g, unknown, or other
  misc_feature (543)..(543): n is a, c, t, g, unknown, or other
  misc_feature (570)..(570): n is a, c, t, g, unknown, or other
  misc_feature (571)..(571): n is a, c, t, g, unknown, or other
  misc_feature (573)..(573): n is a, c, t, g, unknown, or other
  misc_feature (574)..(574): n is a, c, t, g, unknown, or other
  misc_feature (589)..(589): n is a, c, t, g, unknown, or other
  misc_feature (616)..(616): n is a, c, t, g, unknown, or other
  misc_feature (626)..(626): n is a, c, t, g, unknown, or other
  misc_feature (627)..(627): n is a, c, t, g, unknown, or other
  misc_feature (650)..(650): n is a, c, t, g, unknown, or other
  misc_feature (681)..(681): n is a, c, t, g, unknown, or other
  misc_feature (752)..(752): n is a, c, t, g, unknown, or other
  misc_feature (753)..(753): n is a, c, t, g, unknown, or other
aagctggagctccccgcggtggcggccgctctagaactagtggatcccccgggctgcaggaattcgcacgagaccattacctagaacatcctaatcgaaaaatccccggtgaccaagggtgttgaatcctcatgcacgcagaggcagaaacactgcccgaggctgatgcctgatggtgcgatcccgttccctgtcgccatcgagttcgttttttcgttggttgacagccttaaagcggcgcacgaatgccacgagccactgaggcggcttcccaggtcactccagggccagggcgcccgggtcgccctggaatccccgctcctccctccggnggttggggtcccgagagctcgcttttcgttgggggggggggggantnnaaaggttttttttcccccttttgtgttgtggtgtgggcccctttncnncnnnnttttatnaatttgctttnggggaacccttaaccngaaangggggtcctnnaaatttaaatgaattatttggcntggcccctccccccccctcccccccaggaaaagtggngggaagaaacctatgagaaataccccnnannaaaattttccaaacncgggaacccccccgcgggggggggggntctcccaaanngaaaaaaaatcccggcacgaaanaaaaaggggtgcggggggtccgcaaaagcgncctatatacgggtgttttataggatgaatttgtgtgggggaggagggtagaagctcttttgcctccacaanncgcgggctaacgcccacgactctcgttcgcgccc

SEQ ID NO: 46255 - DNA, 881 bp, Zea mays
  misc_feature: Ceres CLONE 1451583-F
  misc_feature: Encodes the peptide sequence at SEQ ID NO. 46256
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (476)..(476): n is a, c, t, g, unknown, or other
  misc_feature (493)..(493): n is a, c, t, g, unknown, or other
  misc_feature (881)..(881): n is a, c, t, g, unknown, or other
tggtcatacgagagtggaacccaaccctttttnnnnnnttnccccnnntcactttggtacttctcttaggtggcggccgctctatactagtggatcccccgggctgcaggtattcgcacgagaccattacctagaacatcctaatcgaaaaagggttccatcggtattactgccaatgacgatccatataatggtaatgaaatgagcccaaacgaccaaagacaaagccatgtttcagcatcgagaaagagacctatttccctcccaagaagtgaagaagcaaaaactgggaagagacagagagagaatggtgatgatatgattcccacacccgagaactatagacctgaagatgctctacaacatgtccaacatagcaaggggaattgatcgactagaatctttgtcgagggagcgggttgaaannngnntgacttattataaaacacccaaggtgttttcttcccccccccagnattttccacttaatacngtacaatcgtccaatccataagggaacgtatgattgtcgaatttatgggacccggatgtcctctttaattcggttggataacggatattggagccgatcataaagataaattttccataataaccaaccatggaaatgtgaccgcccttcgctagaaaataactctggccgggcccttttttgccttatcttttcggctccgaggcttccacaccaaaattttattcaaccttatttattgcgtgccttaggaatttgaggatgcgagcaccgctcgcattaagcgagcggattatatatggggcgtgtcccaagacgacatccctccactatatcccgggggcgtgcataaggcgatttgaaagagcgcagttaaaatcggagcgtn

SEQ ID NO: 46256 - protein, 62 aa, Zea mays
  misc_feature: Ceres CLONE 1451583-F
MSPNDQRQSHVSASRKRPISLPRSEEAKTGKRQRENGDDMIPTPENYRPEDALQHVQHSKGN

SEQ ID NO: 46257 - DNA, 789 bp, Zea mays
  misc_feature: Ceres CLONE 1451590-F
  misc_feature (320)..(320): n is a, c, t, g, unknown, or other
  misc_feature (323)..(323): n is a, c, t, g, unknown, or other
  misc_feature (328)..(328): n is a, c, t, g, unknown, or other
  misc_feature (374)..(374): n is a, c, t, g, unknown, or other
  misc_feature (375)..(375): n is a, c, t, g, unknown, or other
  misc_feature (386)..(386): n is a, c, t, g, unknown, or other
  misc_feature (388)..(388): n is a, c, t, g, unknown, or other
  misc_feature (401)..(401): n is a, c, t, g, unknown, or other
  misc_feature (402)..(402): n is a, c, t, g, unknown, or other
  misc_feature (435)..(435): n is a, c, t, g, unknown, or other
  misc_feature (444)..(444): n is a, c, t, g, unknown, or other
  misc_feature (503)..(503): n is a, c, t, g, unknown, or other
acccgcggtggcggccgctctagaactagtggatcccccgggctgcaggaattcgcacgagaccattacctagaacatcctaatcgaaaaaaaaacccacaccacacttcgttccccttgtcccaattgctcctccacttcccccaccgcccaccagtgatctcgccgccgcgacgcgaggcaccacggccggcgccggccgccttcctccagaaagtatcccccgtgcgcccgaatcacctcttaatttcgttcttagccgctgcgtttcacagaggtcgcgacatgcccgcctcggcggctcctcctgcccagcccgnggnaccgnccccctccctctcctcccgcttctcctgcccctccggaggatgtgnnagcgactgccngntcaccttcgaggnnctcagcagtggggaccgtgaactggggaacggnccacctccntgccgtcttcgcttggctgctaacacggggggagcaaggaagcctcccgtttccgtccntaaggatgcccaaggtgaagctgaaaaatggaaccccaactgaaaagcgggaacagttataaattggagaaaatatgcttggaaaaaaaaacccttctttaaccaaacccgcgggaaaaccggaggtttttcaaatttggccctggtgggcctcgctaaagggattgtgttttgggcctttattttcgccgggcacaaaaagtgggcgccaaaaaaaaaaattttgggggaaactcccccttgggggggggaaccccacaaccccccgtgggggggagaaaataaa

SEQ ID NO: 46258 - DNA, 750 bp, Zea mays
  misc_feature: Ceres CLONE 1451595-F
  misc_feature: Encodes the peptide sequence at SEQ ID NO. 46259
ctccccgcggtggcggccgctctagaactagtggatcccccgggctgcaggaattcgcacgagaccattacctagaacatcctaatcgaaaaaagccacaccaggcacgccagcctcactcactccccagaccacctcacacgcacgaagcagcagcagtggactggactagctctaggtgggcaacatgaagcttcaggccaccgccagagttgctggcctcctcttcttcctcgtcctcctcctggcgctgccttccctccgcgtctccatggctggatcagggttctgcgacggcaagtgcgcggtgaggtgctccaaggcgagccggcacgacgactgcctcaagtactgcgggatctgctgcgccacctgcaactgcgtgccgtccgggacagcgggcaacaaggacgagtgcccatgctaccgcgacatgaccaccggacacggcaaccgcaccaggcccaagtgcccctgatgatattcattccttcgctctgtcttgcatgcgtatatgtaatgttgtataggctgtgcaatgcatgcatacatgatacatgccgtgactctggatcggcggatgcctatgcatgcttttcactagctgctgctactactactactcttcctgtcttcctactgtgtgcaccaaagtgagagggacgacatgcatggcgatgacatgtcgtgttatgtgcactggcggccgcttggccaggtctaattcatgctctgtgtattgtgatacga

SEQ ID NO: 46259 - protein, 96 aa, Zea mays
  misc_feature: Ceres CLONE 1451595-F
  misc_feature (6)..(96): Pfam Name: GASA Pfam Description: Gibberellin regulated protein
MKLQATARVAGLLFFLVLLLALPSLRVSMAGSGFCDGKCAVRCSKASRHDDCLKYCGICCATCNCVPSGTAGNKDECPCYRDMTTGHGNRTRPKCP

SEQ ID NO: 46260 - DNA, 778 bp, Zea mays
  misc_feature: Ceres CLONE 1451604-F
  misc_feature: Encodes the peptide sequence at SEQ ID NO. 46261
ggagctccccgcggtggcggccgctctataactagtggatcccccgggctgcaggaattcgcacgagaccattacctagaacatcctaatcgaaaaaccaacttcgatctccaatccccagctagctaactatccaatggcgggccaagtgatggaagctcaggcgtgccggctgcagcctcccaccatggcgccgttcgcgccactacctcatcagtacaacaacacctgcaagcacctcaacacgacgatggccgccacttccggcaacaacaacagcaacggcagcaccgctaccgcggctggcggtgcggcggccgacggcatggccgcctacctccagcacctgcagcaggcgggcgccgaggcggcggccaagaagcgcggcggcggcggcgcggcgcgcagggaacaatgcccgcggtgcgcgtcccgcgacaccaagttctgctaatacaacaactacaacacgtcccagccgcgccactttctgcgcgcttgccgacgctactggacgctgggcgggtccctccgcaacgtccccttcggtgggtcccacccgcaagcgcccggcgctgggcgcaccaccacaacacagccaggtttccttcccccggggcccgaaagtttttggctcccaggccaaaagagcccccttccctttgaaaccgggttctctaaaacatttttttccccggggaagggaaaagggaaaagggaaaaaagggggccccccccccctcctattgtttcccccctccgccccccgggggggagg

SEQ ID NO: 46261 - protein, 105 aa, Zea mays
  misc_feature: Ceres CLONE 1451604-F
MAGQVMEAQACRLQPPTMAPFAPLPHQYNNTCKHLNTTMAATSGNNNSNGSTATAAGGAAADGMAAYLQHLQQAGAEAAAKKRGGGGAARREQCPRCASRDTKFC

SEQ ID NO: 46262 - DNA, 706 bp, Zea mays
  misc_feature: Ceres CLONE 1451605-F
  misc_feature: Encodes the peptide sequence at SEQ ID NO. 46263
  misc_feature (609)..(609): n is a, c, t, g, unknown, or other
  misc_feature (627)..(627): n is a, c, t, g, unknown, or other
  misc_feature (628)..(628): n is a, c, t, g, unknown, or other
  misc_feature (652)..(652): n is a, c, t, g, unknown, or other
acccgcggtggcggccgctctagaactagtggatcccccgggctgcaggaattcgcacgagaccattacctagaacatcctaatcgaaaaattcacatcttctcttcgtccgccgccgccgcctctcttcattggtagcaccttaatccgaccccagtccagccccccgccatggaggcgctgacggccacggacaaatgcttctccccggccagggcgatgttcccgatgccgattgtgaggccacctgcatcaccagaccatgccagtcagtatctggaggacttgttgcaggagcaacagaagctcgggccattcgtgcaggtgctcccaatctgcggcaggctgttgaatcaagagataatgagaacatcaaacctgctttctaactttggagttagaggaaatgagaggttgccaccaattgcaagtccgaaccacatgcatccattgccccggggacctgatttctgtggaaacggtttcggtccatggaatgagatgcatcctgagagaagtggttttcctaggggagccatgggttggcaaggtgctgtacagaaccattcctcctacatttgtcagaagatcgtgcgatttggagttccnacagatgcttacccccanntttacttcatgggccgtttgcttnggccgaggggacactcactaaagagaatcgagctactacaggttgccgtgtttc

SEQ ID NO: 46263 - protein, 178 aa, Zea mays
  misc_feature: Ceres CLONE 1451605-F
  misc_feature (152)..(152): Xaa is any aa, unknown, or other
  misc_feature (153)..(153): Xaa is any aa, unknown, or other
  misc_feature (161)..(161): Xaa is any aa, unknown, or other
MEALTATDKCFSPARAMFPMPIVRPPASPDHASQYLEDLLQEQQKLGPFVQVLPICGRLLNQEIMRTSNLLSNFGVRGNERLPPIASPNHMHPLPRGPDFCGNGFGPWNEMHPERSGFPRGAMGWQGAVQNHSSYICQKIVRFGVPTDAYPXXYFMGRLLXPRGHSLKRIELLQVAVF

SEQ ID NO: 46264 - DNA, 751 bp, Zea mays
  misc_feature: Ceres CLONE 1451608-F
  misc_feature: Encodes the peptide sequence at SEQ ID NO. 46265
  misc_feature (679)..(679): n is a, c, t, g, unknown, or other
  misc_feature (739)..(739): n is a, c, t, g, unknown, or other
  misc_feature (740)..(740): n is a, c, t, g, unknown, or other
tggagctccccgcggtggcggccgctctagaactagtggatcccccgggctgcaggaattcgcacgagaccattacctagaacatcctaatcgaaaaaaccccaaaggtcgccgtgaccgtgccggagagatctcgcgctccgggcccgttaccgcgcagctgtgctgtcgcaggcccacccgttcacccactccgccacgctctcgataaggccgccgcacgcggccgcacgcaccgacaagctggagccgccgcagcaggaggcggtgaaaccatcgccgaccaacggtcgcatccgctaccgtacgccctcggcagccgatctgctccccgctgacgatgtcgcggcggatgccgcggcagccacagtggtggccgcgaggatgcgccgctactcgggcgccggagcacggcagcagcagcaaacggaggcggtggccgaccgcgtgcaccggtaccgtcgggtgctgatggtgttgctctcgccggtactcctcatctcgttcgtgctccttctcatgccgcgcgcgccggcctccgcctcagggggtgtgctcctcgccgttggtggtcggaggtggggaccccgggccgtcgaggacggactgaacaagtatgcggtcatatttgacgccggcagctctgggagccgcgtgcacgtgtattgcttcgacgaanacctggatctagtgcccatagggaaggagattgagctgttcaaacaggtgaatggtttanngcttcctcttg

SEQ ID NO: 46265 - protein, 122 aa, Zea mays
  misc_feature: Ceres CLONE 1451608-F
  misc_feature: SWISSPROT Homolog: EC 3.6.1.15 Nucleoside-triphosphatase
  misc_feature (99)..(99): Xaa is any aa, unknown, or other
  misc_feature (119)..(119): Xaa is any aa, unknown, or other
MRRYSGAGARQQQQTEAVADRVHRYRRVLMVLLSPVLLISFVLLLMPRAPASASGGVLLAVGGRRWGPRAVEDGLNKYAVIFDAGSSGSRVHVYCFDEXLDLVPIGKEIELFKQVNGLXLPL

SEQ ID NO: 46266 - DNA, 713 bp, Zea mays
  misc_feature: Ceres CLONE 1451612-F
  misc_feature: Encodes the peptide sequence at SEQ ID NO. 46267
  misc_feature (461)..(461): n is a, c, t, g, unknown, or other
  misc_feature (493)..(493): n is a, c, t, g, unknown, or other
  misc_feature (519)..(519): n is a, c, t, g, unknown, or other
  misc_feature (543)..(543): n is a, c, t, g, unknown, or other
ctccccgcggtggcggccgctctagaactagtggatcccccgggctgcaggaattcgcacgagaccattacctagaacatcctaatcgaaaaaaataaaaacacgccgccaccatctccggcgatgtcgcgcttcgggcgctccgggcagccggagaaccgcgaatctttctccctcctcgtcctcaacgtctccttccgcactacggctgacgacctcttcccgctcttcgatcgctacggcaaggtcttagacatctacatcccgcgcgaccacaggactggggatccgcgagggttcgcgttcgtgaggtacaattacgaggatgaggcgcaggatgccattgacgggcttgatgggatgaggtttgatgggcgtgcgctcatggtgcagtttgccaaataccggaacccatgctgaaaagatcataggggtagaattacagaagaaaatcaaagccnaggggtcgttgcaaaaaccgcagtccaggacngggtatcgagaaggattatggggatngagactataaaggccaaaccggancaaagtttgggacggaattgaacaggccgggtacaaaaaggggaatcttcgtcccctaggagccccggtatttaccccgatttggaggggaacgtaccaaaccgggggctcccggttcttaaagcccccttaaagaaagatgtttcctcccaggggcccccggaaagaaa

SEQ ID NO: 46267 - protein, 98 aa, Zea mays
  misc_feature: Ceres CLONE 1451612-F
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSRFGRSGQPENRESFSLLVLNVSFRTTADDLFPLFDRYGKVLDIYIPRDHRTGDPRGFAFVRYNYEDEAQDAIDGLDGMRFDGRALMVQFAKYRNPC

SEQ ID NO: 46268 - DNA, 783 bp, Zea mays
  misc_feature: Ceres CLONE 1451614-F
  misc_feature: Encodes the peptide sequence at SEQ ID NO. 46269
  misc_feature (250)..(250): n is a, c, t, g, unknown, or other
  misc_feature (358)..(358): n is a, c, t, g, unknown, or other
tggcggccgctctagaactagtggatcccccgggctgcaggaattcgcacgagaccattacctagaacatcctaatcgaaaaattttcaaaatcaaaccacgacgatgccgcaggcgatggcggacgccgcgacgctctccgccctcgctctctttgcctcccgcctctcctgtcgcaggttcggggacgaggacctccgggtgctggaggccgcgctgtccgccggcgccgacgtccccgcgctgctcngcacgcgctcggcggcccggcgcctgctgcgatcgagcgcggcggaagcactcgcgttcacccgcgcgggtgcatcgctggatggtggggatgaaagacggaacctcnccgtccgcgacttcttctcaggcgctttccccttgaaggcgatgtcaaaagctgccctggcatgaaatcgaggccatgttgcttcaaaacgttaaatccggcaggactttcctttggaagggtcccgcccggagaggcgtaacttttgccacggaatggccttgaaaaggcttccccacccctttgcccccaaggtttttaaaaaggccttttggggcctttcccccccccccccgggggtcttggggccccggattttcccctgggggaggagggaacaattttttaaaatagaggggccccaaaatgtggcggcgattttttttcccccaccgtttttgtgtcaaaaaaaaccgccgaaaaaaaggagagagaagaacctctgcgtggcccccaaaaatattttttttcccgcccaccccccc

SEQ ID NO: 46269 - protein, 101 aa, Zea mays
  misc_feature: Ceres CLONE 1451614-F
  misc_feature (45)..(45): Xaa is any aa, unknown, or other
  misc_feature (81)..(81): Xaa is any aa, unknown, or other
MADAATLSALALFASRLSCRRFGDEDLRVLEAALSAGADVPALLXTRSAARRLLRSSAAEALAFTRAGASLDGGDERRNLXVRDFFSGAFPLKAMSKAALA

SEQ ID NO: 46270 - DNA, 719 bp, Zea mays
  misc_feature: Ceres CLONE 1451618-F
  misc_feature: Encodes the peptide sequence at SEQ ID NO. 46271
  misc_feature (230)..(230): n is a, c, t, g, unknown, or other
  misc_feature (235)..(235): n is a, c, t, g, unknown, or other
  misc_feature (236)..(236): n is a, c, t, g, unknown, or other
  misc_feature (243)..(243): n is a, c, t, g, unknown, or other
  misc_feature (244)..(244): n is a, c, t, g, unknown, or other
  misc_feature (279)..(279): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (453)..(453): n is a, c, t, g, unknown, or other
  misc_feature (475)..(475): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (511)..(511): n is a, c, t, g, unknown, or other
  misc_feature (521)..(521): n is a, c, t, g, unknown, or other
  misc_feature (670)..(670): n is a, c, t, g, unknown, or other
  misc_feature (685)..(685): n is a, c, t, g, unknown, or other
  misc_feature (686)..(686): n is a, c, t, g, unknown, or other
aaagctggagctccccgcggtggcggccgctctagaactagtggatcccccgggctgcaggaattcgcacgagaccattacctagaacatcctaatcgaaaagaacgggggcgacctccaggaaaatcgcagagaatgagggggatcctcttcgggccccggcggcagccgccgccgctcccgctcttccccgccgccaagcgctcctcggcacccgcgaaccttctttntcgcnntcgcctnncttatcgctttcctcccggccagccccatcctccnggctccttctcctcctcgcactcctctccctcatcccgcgggcctttcttccaccctcggtctccgccgctttcaccaaaatgcgcgaagaggaaagtggcggggtggaatgnnnaagggccccccatggggggggcgcacgggggggactcccccaacgccttccccaattcnatgggaccccttttccaaatgnctttttnnnnnnaggcgcccggctgggtggcaagtnaattttttcnagggcccaagaggggggggccttttgccccgcctagagggcaagtattcttaaaaaaagtcgtggggtatttttcacaccaaaaagttctgcgccgcgcacgccaccaaggagccgtcttttaaaaacacaaagcgcgccccgcacggnccttttccttcgttnntttttatggccccaatagcgaggaacttctccc

SEQ ID NO: 46271 - protein, 169 aa, Zea mays
  misc_feature: Ceres CLONE 1451618-F
  misc_feature (32)..(32): Xaa is any aa, unknown, or other
  misc_feature (34)..(34): Xaa is any aa, unknown, or other
  misc_feature (37)..(37): Xaa is any aa, unknown, or other
  misc_feature (86)..(86): Xaa is any aa, unknown, or other
  misc_feature (87)..(87): Xaa is any aa, unknown, or other
  misc_feature (114)..(114): Xaa is any aa, unknown, or other
  misc_feature (116)..(116): Xaa is any aa, unknown, or other
  misc_feature (117)..(117): Xaa is any aa, unknown, or other
  misc_feature (118)..(118): Xaa is any aa, unknown, or other
  misc_feature (126)..(126): Xaa is any aa, unknown, or other
  misc_feature (129)..(129): Xaa is any aa, unknown, or other
MRGILFGPRRQPPPLPLFPAAKRSSAPANLLXRXRLXYRFPPGQPHPPGSFSSSHSSPSSRGPFFHPRSPPLSPKCAKRKVAGWNXXGPPMGGAHGGDSPNAFPNSMGPLFQMXFXXXAPGWVASXFFXGPKRGGPFAPPRGQVFLKKVVGYFSHQKVLRRARHQGAVF

SEQ ID NO: 46272 - DNA, 737 bp, Zea mays
  misc_feature: Ceres CLONE 1451622-F
  misc_feature: Encodes the peptide sequence at SEQ ID NO. 46273
tggagctccccgcggtggcggccgctctagaactagtggatcccccgggctgcaggaattcgcacgagaccattacctagaacatcctaatcgaaaaatcaccaagttttggattccagcagcggcgcccccaggccaggccccacccgctcagcctcctcagctgcccaaccttctccccatctgctcagcctcagctgtcattcccgcgaagcgccgtctcccggctctatcgatggaccgagtcgccgccctcgtcgtcgcgctcctcgccctcttcttcgccgccggggccacggcgcaggccccggcctcgtcgcccaagcgcactccagcgccagcgccacccaggacggtcttcatcccgccgcccccggccagggcgcctatggcctccccgccctcgcctcccgcgatggcgccggtgcccgcgccctccgccggcgtgccggccacgagccccgtcggcgcgggagctggtgacgacgcgatggcccccgccggagccgcggcggctctgactccggctgccgcgcccgtcacggagaagagcgcctgcgtctcagcctccgccgtcgccgccagcctcgtggccatcgttgccgccgtggcagccgccgtcgcgttctataccgggaccgaccttgggacatctgatatggcggtggatccgtggaagaactagagctgcactctttctccgctgtgggtgttgggcgttttccctcccctttttt

SEQ ID NO: 46273 - protein, 149 aa, Zea mays
  misc_feature: Ceres CLONE 1451622-F
MDRVAALVVALLALFFAAGATAQAPASSPKRTPAPAPPRTVFIPPPPARAPMASPPSPPAMAPVPAPSAGVPATSPVGAGAGDDAMAPAGAAAALTPAAAPVTEKSACVSASAVAASLVAIVAAVAAAVAFYTGTDLGTSDMAVDPWKN

SEQ ID NO: 46274 - DNA, 751 bp, Zea mays
  misc_feature: Ceres CLONE 1451626-F
  misc_feature: Encodes the peptide sequence at SEQ ID NO. 46275
  misc_feature (504)..(504): n is a, c, t, g, unknown, or other
ggagctccccgcggtggcggccgctctagaactagtggatcccccgggctgcaggaattcgcacgagaccattacctagaacatcctaatcgaaaaatccagtctccgtgtccagtcgagtctcagcaaggaagatgtgggggagaggaaagaagcgtttcggcggtggcggcagcggtgagcccgcggccaagcgccaggccgcgagggacgatggcccctccgaatccgctgaagacggtaccgtcgtagccgagatatcgaagaacaagaaggtgtccgttaggagctggaaaggcagggtcttcgtcgacttacgcgagttctacttcaaggacggcaagactctccccacccgcaaaggtatatcactccaattagatcagtggaagatattgaaggacaacatcaaagccataaatgaggccatcgaggaaaatacatgatgggagccgccaagcagtcacgtgacgggcgagcttttgctttctctctggttgaggnccgatgtacggaagtagtttttgttgcccatatgctggcctgttgcttttggcccatttgaccccctgcttgttggaggggccccatggcccaaaggtttggtttttggcccggggctccaattaaccttaacgccggacggaggaagaaactctccttattacctgtggaccaaaaaaccttgtgtgggttcggcacaaaaaatatttggggtaaaagactccgggtttctttctcggtttaaaac

SEQ ID NO: 46275 - protein, 103 aa, Zea mays
  misc_feature: Ceres CLONE 1451626-F
  misc_feature (10)..(99): Pfam Name: PC4 Pfam Description: Transcriptional Coactivator p15 (PC4)
MWGRGKKRFGGGGSGEPAAKRQAARDDGPSESAEDGTVVAEISKNKKVSVRSWKGRVFVDLREFYFKDGKTLPTRKGISLQLDQWKILKDNIKAINEAIEENT

SEQ ID NO: 46276 - DNA, 723 bp, Zea mays
  misc_feature: Ceres CLONE 1451627-F
  misc_feature: Encodes the peptide sequence at SEQ ID NO. 46277
ggagctccccgcggtggcggccgctctagaactagtggatcccccgggctgcaggaattcgcacgagaccattacctagaacatcctaatcgaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccacaaccccctggcttctgagccccgcaccatccgtggcgactttgctgtcgacattggcaggaatgtcattcatggaaatgacagcattgagaagggctaataggagattgccctggtggtccccccaggcccttgctgaatggcaaaccaacacccccctctgaatttcgaaaagaaaacgtggaaagtttcccatcaaccttgaaacccaaaggagccggcccccttttgggtttaaacaaggtttcaaaaaaattaaaatcgttctcttgaacctttttttgggggcaaa

SEQ ID NO: 46277 - protein, 144 aa, Zea mays
  misc_feature: Ceres CLONE 1451627-F
  misc_feature (2)..(135): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVVAMVWEGKSVVTTGRKIIGATTPWLLSPAPSVATLLSTLAGMSFMEMTALRRANRRLPWWSPQALAEWQTNTPL

SEQ ID NO: 46278 - DNA, 738 bp, Zea mays
  misc_feature: Ceres CLONE 1451632-F
  misc_feature: Encodes the peptide sequence at SEQ ID NO. 46279
ggagctccccgcggtggcggccgctctataatagtggatcccccgggctgcaggaattcgcacgaaaccattacctagaacatcctaatctaaaaaaaattcgcagcgtgtctcttcctccatcgcagagtgtctcgggctcgccccagggtcctcttggtcgctttccctccaccccgggcgcaaaccctaaccctaccggcactcgcaccgcgccgtctgccaatggagcgcctcgagtgagtgtgcgctaaagaggggtaaaccttgaggccactacccctggaggacagcgagatatgtataaacacgcctgatcgtgcccaaggggcaggtctggactaaaagcggatcaaagaggtggtggataaaaatctcaagaagcatgtcgattcaccatatatgtggccccccccggcgggcggcgggcacgaccaccaccgcctcatcatgccatcctcaatgtcatgcatccccaagggtctctgctccgaaggggagactgattctgatagctaagcacagcaaggaatccgccctgattggaaaacaaacacatggctttacatggattagcaacttaagacggaaccgagacttctcggtaattgtaccaggactatattcaagacgaatttcaccttggtggcctccgccgggcaacatccttcagtaaaaatttgctcgttgataaggtctgaaatatggatgcaattgcttggggactagttttatgga

SEQ ID NO: 46279 - protein, 38 aa, Zea mays
  misc_feature: Ceres CLONE 1451632-F
MWPPPAGGGHDHHRLIMPSSMSCIPKGLCSEGETDSDS

SEQ ID NO: 46280 - DNA, 785 bp, Zea mays
  misc_feature: Ceres CLONE 1451633-F
  misc_feature: Encodes the peptide sequence at SEQ ID NO. 46281
  misc_feature (325)..(325): n is a, c, t, g, unknown, or other
  misc_feature (326)..(326): n is a, c, t, g, unknown, or other
  misc_feature (377)..(377): n is a, c, t, g, unknown, or other
  misc_feature (379)..(379): n is a, c, t, g, unknown, or other
  misc_feature (472)..(472): n is a, c, t, g, unknown, or other
gggctgcaggagttcgcacgagaccattacctagaacatcctaatcgaaaaatctcgtccacgaaacgtacggacttcgggcatcggccccaacgccagcggcaccgcaccaccacgcccgtcggcaacatgaatccgcccgcagcagccgcgtccaccggcccatgaggccacgccgcggcgcctgaggcagcccgggagtacgtgcactacccgaggctctccccagaggaggtggccccgcccccgcccccgccttatcacgccgccaccgccgcgccgtccgcctacggaggcaactcctatttttatttattttttaaanncgccgccacctccccgaagaagacgatggactgtttccccacaccagctcncncaaaatggggaaaaggtttggcgaaggcgcccccctaaacccaataccaacaccggcaaaattctggaaaccacttgaaaaactcggccaaancattacctgatgcctgtcattgagcaggatcttcgagtgtgggccaaatccattgccataaagggggataagaacaaagttttggcgctcaacattttggaggctcacctcctggtgtaaaagcttcacggaaccccaaatgcctgctgaatgttgtcagtcttagggccgatccctgtctatggcggcgggcgtgtgacctggaccacagtgacgaaccgtgacactttccattggagaaagcgcgcgagacacaacaggcctctgaaaacacaaactcgagtgggaagtttccaaaatggaggcgtattct

SEQ ID NO: 46281 - protein, 32 aa, Zea mays
  misc_feature: Ceres CLONE 1451633-F
  misc_feature (30)..(30): Xaa is any aa, unknown, or other
MGKRFGEGAPLNPIPTPAKFWKPLEKLGQXIT

SEQ ID NO: 46282 - DNA, 756 bp, Zea mays
  misc_feature: Ceres CLONE 1451634-F
  misc_feature: Encodes the peptide sequence at SEQ ID NO. 46283
  misc_feature (521)..(521): n is a, c, t, g, unknown, or other
  misc_feature (605)..(605): n is a, c, t, g, unknown, or other
  misc_feature (606)..(606): n is a, c, t, g, unknown, or other
  misc_feature (623)..(623): n is a, c, t, g, unknown, or other
  misc_feature (677)..(677): n is a, c, t, g, unknown, or other
  misc_feature (702)..(702): n is a, c, t, g, unknown, or other
ggagctccccgcggtggcggccgctctagaactagtggatcccccgggctgcaggaattcgcacgagaccattacctagaacatcctaatcgaaaatccccccgtttcaatcaaaatggaaaaaagtttcctcccttcccctctcttctgaatccggcatcaccatgcagaacaccgtcgcgaacccttccactgcggccgccgccgctgcggcagggaacggcggcgtccaagcatcgggggctggaggggagcggccggaggacgcgtcgaagcagaacctggcgcaggtgacgagctccatccagaagacgctgggcctgctccaccagctcaacctcaccgtctcctccttcaactctgcctcccagctccccctcctccagcgcctgaatgcgcttgtggcggagctcgacacgatgcagaaactcgccgaggggtgcaacatccaggtgcctatggaggtcgtcaatttgatcgacgatgggaagaaccccgacgagttcactagggacgtgctncacagctgcatcgtcaaaaaccagatcaccaagggcaagactgacgctttcaagggcctacggaagcatcttctttgagagctnntgacagctttccctgangacgtagaagcatacagggagatacgtgctacttctgctgctgaagcaaagcgnttggctcagtccccaggtactttgncctatggagatgtcaaagtgaaagctgagcattgagcgaatggtacgactacgg

SEQ ID NO: 46283 - protein, 144 aa, Zea mays
  misc_feature: Ceres CLONE 1451634-F
MQNTVANPSTAAAAAAAGNGGVQASGAGGERPEDASKQNLAQVTSSIQKTLGLLHQLNLTVSSFNSASQLPLLQRLNALVAELDTMQKLAEGCNIQVPMEVVNLIDDGKNPDEFTRDVLHSCIVKNQITKGKTDAFKGLRKHLL

SEQ ID NO: 46284 - DNA, 610 bp, Zea mays
  misc_feature: Ceres CLONE 1451635-F
aaagctggagctccccgcggtggcggccgctctagaactagtggatcccccgggctgcaggaattcgcacgagaccattacctagaacatcctaatcgaaaaacagatcgcttgtgcgtcgctaacccgccgctagtcggctagtgggtgggaatccgcagattcccgtcgctacttcggccacatggctgcagcggcggcttggaccgggccgcattcccccactcgttgctggtttggggtttggcttccccaagccgcgtggttcggcccttcccggggaactccttgggaaaggggtttcggttggggtttggcccccccgccgggggggctttgggggccccgcccccccccatgggggttaaaaaaaggggttctccttttttttttttccggggggccccccccccttgtggggggttttttaaaatattccccccggggggttttttccaaaaaaaatttttcccggggggggtgtccccgtcttttctcgggcctcttgtttttttttttccccccccttccgcggaattttttaaaccccccccttctttttttgtgggggggggtgtggtcccccttttttttttttggtggcgccctg

SEQ ID NO: 46285 - DNA, 654 bp, Zea mays
  misc_feature: Ceres CLONE 1451641-F
  misc_feature: Translation starting site: 203
  misc_feature (354)..(354): n is a, c, t, g, unknown, or other
  misc_feature (402)..(402): n is a, c, t, g, unknown, or other
  misc_feature (413)..(413): n is a, c, t, g, unknown, or other
  misc_feature (455)..(455): n is a, c, t, g, unknown, or other
ggagctccccgcggtggcggccgctctataactagtggatcccccgggctgcaggaattcgcacgagaccattacctagaacatcctaatcgaaaaacctggttctccgtccggtcagaccaatcaacaaagtgacgctgagcacgagcatccatcgtttccccttcttccccatcgcgtgccctcgccgcagccatcttccatggcggaccagctcacggacgagcagatcgcggagttcaaggaggccttcagcctcttcgataaggatggcgacggctgcatcactaccaaggaaagcttggaactgtgatgcgctcacttggccagaaccccactgaagcagagctgcangacatgatcaacgaggttgatgctgatggcaatgggaccattgacttnccagaattccntgaaactgatgggcaggaagatgaaggacaccgactccgaangaggagcttaaggaaggcttttcgcgtcctcgaaaaagaacaaaatggtttcatctcggcttgctgaactccgcatgtcatgaccaaacctcggcaaaaaactgaatgacaaggaggtccaaaaaaagaatccggaagggcaatgttgacggggaaggccaaattaataacaagaattcgccaaggcattaaggccaag

SEQ ID NO: 46286 - DNA, 748 bp, Zea mays
  misc_feature: Ceres CLONE 1451644-F
  misc_feature: Encodes the peptide sequence at SEQ ID NO. 46287
acccgcggtggcggccgctctagaactagtggatcccccgggctgcaggaattcgcacgagaccattacctagaacatcctaatcgaaaaacttcactactctctctctctctgcctgcaaagctgcttgatccatcatcgatcacatcactccaccagccgcagcgcacgaacgtacgactcatggcagatcgcgaccgcagcggcatctacggcggcggcgcctacgggcagcagcaggggggcggccgcccgatgggtgagcaggtgaagggcatgatccacgacaaggggccgacggcgtcccaggcgctgacggtggcgacgctgttccctctgggcgggctgctcctggtgctgtcgggcctggcgctggcggcctccacggtggggctggccctggccacgcccgtgttcctgctcttcagccccgtgctcgtccccgccgcgctgctcatcggcacggccgtcgcggggttcctcacgtcgggcgcgctggggctcggcggcctgtcctcgctcacgtgcctcgccaacacggcgcggcaggcgttccagcgcaccccggactacgtcgaagaagcgcgccgcaggatggcggaggccgcggcccacgcgggcacaagaccgcgcaggcgggcacggcatccaaagcaagcgcaagaggccgtgctggcactggcgcggcgccggcaggactcctccgtaataagcaatcatcatgaaggcgggcgtgcatgtcagcagg

SEQ ID NO: 46287 - protein, 188 aa, Zea mays
  misc_feature: Ceres CLONE 1451644-F
  misc_feature (39)..(156): Pfam Name: Oleosin Pfam Description: Oleosin
MADRDRSGIYGGGAYGQQQGGGRPMGEQVKGMIHDKGPTASQALTVATLFPLGGLLLVLSGLALAASTVGLALATPVFLLFSPVLVPAALLIGTAVAGFLTSGALGLGGLSSLTCLANTARQAFQRTPDYVEEARRRMAEAAAHAGTRPRRRARHPKQAQEAVLALARRRQDSSVISNHHEGGRACQQ

SEQ ID NO: 46288 - DNA, 699 bp, Zea mays
  misc_feature: Ceres CLONE 1451645-F
  misc_feature: Encodes the peptide sequence at SEQ ID NO. 46289
  misc_feature (699)..(699): n is a, c, t, g, unknown, or other
ccccgcggtggcggccgctctttaactagtggatcccccgggctgcaggatttcgcacgagaccattacctagaacctcctaatcgaaaaacgtttctctgcgactcgcacggcccgcgcccaccaccgaccaccccacctggttcggtcggcactcggcaccccgccccgcatacatgccgccgcccagcctcaccgtggcgcgcgacccggccgccgccgccaccacgcggcaccgcaaggtccacccgacgccgggcggaggcgcagggacgacgaaggagatgggcgcggcggaggggtgggcgcggcccgagtggtgctcggtggcgggcgccgcggccgtgctgtggtggtattttggcacccgcgctcctcgggtgcggcctcctgggggaccccccccccaagtacaccatccccatggtcaggccggacgcgccgccgctcgacctgggcttcgtcgccaccaggggcttgcacgccgccgtcgccgcgaggccctggctcaactcgctcctcgccgcgctcaacacggtcttcgtcgccatgcaaggggcgtacatcctgtgggccatcctcggcgagaagcggccgcgcgccgccgttcccacgctcatgatgttcacctgcccggggcgcgcttgggttgggccacccagattcccgctgccggaaggagtcccgggggtccgggan

SEQ ID NO: 46289 - protein, 232 aa, Zea mays
  misc_feature: Ceres CLONE 1451645-F
PRGGGRSLTSGSPGLQDFARDHYLEPPNRKTFLCDSHGPRPPPTTPPGSVGTRHPAPHTCRRPASPWRATRPPPPPRGTARSTRRRAEAQGRRRRWARRRGGRGPSGARWRAPRPCCGGILAPALLGCGLLGDPPPKYTIPMVRPDAPPLDLGFVATRGLHAAVAARPWLNSLLAALNTVFVAMQGAYILWAILGEKRPRAAVPTLMMFTCPGRAWVGPPRFPLPEGVPGVR

SEQ ID NO: 46290 - DNA, 746 bp, Zea mays
  misc_feature: Ceres CLONE 1451650-R2
  misc_feature (1)..(1): n is a, c, t, g, unknown, or other
  misc_feature (2)..(2): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (130)..(130): n is a, c, t, g, unknown, or other
nnaacaccnnnnnnaacaaattgggtaccgggccccccctcgaggtcgacggtatcgataagcttttttttttttttttttaaatccaaatcgtgcgtacaatttttatcaaaaacaaatacacaacttntttctagcatccacatataactaaagcataaagcatccaggtatcaaacattaaacatgtttaaatatcctataacttaaatccaaaagcagatagaatagtttcaacatccacaatctggttgacgccttccacggtcgctattgttgagaaagctcggcaactcccgactattggaagctgaagcttttggtccaaggaatttttggatcttcgctataagcattaaccagaaaaaaggggtcccatacaaaccccataaggtaaccccacgttggggggggaccgcctccaaacctttcttaaattcaaaaacaagcgggcctttttttcccaaaaaaccccctcccaaaaggaaccccgggggctagggcctcccaaaaaaaaaatttttttatagggggggccttggtttaattttttgaaaaaacaatttggggggaaaatagcccccggaaaagggggcccatttggaaaattaaacggggccttttaacaaggcaccaaaaaagaaaaagaattctcccaaaaaaaaaaaagagggggggggcacacagggggggggactctataaataggggggggccccccccccccccccaccaaagaagagggc

SEQ ID NO: 46291 - DNA, 708 bp, Zea mays
  misc_feature: Ceres CLONE 1451650-F
  misc_feature (624)..(624): n is a, c, t, g, unknown, or other
  misc_feature (690)..(690): n is a, c, t, g, unknown, or other
  misc_feature (708)..(708): n is a, c, t, g, unknown, or other
aagctggagctccccgcggtggcggccgctctagaactagtggatcccccgggctgcaggaattcgcacgagaccattacctagaacatcctaatcgaaaaatgttcactactttactagtcgtgcagcccatcaaccagagcccagcagcacaccaatctttctcatggacgcatggacgtgcctgctttctcgggcgtgctaggcgctatccctcgtcagcagccacaaccgccgcctgctagcacagccaacaagccgctcgccacgcgtgcgacgctgtgtttggcccccaccgccgttcggccgtcttccccgccgccggtccaccgtactcttcttcgctagactgctccccttctgcatcgctcacttgctccactacgcgcaagacgcaatcatgcccgtggcctactagtgcctagcttcctgcccctctctatgcgtgccactccaggcgtcgagcttgcctctgtgggaccatagcccctgcccctcatcgactctctgcgtgagcgtgatcatgcctccgcatcccatgttcaatacagccctaaagttctggctgccggtgctcgaggatttggaaaggcgctgtttgattagaagttgagcgtcctgacnagtgggtacctatagcttgtatggaccattttctggttatgcttatacgaagatccaaaatccttnggaccaaaagcttcagcn

SEQ ID NO: 46292 - DNA, 739 bp, Zea mays
  misc_feature: Ceres CLONE 1451650-R
ttgggaccgggcggggcagaggggagtttccaaaagcgtttggttttttttttatccaaaacgtgcgtcaatttttatcaaaaacaaatacacaactttttctagctcccatataactaaagcataaagcatccaggtatcaaacattaaacatgtttaaatatcctataacttaaatccaaaagcagaaagaatagtttcaacatccacaatccgattgacgccttccacgggtcctattgatgagaaagttcggcaactcccgaaaattgggaagtgaaaccttttgggcccaaggaattttgggatcttccgaaaaagcaaaacccaaaaaaagggcccataaaaagttaattggtatcttattttgttagggacccgttaggttcctaaattaaaaagggcgcgttttttcaaatacctcagaaggcaacgggaaagggagaaaatttgggaggggcctgtgaaatgaaaaacaggggaaggttcaaaggggatatatattccccccccacccccccgaaaaagagtcattaataagagggaaggggggtttttttggtctccaccaaagaagggggaaatatattcacccccctatgggggtgggggcccgctcctaagaggaagggggagaaaaaaaaaaaagaggcacactaaatggagcgccacagggcggagataatagggatacttaacaatgagaccccgttgacgtcgcaacttgtagtctttgttg

SEQ ID NO: 46293 - DNA, 762 bp, Zea mays
  misc_feature: Ceres CLONE 1451651-F
  misc_feature: Encodes the peptide sequence at SEQ ID NO. 46294
tggagctccccgcggtggcggccgctctagatctagtggatcccccgggctgcaggaattcgcacgagaccattacctagaacatcctaatcgaaaagacgaaggaaaaggcagccttctcaccgtcggacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaagggggcggcggtgaacaagttcgccgtgctgtccatggccgcgggattcctggctatagtggtgggggaattagggcgattgcggaccatgccaccgctgcttcggctatacacaagcttgtcatcaattgcggttgcattctctgcgacatgcattatccggtcaaagttgttcttgaaggttatgaaggcaaacacagaggccatcacaagctacgaaatgcttgatgcggttcgtgttgctcttggtatcctgctgcacagggtggttatagctaccactaccagactcctgccagaaaatgtctcctcccaagagagctccttgaatgctatgacattttagctttggtttcagtaggaaggggaataaaaccttcaagttaaaaatattggccaagtggcaatagtcttgtaccgaagatgctactgctggtaca

SEQ ID NO: 46294 - protein, 176 aa, Zea mays
  misc_feature: Ceres CLONE 1451651-F
MQRHVASGRPSGTDGSDFSYRMVVESRYQRVAEGRSRLARLILVQALHLVAGGLLLLLSLSKGAAVNKFAVLSMAAGFLAIVVGELGRLRTMPPLLRLYTSLSSIAVAFSATCIIRSKLFLKVMKANTEAITSYEMLDAVRVALGILLHRVVIATTTRLLPENVSSQESSLNAMTF

SEQ ID NO: 46295 - DNA, 740 bp, Zea mays
  misc_feature: Ceres CLONE 1451652-F
  misc_feature: Encodes the peptide sequence at SEQ ID NO. 46296
  misc_feature (536)..(536): n is a, c, t, g, unknown, or other
aagctggagctccccgcggtggcggccgctctagaactagtggatcccccgggctgcaggaattcgcacgagaccattacctagaacatcctaatcgaaaagctcgccaaaccctagccgccgagtgccgcccaccgcccgcccgccctccgccgcgcgtcggacggtgccgagggaagaggcaccatgaggttggagaagtgctggttctgctcctctaccatctaccccggccatggaatccagttcgtccgcaacgacgccaaggtcttccgcttttgccggtcaaagtgccataaaaacttcaagatgaagaggaaccctcgtaaggttaagtggacaaaagcatacaggcatttgcatggcaaggacatgacccaggatacaacctttgagtttgagaggaaccacaactggtccgagcgctacgaccgcaatttgacggagcagactctgaaggctatcccgcttattgcaaagattaggcatgaccgtatgggaaaacacatctcaaacatgcataaacctggtaaacncaaggagatggaaaaggactccaaggagctggagcaggacatcggcatgctcccgaagaagcttattatcaaccatctcgcggctgaaaaaacgaaggtcaagggtggaagttgtttcaccagcaaacagaaagataacggctatggaaaagtagtgcctggccattttgggtgccttgtggttttcctggccgaatgcaaatc

SEQ ID NO: 46296 - protein, 184 aa, Zea mays
  misc_feature: Ceres CLONE 1451652-F
  misc_feature (1)..(71): Pfam Name: Ribosomal_L24e Pfam Description: Ribosomal protein L24e
  misc_feature (117)..(117): Xaa is any aa, unknown, or other
MRLEKCWFCSSTIYPGHGIQFVRNDAKVFRFCRSKCHKNFKMKRNPRKVKWTKAYRHLHGKDMTQDTTFEFERNHNWSERYDRNLTEQTLKAIPLIAKIRHDRMGKHISNMHKPGKXKEMEKDSKELEQDIGMLPKKLIINHLAAEKTKVKGGSCFTSKQKDNGYGKVVPGHFGCLVVFLAECK

SEQ ID NO: 46297 - DNA, 696 bp, Zea mays
  misc_feature: Ceres CLONE 1451654-F
  misc_feature: Encodes the peptide sequence at SEQ ID NO. 46298
agctccccgcggtggcggccgctctagaactagtggatcccccgggctgcaggaattcgcacgagaccattacctagaacatcctaatcggaaaagcgtgtcatcgccttcccctccccacaagccaaacgcgaataccacccccgtgacttcccgatctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagccgccggtcaccatcgggttcgagttcgactggaggagcggcgtctccgccaaggactatcccagcgtcgccaagaagggcaaggtcgatggaagaggaaatgcaggacgtgaacaggcgaacgaaactcaggatggcttggctagggttcc

SEQ ID NO: 46298 - protein, 176 aa, Zea mays
  misc_feature: Ceres CLONE 1451654-F
  misc_feature (76)..(137): Pfam Name: EMP24_GP25L Pfam Description: emp24/gp25L/p24 family/GOLD
MAARRLGSPASRWLRPSALLLLVASALLSAPSPARALRFDLESGHTKCVSDEIKVNAMAVGKYHIVGPDPNSPDAQLPESHRISLRVTSPYGNSMHYAENVQSGHFAFTAAEAGDYLACFWAPDHKPPVTIGFEFDWRSGVSAKDYPSVAKKGKVDGRGNAGREQANETQDGLARV

SEQ ID NO: 46299 - DNA, 1161 bp, Zea mays
  misc_feature: Ceres CLONE 1451658-R
attgggtaccgggcccccctcgaggtcgacggtatcgataagcttttttttttttttttttgacagcaagaaatggtccatcatataaagatcggagtgcatatgtttaaaagaacaaatacattcgaaccttgatcagcaaaagtaacctagaccaacatactaaaaccctgtacacgctgggtgagaatgcaaaaggaggtgatactgataaagtaaagcacataataccagtaactctaccggcccaccgtaaggcgacaacaagagtttccattgcctgaagaacttctgttcttgtcttgactataccctgaaacaaactaaacaagtcaacaaaggggaggggatgagaggttatttttcaccctatactcttcaagtcctccacctccctgagcctttgatggggtctgagcaaaaaactgtttcttggccccggcacatggaaaacaccttaaaccctgaagggctccttaaaaaaactatatttaagacaggcttgaaaaggttttatcatcctttgaggcccaattattataccttattttcaccttaaaacaaacaactcccctccccctctcttaaagcaccccccgagatgtaccatccctttttagaaggatagaatttgttggtaagatacccacccgtatatactcctgttccccgacgaagtatggtgctcgcgagttgtctacgatccttcactaaagaccaagatgtggaaattatgagtgagaccacaaataatacagtcaccaacacaagaaaccacgtgacgatgaggagaagatatctcctgcgcgacacgcccaccttgtggaggtccgcacacagaatattctctgtaactatgttgtcgccgcctaatgtacgaggtatgagtatgatactgaagacccctcccccccaacaccgtccattaagcagtagaagtgtattatctagtgtagtcgctcattccacagcaatcacgacttgttgaaactcccactccgttacataaaaccccgcggacggataatagcaagaaggcgctcataccccttttattgtaaggcggacttactcttcgagtatccggcgacccgtaggtaaatcccacctcgcgcaaatagtgggaaaaaaacagaataaaccttctccaccctgtattag

SEQ ID NO: 46300 - DNA, 826 bp, Zea mays
  misc_feature: Ceres CLONE 1451661-R
  misc_feature: Pfam Name: CUE Pfam Description: CUE domain
cgaattgggtaccgggccccccctcgaggtcgacggtatcgataagcttttttttttttttttttagtcccaaaacaaattttattacgatcttttctaaatacactaacctatagcataccgagtatgataattatacagctatggttactatacaaacaaatccctggggacaaaaataaagagagagaaaaggattttattacaggatcgaaaagtgttgttacccccaggctcgcctttaactatacacatacttttcttataagcttttacagccagtaaacgtcatacttatatgttgtattgacgtatctactattgcatcagcaaaaaattattcacagccccgtttatgttgtttgcccccatcaaatcctctataattagctcgtcaggaatatgaggtaaaacttcccgcaccctatctaccatagggagtacctctgaaagacttccattgcctgtgcctgcactaccacggagccgcaatccggaagcagatgcactaccaggcaccatcgaggaagtggatggaacaagagaggaccctgccatgggctcgggccataggttccaggtaccatcagcatgcccataactgtcggtcacagaagccaactgcctcatcattatctggaactcagaaagacctactgacctcactgcactagaggcaccggggatttcttatcacagggcttgacccccgggggaatccagcttggatccaaaaccagcaccccttcaaaaaagcatctggaagggttctgcttgttcaacaagatggttcattaccaggaaactctctgcctgattcatccca

SEQ ID NO: 46301 - DNA, 975 bp, Zea mays
  misc_feature: Ceres CLONE 1451661-R2
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
nnnnnnnnnnnnnnnnnnccatcccttccctttttttatttttttgttgtgtatggggggtggnnnnnnnnnnnnnnnnnnntttttttcgatcttgtctattacactaacctatagcataccgagtatgataattatacagctatggttactatacaaacaaatccctgcggacaaaaataaagagagagaaaaggattttattacaggatcgaagagtgttgttacacccaggctcgcctttaactatacacatacttttcttataagcttttacagccagtaaacgtcatacttatatgttgtattgacgtatctactattgcatcagcagaagattattcacagtcgcgtttatgttgtttgtcctcatcaaatcctctataattagctcgtcaggaatatgaggtagaacttcccgcaccctatctaccatagtgagtacctctgatagacttccattgcctgtgcctgcactaccacggagccgcaatccggaagcagatgcactaccaggcaccatcgagggaagtggatgggacaagaagagaacctgccatgggctcggggcataggttccaagtaccatcagcatgcccataacctgtcggtcacagaaagcaactggcctcatcatcatctggaactccagaaaaacctactggacctcacctgcacttagaggaactgggaattatctattcacaagggcttggaccacggggggaatccaagcttaggatttcagaaccaggacccccctcccaaacaagaattttgaaaagggtttctggctggtttcaaacagggatggttcctttacccaagaaacacccctcggcgtgaaattcatcccccatagggaaaagggggtgttttctgccaaatttcgcgctgaaaaaacattttggcgtgcgcctccccacaaaatcggggaaaaaacctttggggttttggccccctttcgagaaaagc

SEQ ID NO: 46302 - DNA, 728 bp, Zea mays
  misc_feature: Ceres CLONE 1451661-F
  misc_feature: Encodes the peptide sequence at SEQ ID NO. 46303
  misc_feature (708)..(708): n is a, c, t, g, unknown, or other
acccgcggtggcggccgctctagaactagtggatcccccgggctgcaggaattcgcacgagaccattacctagaacatcctaatcgaaaatggatccacttccctccccacgtgttttttgattgttcctccccatgttcctcgcgttcccgtgaggccgtgacgcccccctcggcctcgcctcgccatcgctcgcggcatcgccgcctgccccctttcccccacgcgaataaagcgccggaagcgcgccccccaagcaaagtcctccggcgctcaggatcgggagccaccccctagggttagggctccgttttgcctcgttccggcgtcgaccgatgcgcggcgcatggcgacggtgaactgcctctacgtcgcggccgcctccacggcggtaagcaccgctgctctgcagtggtgggcgtcctcgctcctcgacggcgacgctggggccggcggggatggagactggcttggagccgtgctgcggtcaagggtcaccgtcgcgctcctggcgaatctggcggcccacgtgttcgtcgttgtcatcctcgcgctcaagactatattttttgttcagctaacttctgtagagaccagaaaagtgttggagcacatcattaactatgtacttcacaagggaacttttctcccgctggctgtgcctccacttctcagcaaatatccttttggtcacttggttggtcattnctttgtcactgaagatgttc

SEQ ID NO: 46303 - protein, 127 aa, Zea mays
  misc_feature: Ceres CLONE 1451661-F
  misc_feature (121)..(121): Xaa is any aa, unknown, or other
MATVNCLYVAAASTAVSTAALQWWASSLLDGDAGAGGDGDWLGAVLRSRVTVALLANLAAHVFVVVILALKTIFFVQLTSVETRKVLEHIINYVLHKGTFLPLAVPPLLSKYPFGHLVGHXFVTEDV

SEQ ID NO: 46304 - DNA, 759 bp, Zea mays
  misc_feature: Ceres CLONE 1451662-F
  misc_feature (411)..(411): n is a, c, t, g, unknown, or other
  misc_feature (759)..(759): n is a, c, t, g, unknown, or other
caccgcggtggcggccgctctattctagtggatcccccgggctgcaggaattcgcacgagaccattacctagaacatcctaatcgaaaaatccccaggcctcacgcccatctagcaaggttctcctcctccccttccacatgaccagcgccgcgccgcgcagcgcagccgtccttgttctgtcccgggtacgccgccacacacaccgcttcaagcgctgccctccgtttctcctctttgtggattggaatcgacgcctgaaagtgtatgacgatggcgggttcttgcgtcgcgccgcccgttgactgtcttctctcgttgaggacgctgccgccaactcgcgttagacttgggggttttttgtgaaagaacgaggggggagggaaccacaaagaaaccgggcccttccccnaaaagggtgtttagaggcagaattcgggagttcataacggggaggtctagggttacctgctaaaaagtggtggctgccaacagagaaaggcccgcgaagggagagagggggcgcggttaggcgcgggagattatgcaggcatggtgtattggattcgttactccgtaatatgcccctgctatgatgtgattttcctccgggctcccccgccacttaaatcgcaattttttagtcccatgctccgcgatttatccaacttccccgcgttctttttcttatttattaagttaacgcggccctctaggggatacatagggtttaataggcggtgaattgggggagtcgtgn

SEQ ID NO: 46305 - DNA, 755 bp, Zea mays
  misc_feature: Ceres CLONE 1451668-F
  misc_feature: Encodes the peptide sequence at SEQ ID NO. 46306
tggagctccccgcggtggcggccgctctagaactagtggatcccccgggctgcaggaattcgcacgagaccattacctagaacatcctaatcgataaatcgccgtgcgcgtgcgtccacttcattgctgctcatgtacccctacacgtttcgggcggccgccagcagcagcagcagcagcacggcactcgggttcgcgctcggccggatcggcggcaccacgaggagcggcggcgtcgctgcgccaggcttggtggtacccgccgcgggcgtagcacgcgggaggagcgtctcctcgacgccggccggcagcgcacccgtgccgggcgaccagggcgtcggcatggagcagccgaagcagcagcagcagcagcccaaggtgcccccgcaggacgccgccgggggcgagaacaagcgcgacgacatgcacaagcacaccagagtacgacacgtcgcagggctcggaggtaaaggagaaggagaaggcgcgccacctcaaggacgagaagcatgccaccgcctagaggcgccggcggcgacatcaggcagggctgtcggcgtttagtttagtcgagttcgctttgctcccggcctttgggcgcgtcacgtactcagcgtggttcgctaggctgctttcgaatactacagtactatccaagtttgctgagatgtaaaaaaaatagtaagctgtttcaaggagcttccgtgctagtacatgttatttctgctctttgcttctatgtaatacaagcacaa

SEQ ID NO: 46306 - protein, 143 aa, Zea mays
  misc_feature: Ceres CLONE 1451668-F
MYPYTFRAAASSSSSSTALGFALGRIGGTTRSGGVAAPGLVVPAAGVARGRSVSSTPAGSAPVPGDQGVGMEQPKQQQQQPKVPPQDAAGGENKRDDMHKHTRVRHVAGLGGKGEGEGAPPQGREACHRLEAPAATSGRAVGV

SEQ ID NO: 46307 - DNA, 701 bp, Zea mays
  misc_feature: Ceres CLONE 1451670-F
  misc_feature: Encodes the peptide sequence at SEQ ID NO. 46308
  misc_feature (701)..(701): n is a, c, t, g, unknown, or other
tggagctccccgcggtggcggccgctctagaactagtggatcccccgggctgcaggaattcgcacgagaccattacctagaacatcctaatcgaatttctccccttcccaccccatccctcactgcgagtggcctggtgtgcgagccgcgcgagaggaaaagaggcagagcgagccttccgcctcctcccccccttcgcgagagagaaaggagtgggggaggaaaaaaaatcttagggctttctcgtcgatcctctccgcgattaccccaccgattcgtccaatccaatgcagcgcggccccgcggtatcaaatcccccggcggcggccgccaccggcgcctccgagaacggtggatgtgatttgtctcgtgcggatgggaaatggtcgtaggatcctttataggttattattgaactgccccccacagttaattgtgagcagaaatattggacactctggcccatcttgcagtgcacctgcatatcagttgtttcgccctgttactcgttctatgacccgtgggtctgatcctatcgtggcttcacctggtttcaaggcaggaggatctgatagcgcaagcacacaaagaagtatttcatatgcttcttttagcgctcaattagttgcctcacgactgactgccactcgtacccggacccctctaaaagtgacttcatctggttggaagcctcttactcn

SEQ ID NO: 46308 - protein, 108 aa, Zea mays
  misc_feature: Ceres CLONE 1451670-F
MGNGRRILYRLLLNCPPQLIVSRNIGHSGPSCSAPAYQLFRPVTRSMTRGSDPIVASPGFKAGGSDSASTQRSISYASFSAQLVASRLTATRTRTPLKVTSSGWKPLT

SEQ ID NO: 46309 - DNA, 759 bp, Zea mays
  misc_feature: Ceres CLONE 1451671-F
  misc_feature: Translation starting site: 330
  misc_feature: SWISSPROT Homolog: EC 2.3.1.144 Anthranilate N-benzoyltransferase
  misc_feature (644)..(644): n is a, c, t, g, unknown, or other
  misc_feature (698)..(698): n is a, c, t, g, unknown, or other
  misc_feature (759)..(759): n is a, c, t, g, unknown, or other
ggagctccccgcggtggcggccgctctagaactagtggatcccccgggctgcaggaattcgcacgagaccattacctagaacatcataatcgaaaaatcggctgcggccggccgtctcccctgcctacttcggcaacgccatccagagcgctgtgacgacggcgacggtgacggagctgctggcttgcagcgatctacggtgggccgcgggcaagctgaacgcgagcctcgcggcgtacggcgacggcgcgatccggcgcgcggcggcggcgtggcaggccgcgccccggtgcttcccgctgggcaaccccgacggcgcggtgatcacgatgggaagctccaaccggttcccgatgtacgagggcaatgacttcgggtgggggcggcccctcgcggtgcggagcggccgcgccaacaagttcgacggcaagatgtcggcgttcccgggacgcgccggggacggcagcgtggacatcgaggtgtgcctgaccccggacaccatggcggcgctgctccgcgacaccgagttcatgcagtacgtgtcgggcccgtcgcatctgttgtgatgtactactataccggtgccatgcgtgcgggcgcgagtgggggccatcgggtcgggcggcgtcagggctgggctgctngtgatttgctcggtcgtccttgcctttagcgaggactagctagttggtgccaangacattgtatctgtctcgctttctcgcagtgctgcggtgaaatcgtgttagttagcaactn

SEQ ID NO: 46310 - DNA, 762 bp, Zea mays
  misc_feature: Ceres CLONE 1451674-F
  misc_feature: Encodes the peptide sequence at SEQ ID NO. 46311
  misc_feature (366)..(366): n is a, c, t, g, unknown, or other
  misc_feature (403)..(403): n is a, c, t, g, unknown, or other
  misc_feature (405)..(405): n is a, c, t, g, unknown, or other
  misc_feature (653)..(653): n is a, c, t, g, unknown, or other
ctccccgcggtggcggccgctctagaactagtggatcccccgggctgcaggaattcgcacgagaccattacctagaacatcctaatcgaaaacactcccaagacacagagcgtcagagcccgatcccgatccagcgaggcggcgaccctccctcctccccttgcttcgctcgtccagccctgaccacccgcatccccgtcagtcatggcagcggcagcaggcggaggcgcggtgcgtgcgctgtcccagaaggagcaggacatacagatgatgctcgccgccgacgtccaccttggcaccaagaactgcgatttccagatggagcgctatgcctttaagcgccgcaccgacggcatctacatcatncacctttggcagacatgggagaaactgcagcttgcancnaggggtatcgttgccatcgagaccccgcaggacatcatcgtccagtcccgccgcccctatggcaggcggctgtcctcagttccctccgaacactggggctcatggcattccttggagggcaacccccggggaccttttcttaaccagctccaagactccttaaagggagcctcgggtgggcttccttaccggacccagggttggaccttccccccaattaaggggcccggcctggggaaaatcccccnaccttggctttgggggaaaggaaccccccccggcggagggggcaaattccggcctccccccaaaaaaaagggggagaaaaacacttgggggccccgtccgcgttttttg

SEQ ID NO: 46311 - protein, 186 aa, Zea mays
  misc_feature: Ceres CLONE 1451674-F
  misc_feature (23)..(165): Pfam Name: Ribosomal_S2 Pfam Description: Ribosomal protein S2
  misc_feature (54)..(54): Xaa is any aa, unknown, or other
  misc_feature (67)..(67): Xaa is any aa, unknown, or other
  misc_feature (150)..(150): Xaa is any aa, unknown, or other
MAAAAGGGAVRALSQKEQDIQMMLAADVHLGTKNCDFQMERYAFKRRTDGIYIXHLWQTWEKLQLAXRGIVAIETPQDIIVQSRRPYGRRLSSVPSEHWGSWHSLEGNPRGPFLNQLQDSLKGASGGLPYRTQGWTFPPIKGPGLGKIPXPWLWGKGTPPGGGGKFRPPPKKKGEKNTWGPRPRFL

SEQ ID NO: 46312 - DNA, 736 bp, Zea mays
  misc_feature: Ceres CLONE 1451676-F
  misc_feature: Encodes the peptide sequence at SEQ ID NO. 46313
  misc_feature (579)..(579): n is a, c, t, g, unknown, or other
  misc_feature (630)..(630): n is a, c, t, g, unknown, or other
  misc_feature (736)..(736): n is a, c, t, g, unknown, or other
ggagctccccgcggtggcggccgctctagaactagtggatcccccgggctgcaggaattcgcacgagaccattacctagaacatcctaatctaaaaaaagccacgacagcagtcgaagcgcgcggcgcgcctgcctagccatcccggccacccggggccagggcccagggggaggggaaaccgaggcaggcggcggccgcagcagcggcagcgcagggcgcacgcgcttctcgtttcgtgtccccacaccccagccgagggggagttggagggaagtaaccggaggcgcagcttcaaggaggaggctggcggccgagcgttcgtgcggcatggggagggacgagctgctgcggcggagcctcgtggcgctggcggcggccgtggcgctcacgggcttggccacggcgtcgctgcgcaaggcggcggccacatacgggttcggcatcctcgccatcgctggcgtgctgctcccggactgggagttcttcgaccgggactactcccagtggctcacccccatgcccgcctcccgacgcacggccgcggccgcggccgccgaccgggagcacgacgtctggnaaatcaagccctatcctctcagggtggccatgctgacgaccatctacgggntcggtcttcacagtggtggacgtacgtatctagctagcggagtgggtcttcacagcatgaccgacgaacccgaaaggtgaaatatcattgattagggtgtagcaan

SEQ ID NO: 46313 - protein, 126 aa, Zea mays
  misc_feature: Ceres CLONE 1451676-F
  misc_feature (84)..(84): Xaa is any aa, unknown, or other
  misc_feature (101)..(101): Xaa is any aa, unknown, or other
MGRDELLRRSLVALAAAVALTGLATASLRKAAATYGFGILAIAGVLLPDWEFFDRDYSQWLTPMPASRRTAAAAAADREHDVWXIKPYPLRVAMLTTIYGXGLHSGGRTYLASGVGLHSMTDEPER

SEQ ID NO: 46314 - DNA, 826 bp, Zea mays
  misc_feature: Ceres CLONE 1451677-F
  misc_feature (344)..(344): n is a, c, t, g, unknown, or other
  misc_feature (653)..(653): n is a, c, t, g, unknown, or other
  misc_feature (684)..(684): n is a, c, t, g, unknown, or other
aaagctggagctccccgcggtggcggccgctctataactagtggatcccccgggctgcaggaattcgcacgagaccattacctagaacatcctaatcgaaaaattcaaaactccaatgaatcagacaagtcccgagtcctgcgaaagtttgatgggatcaggcgtctcatgcagcagctgccacctgagcacctcgcgcgccgtcatagcttcacatgccagcggggtgggcgccggcctgaggcgcaaatgctccatcgttaccgtccctatttccttgtcctgtcgcaggtgccactctctccccgcgattctctcctcctgattgtctgcttcttcatgcngaccaccgtcggcgcatcattgtgaagttgcagcactactctaattaaagacagatgtcgcggtcctctgacccccactaaatgcacaggccagaaaaacataaattaaagccccccccgccccaaaaatttcaaatttccaaacctttgaaaaaaacaaaatgggccccatggggggaggcccgcaaaccccccctttgcccccccaaaagtttacggggcggaagggaaaaaatcccaaaaggggtcttttgggggttttgggccccccccacgggtttagaaaaaaaccacccctttggggggcgncccattagataagacaaaagaaaagtttgtntggggaaaatatttttttgtataaatagacccccacctctttgttctttataaataaaaaggagagtccctttgcaaaagaaaatatgtttttattcttgaagaaaaagaaaaagggccccgccacaaaccaaagagagagg

SEQ ID NO: 46315 - DNA, 747 bp, Zea mays
  misc_feature: Ceres CLONE 1451682-F
  misc_feature: Encodes the peptide sequence at SEQ ID NO. 46316
  misc_feature (295)..(295): n is a, c, t, g, unknown, or other
  misc_feature (296)..(296): n is a, c, t, g, unknown, or other
aaagctggagctccccgcggtggcggccgctctagaactagtggatcccccgggctgcaggaattcgcacgagaccattacctagaacatcctaatcgaaaaaggagctcgcgctctgcaaaccttcatggcctccgaggcggtcgtcgttcacaccggcggttgccactgccggcgcttgcggtggcaggtcgaggcccccgcgagcgtagtggcgtggatctgcaactgctccgactgttccatgcgcgcgaacacccacttcatcgtccccgcccgcaaaagtcagctgcanngccggcgctgacgaagttcatcaccacctacacctcggcacgaacacgccaagcaaccttttgcaagactggggatcacctctttctaaccccgaggtcaaccgcgaaggctggccattaccgtggcctggttcaaccgggaccttaaaaccctcaagacccgatttcagggaagaacggaagattttttcggaccccgacttccgggatttccaaaaaaaaaaaaggggggaaatgggggagaaaaatctgtttctcccccctatttaggggatatttggaaactttaatttcaccgtgtgttttcaccccaattcccatttttttcaacaaatcgcccccccccgtgttgggtgcgccccttttttcccaccaatgaaaaaaaaaaaaaacccttttttttttgttggggggcacaccccccggcgggtttttaaaaattttttttttt

SEQ ID NO: 46316 - protein, 59 aa, Zea mays
  misc_feature: Ceres CLONE 1451682-F
  misc_feature (56)..(56): Xaa is any aa, unknown, or other
  misc_feature (57)..(57): Xaa is any aa, unknown, or other
MASEAVVVHTGGCHCRRLRWQVEAPASVVAWICNCSDCSMRANTHFIVPARKSQLXXRR

SEQ ID NO: 46317 - DNA, 764 bp, Zea mays
  misc_feature: Ceres CLONE 1451683-F
  misc_feature: Encodes the peptide sequence at SEQ ID NO. 46318
aaagctggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcctttctgtagggaactactttgcttgtgtcttgttagtactgaaaaccagaggcactcctacctttttgcatcagtagccactaaaatgtggcagattccactgtttaccttgcatctatctaaattata

SEQ ID NO: 46318 - protein, 133 aa, Zea mays; identical to SEQ ID NO: 13146
  misc_feature: Ceres CLONE 1451683-F
  misc_feature (14)..(123): Pfam Name: Ribosomal_L32e Pfam Description: Ribosomal protein L32

SEQ ID NO: 46319 - DNA, 760 bp, Zea mays
  misc_feature: Ceres CLONE 1451690-F
  misc_feature (654)..(654): n is a, c, t, g, unknown, or other
aaaagctggagctccccgcggtggcggccgctctagaactagtggatcccccgggctgcaggaattcgcacgagaccattacctagaacatcctaatcgaaaaaagcaaaaatgaaaccagcaacggtagcaaagtggcaatggtttcacttccagtccaatcaattccttcgtttgacgttctatccctgactcaggtagtcaggtgtagtgctgctgcggccacagtgctcggcgctcgctcgtgctgcctgctggtgctctgtgctcgagtgctcgacggccgctgcccgctgcgctgggagcttgcgacgagccaacgggtcaccggtcgacggccacccgcgcgccaccgcgccagactgggcgcgccctcctcgccgtgggtcctccactccgggatccggcggcggcggcggcctccctgcggccctgcctgcgccgtgcagtgccgcccctcgccggcggtcggctcaactccctgtccaccacagtgccgagccggcatccacctcctgcttccaccgccagtttgccacagtgccgcgccggcctcccgtccctggtcgaaggccgccaccgccacctactgaattgtgataatgaacgtgacggcggcgaggcagcggaggctgcccccgctcgggccacggnggccactcccgccgccgcgcctcctcgccgctgtcatcgccttcgccttcgcgctcctcttcctgctcctcgtgcttctctccagctcctcccctcactcgccgcc

SEQ ID NO: 46320 - DNA, 715 bp, Zea mays
  misc_feature: Ceres CLONE 1451692-F
  misc_feature (365)..(365): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (390)..(390): n is a, c, t, g, unknown, or other
  misc_feature (400)..(400): n is a, c, t, g, unknown, or other
  misc_feature (413)..(413): n is a, c, t, g, unknown, or other
  misc_feature (414)..(414): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (469)..(469): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (520)..(520): n is a, c, t, g, unknown, or other
  misc_feature (521)..(521): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (540)..(540): n is a, c, t, g, unknown, or other
  misc_feature (542)..(542): n is a, c, t, g, unknown, or other
  misc_feature (543)..(543): n is a, c, t, g, unknown, or other
  misc_feature (549)..(549): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (617)..(617): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (650)..(650): n is a, c, t, g, unknown, or other
  misc_feature (652)..(652): n is a, c, t, g, unknown, or other
  misc_feature (655)..(655): n is a, c, t, g, unknown, or other
  misc_feature (657)..(657): n is a, c, t, g, unknown, or other
  misc_feature (674)..(674): n is a, c, t, g, unknown, or other
  misc_feature (675)..(675): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaacctctcctctcctctcctcttcctctgcttctctccccgatctctatttcccatttccgggcggctcccgttctccacctcaattattgcccacgcatccccgctccctcctctcctctcctcccgtcccacccatctcctcgcaccagcgccgggggaatggcggccgcgctgtggacgctgctggtggtggtggccctggtcggcggcgctggcctcgaaccgcccccgtggggcgggggggggggggccccccggggggncnnngggggggggggggnnnnnngngggggggggncccgcgccccccnngggggggggggggggggggcgccgggcnnnncccccccnnnnnnnnncccccccnccnnngcggcgcgggggggggggggggggggggggcccccccccccccccnnccccccnnnnnnngggggngnngggggngggggggnnngnnnngnnngnnnnnncgcggccgcnnnnccccggccgcgcgcnnngcccccgccccngnnnncccccgggggcgcgccccccccgcgcgngngcngnccgcggggggggggggnncgggggggggcgcgcgggnnngngcccggccgcggcggcg

SEQ ID NO: 46321 - DNA, 755 bp, Zea mays
  misc_feature: Ceres CLONE 1451696-F
  misc_feature (550)..(550): n is a, c, t, g, unknown, or other
  misc_feature (551)..(551): n is a, c, t, g, unknown, or other
  misc_feature (573)..(573): n is a, c, t, g, unknown, or other
aaaagctggagctcaccgcggtggcggccgctctagaactagtggatcccccgggctgcaggaattcgcacgagaccattacctagaacatcctaatcgaaaataaaagattggatagctttcagccatgtgacatacatgaactgaaacctggaacacacttctttgctgtctacggtgacaacttcttcaagagcgctagttatactatagaggttgtatgtggtgaatcttttcctgccgaaaaggagatgctacgaaatgtggaggccaagatactcacaaaacgagctgaactttccaaatttgagtcagagtatagggaggttttggcgaagttcactgaaatgaccagcaaatacacacaagaaatgcaagcgattgatggtcttttgaaggaaaggaatgagatccatgcttcctataccaacaatccacctctaaaacggagttccagcaggaataaagccaagtcgccttcgaaagtggccaaaactggtacagaaaaacatcatcagaaggaaaagaaggtgaaggatcactgcatggnnaggatgtgaagtgacagcgatnactcaagtgaaaagaaatcaaaagagcggttcccaaagaaggaaatgctgaaccttccatttcaacttgacaggagaaagacgtgctgagcaatgtatatatggtcccgtgctattctatcctgttatgcataatcctgagctgaactcaatttcttccctttctcatgcttttaaaggagg

SEQ ID NO: 46322 - DNA, 799 bp, Zea mays
  misc_feature: Ceres CLONE 1451707-F
  misc_feature: Translation starting site: 155
  misc_feature (117)..(117): n is a, c, t, g, unknown, or other
  misc_feature (131)..(131): n is a, c, t, g, unknown, or other
  misc_feature (137)..(137): n is a, c, t, g, unknown, or other
  misc_feature (251)..(251): n is a, c, t, g, unknown, or other
  misc_feature (364)..(364): n is a, c, t, g, unknown, or other
  misc_feature (381)..(381): n is a, c, t, g, unknown, or other
  misc_feature (399)..(399): n is a, c, t, g, unknown, or other
  misc_feature (400)..(400): n is a, c, t, g, unknown, or other
  misc_feature (418)..(418): n is a, c, t, g, unknown, or other
  misc_feature (526)..(526): n is a, c, t, g, unknown, or other
aagctggagctccccgcggtggcggccgctctagaactagtggatcccccgggctgcaggaattcgcacgagaccattacctagaacatcctaatcgaaaagaaaaccctagcagtntcggtattagcagntcgacncggttcctcggagcacgatgaagtttgttgctgcctacctgcttgctgtcctcgctgggaacgccagcccctccgctgacgatttgactgccattctggagtcagttggctgtngaagttgacaatgaaaagatggaactcctgctgtcccaactgagcggtaaggacttcaccgagctcattgcccgcggcagggagaagtttgcttcagtcccatgtgggtggcngcggtgtccctgttgcngcagctgcacctgctgcnntgcgagctgctcctgcanctgaagcaaaaaaagaaaaaaagtggaagaaaagggaaaaaagcgattatgatttgggcttcaacctcttcaaatagctggccaacctcccaattttggttttgggcntggaacccggagaaacccgagcccggtttaaattaaaacctttgtttttttgtgaaaaacttgaaaaaaccccccctttctcttttttttgggaattccccccaaaatggcttcggggggggggaatttcccgcaacaacaattttttttcctctttatccccgggaggtgttcccccccgtttttgtgtgtttttaaaaaaaaaaaaaaattttttctcccccccccccggggggggggccccccccccccccccccgggggggagacaccc

SEQ ID NO: 46323 - DNA, 764 bp, Zea mays
  misc_feature: Ceres CLONE 1451713-F
  misc_feature: Encodes the peptide sequence at SEQ ID NO. 46324
aagctggagctccccgcggtggcggccgctctttactagtggatcccccgggctgcaggaattcgcacgagaccattacctagaacatcctaatcgaaaagtttgcatcctgagctctctcctggaccagccgagatttctcgctctgcgcatctctgattcatcttcgtcgagaggagctgttcctcttctttgccgcctcgaatctgggactggtccgttttctggatccctgctgcctgtcgggttctccagaggggtacaatccaatggagggtgtgtcatccttgatccagccgttgatcggcgactaccggctgcccgtgcccagcagtatcgccaagggtgatcaaatccaaggcctgttgtccactgaatggacaaatgaaccgcacagctatgtacataagctccatggacgcatcttccggggagcaactccgtagtggttccaaggccatccacgatggcttgtgccagatcatgaggattccgacggatgatgctcgcagccgtgacgtccctgagagtccctgggtggaggtgaggcgcttcacgccactcggagtccaccatggcgacggaatggaagtggaacctttggtcgatggttatggatcacgtactgacacggcccgagagaatgtgccggacctctgcagagtagcgaaggcttctgctgttatggaagtcacgggaccagactttccatgagaggggattcaatcccgtaacggtgcatgcaagagacctaatctactcct

SEQ ID NO: 46324 - protein, 109 aa, Zea mays
  misc_feature: Ceres CLONE 1451713-F
MNRTAMYISSMDASSGEQLRSGSKAIHDGLCQIMRIPTDDARSRDVPESPWVEVRRFTPLGVHHGDGMEVEPLVDGYGSRTDTARENVPDLCRVAKASAVMEVTGPDFP

SEQ ID NO: 46325 - DNA, 796 bp, Zea mays
  misc_feature: Ceres CLONE 1451723-F
  misc_feature: Encodes the peptide sequence at SEQ ID NO. 46326
  misc_feature (383)..(383): n is a, c, t, g, unknown, or other
  misc_feature (384)..(384): n is a, c, t, g, unknown, or other
  misc_feature (407)..(407): n is a, c, t, g, unknown, or other
aagctggagctccccgcggtggcggccgctctagaactagtggatcccccgggctgcaggaattcgcacgagaccattacctagaacatcctaatcgaaaaacacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaagcaccccacatcggctgaggttnnaatctacaaaatgaatgactcgnacatgccatgcgtacctgtccgtcgccgaataatggaatgggtgtgtgctttcgtccaataaattgctagaaaaataatggcctcctcgggtggcttgaataaaatgggtccaaatgttcacccttttccgaatggaataaaaattgggatattgaaaaggggcccccgttgtggggttccccctcccaaaaaaaaaaaaaaaatttttcttctccccgcccccggggggggggcccggccccacatccccccaagaggggggttattaccccgcccccgcggcgcccttttttaaacccggggggaggaaaaaaccggggtcccaacaattaatgcgggagaaacacccccctcccccggggggaaaaaaaaaagccccccccccccc

SEQ ID NO: 46326 - protein, 71 aa, Zea mays
  misc_feature: Ceres CLONE 1451723-F
  misc_feature (12)..(71): Pfam Name: potato_inhibit Pfam Description: Potato inhibitor I family
MSSTGGGDDGAKKSWPEVVGLSLEEAKRVILCDKPDADIVVLPVGTPVTMDFRPNRVRIFVDTVAEAPHIG

SEQ ID NO: 46327 - DNA, 744 bp, Zea mays
  misc_feature: Ceres CLONE 1451730-F
  misc_feature: Encodes the peptide sequence at SEQ ID NO. 46328
  misc_feature (409)..(409): n is a, c, t, g, unknown, or other
  misc_feature (410)..(410): n is a, c, t, g, unknown, or other
  misc_feature (486)..(486): n is a, c, t, g, unknown, or other
  misc_feature (504)..(504): n is a, c, t, g, unknown, or other
  misc_feature (505)..(505): n is a, c, t, g, unknown, or other
ggagctccccgcggtggcggccgctctagaactagtggatcccccgggctgcaggaattcgcacgagaccattacctagaacatcctaatcgaaaaattcaattcgtaaatttcgtccatgcatgggcatggaatggatggatgtgaatgccacgaacgattccgccccgccggccaggtgagagatgagcctcacggcggccttccgtgccaccaaaatcccgcgcgctcttcctccaaagtgcggtgagcctgccgcctcctcttcggcctcggcgtccggggatccgccgccgggggccgtgaagagtactaaggcgccgccgccgtggtgcgtgtaccttatagcctcatcccggatccgccgcacgtacgtcggcgtcaccaccgatttccctcgccggctgcnngcacataatggtgagttaaaaggtggtgcaaaagcttcctctgccggcagggcttggaatctcgcatgccttggtngaagatttgccaacaaanntggacgctggtgagtttgattcaaatggaagaacgtctcccggaaaatgcccgggaaaaaactgaactaaacatgaaatcccgccgccaacctcaaaaacacctttaaccaagaggaaactttccgggtttgtcccccctaaaaaacaagggggcccagttgaaccttttaccccttccccttcgggggggggggccttatttgggaaaaaccccccttaaaatccccctggcttaaaa

SEQ ID NO: 46328 - protein, 110 aa, Zea mays
  misc_feature: Ceres CLONE 1451730-F
  misc_feature (75)..(75): Xaa is any aa, unknown, or other
  misc_feature (101)..(101): Xaa is any aa, unknown, or other
  misc_feature (107)..(107): Xaa is any aa, unknown, or other
MSLTAAFRATKIPRALPPKCGEPAASSSASASGDPPPGAVKSTKAPPPWCVYLIASSRIRRTYVGVTTDFPRRLXAHNGELKGGAKASSAGRAWNLACLGXRFANKXGRW

SEQ ID NO: 46329 - DNA, 740 bp, Zea mays
  misc_feature: Ceres CLONE 1451731-F
  misc_feature: Encodes the peptide sequence at SEQ ID NO. 46330
ctccccgcggtggcggccgctctagaactagtggatcccccgggctgcaggaattcgcacgagaccattacctagaacatcctaatcgaaaaaaagcgaaaagaaaaaggggaaaaggggctggtgcgcaaaaccctagcacagtcgcatccatcatggcgatgtccatcttcggcggctgcgtcggcggcgactccggtgcgctcatcgcgccgtccgcgtcctcgctccgcccgccgttccgtcttgtcgctggtcccaagggccatttttgtacttttcctcatggagcatctagcaatcacagccggctatgtgttcaacatcaaaggtgttctcgcagctccacccagaactatgctctttctaggaaggatttttctcctataactcaagatgtgcaacgcttccttcacaatgttgttaatatgggttttcttgaccgtctgaaattagcgtggaagataatgttttctgcaccaaccacaaaggatacctccaatgcaaacatcgcaaaacagaggcttaagatgatcctgttctccgacaggtgtgaagtcagtgatgaggcaaagaaaaagatcgtggagaacatcattgaggcactgtctgagtttgttgagattagattaagggataacgtccaggtggatatctcaactgatggttgcccttggcccggggaccctgtgccagttcctggtgccccgtgtgaaccagagtaccaggaatctgaaaag

SEQ ID NO: 46330 - protein, 195 aa, Zea mays
  misc_feature: Ceres CLONE 1451731-F
MAMSIFGGCVGGDSGALIAPSASSLRPPFRLVAGPKGHFCTFPHGASSNHSRLCVQHQRCSRSSTQNYALSRKDFSPITQDVQRFLHNVVNMGFLDRLKLAWKIMFSAPTTKDTSNANIAKQRLKMILFSDRCEVSDEAKKKIVENIIEALSEFVEIRLRDNVQVDISTDGCPWPGDPVPVPGAPCEPEYQESEK

SEQ ID NO: 46331 - DNA, 780 bp, Zea mays
  misc_feature: Ceres CLONE 1451732-F
  misc_feature: Encodes the peptide sequence at SEQ ID NO. 46332
aagctggagctccccgcggtggcggccgctctagaactagtggatcccccgggctgcaggaattcgcacgagaccattacctagaacatcctaatcgaaaaaagagcgaaaatggatccgcaccagttcgccccctcccagcagtcggcgctgaccatggaatcggcggagagcacggccgccgccgccgcgcgggcgtccaacggcgctgcccgagctgtcgtcgaggacgacgacgaggacgacgacgtccccgaggtggccgcctgcatatcgacgatgctcgaccgcgggggtagcgtggagagccaccgcctcttcctggcgcgccgcaccgcgctggagatgctccgcgaccgcgggtacgccggtccggaagaagagctcgcccgcaccctcccggagtcccgccctgggtgggatacaggccggagctcgaaacgctcgccttctcactaccctcccctccgaccgtccagaaaggtgaaagttgggtcttggcacccttgacctggtcaaatcccactttccggttgattttcccgaatccaaaatgaaaacttgcccagatggttttgaaaactgggggggaaaatattgttttcaacccggaaaaccctccggggaatcttttccattttaaggtggaaccttttccaataccgggagttttttggggaacaatcccattagttgtgcccccccccccacaatttaaattgtttccctcccaagaggaaaaaactccccccctctaaaaaaagaacaagtgtgtgggac

SEQ ID NO: 46332 - protein, 132 aa, Zea mays
  misc_feature: Ceres CLONE 1451732-F
  misc_feature (57)..(128): Pfam Name: RNA_pol_Rpb5_N Pfam Description: RNA polymerase Rpb5, N-terminal domain
MDPHQFAPSQQSALTMESAESTAAAAARASNGAARAVVEDDDEDDDVPEVAACISTMLDRGGSVESHRLFLARRTALEMLRDRGYAGPEEELARTLPESRPGWDTGRSSKRSPSHYPPLRPSRKVKVGSWHP

SEQ ID NO: 46333 - DNA, 768 bp, Zea mays
  misc_feature: Ceres CLONE 1451739-F
  misc_feature: Encodes the peptide sequence at SEQ ID NO. 46334
  misc_feature (646)..(646): n is a, c, t, g, unknown, or other
  misc_feature (705)..(705): n is a, c, t, g, unknown, or other
ggagctccccgcggtggcggccgctctagaactagtggatcccccgggctgcaggaattcgcacgagaccattacctagaacatcctaatcgaaaaatctgaaatatcttgccacctgacgcgacagcgacaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgttctcttcaacgacgatcggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaacaccaagttctcgattccatacaactcgtatgcttgtattctgccgtgcctatattagattctctcgaaccatttggtgttcccttgaaactgctatcgtgtgatgtatgaaattgtggtgctcaagaaattgccttgcttgcatatggttgtgttgctaanaaaatcaatgctggtatagcattcgtgtcatgagacatgcaaacagcagactggagttnatggccggccgggtattgaaaaaaaaaaaaaaaaaagcttatcgataccgccgacctcgaggg

SEQ ID NO: 46334 - protein, 87 aa, Zea mays
  misc_feature: Ceres CLONE 1451739-F
MNVEEEVGRLKEEIHRLGQQQPDGSYKVKFGVLFNDDRCANIFEALVGTLRAAKKRKILTYEGELLLQGVHDNVEITLLPPPAVAAA

SEQ ID NO: 46335 - DNA, 751 bp, Zea mays
  misc_feature: Ceres CLONE 1451744-F
  misc_feature: Encodes the peptide sequence at SEQ ID NO. 46336
  misc_feature (621)..(621): n is a, c, t, g, unknown, or other
  misc_feature (706)..(706): n is a, c, t, g, unknown, or other
ctggagctccccgcggtggcggccgctctagaattagtggatcccccgggctgcaggaattcgcacgagaccattacctagaacatcctaatcgaaaaatatttccatcctccattcacgcatcacaagctggaaggcactgtgggcaataatggctctgctcacgctccagcagccagcgatacccttcctcctgctcctcctcctgctccccgccgcgtccgctaggctgcccggtggccggacactggtcttcatcctggctgggcagtccaacatgagcggccgcggcggcgccaccaacggcacctgggacggcatcgtcccgccggagtgcgcgccctcggaccgcatcgtccgtctctcccccgcgcttcgctgggagcaggcgcgcgagccgctgcacgccggcgtcgacgtgggcaacgttctcggcgtcgggcccggcatgcccttcgcgcacgccgtgctcaccagcgagggcgcagccgcagagccccccgtcgtcgtcgggctcgtgccgtgcgcacagggcggcacgccgatcgccaactggtcccgggggacggagctgtacgagcggatggtgacgcgcgccagggcggccgtggccgagtgcancgaacgcggtcacttggcccgcttgctttggtaccagggggaggcggacaccatgaggcgccaggatgctgagctctaccagcgnggatggagactctcgtgcgtgacgtccgctgcgacctcgggcggg

SEQ ID NO: 46336 - protein, 200 aa, Zea mays
  misc_feature: Ceres CLONE 1451744-F
  misc_feature (96)..(190): Pfam Name: DUF303 Pfam Description: Domain of unknown function (DUF303)
  misc_feature (157)..(157): Xaa is any aa, unknown, or other
MALLTLQQPAIPFLLLLLLLPAASARLPGGRTLVFILAGQSNMSGRGGATNGTWDGIVPPECAPSDRIVRLSPALRWEQAREPLHAGVDVGNVLGVGPGMPFAHAVLTSEGAAAEPPVVVGLVPCAQGGTPIANWSRGTELYERMVTRARAAVAECXERGHLARLLWYQGEADTMRRQDAELYQRGWRLSCVTSAATSGG

SEQ ID NO: 46337 - DNA, 847 bp, Zea mays
  misc_feature: Ceres CLONE 1451745-F
  misc_feature: Encodes the peptide sequence at SEQ ID NO. 46338
  misc_feature (443)..(443): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (459)..(459): n is a, c, t, g, unknown, or other
  misc_feature (467)..(467): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (473)..(473): n is a, c, t, g, unknown, or other
  misc_feature (513)..(513): n is a, c, t, g, unknown, or other
  misc_feature (516)..(516): n is a, c, t, g, unknown, or other
  misc_feature (553)..(553): n is a, c, t, g, unknown, or other
  misc_feature (557)..(557): n is a, c, t, g, unknown, or other
  misc_feature (560)..(560): n is a, c, t, g, unknown, or other
  misc_feature (572)..(572): n is a, c, t, g, unknown, or other
  misc_feature (585)..(585): n is a, c, t, g, unknown, or other
  misc_feature (593)..(593): n is a, c, t, g, unknown, or other
  misc_feature (610)..(610): n is a, c, t, g, unknown, or other
  misc_feature (618)..(618): n is a, c, t, g, unknown, or other
  misc_feature (622)..(622): n is a, c, t, g, unknown, or other
  misc_feature (625)..(625): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (683)..(683): n is a, c, t, g, unknown, or other
  misc_feature (685)..(685): n is a, c, t, g, unknown, or other
  misc_feature (711)..(711): n is a, c, t, g, unknown, or other
  misc_feature (713)..(713): n is a, c, t, g, unknown, or other
  misc_feature (714)..(714): n is a, c, t, g, unknown, or other
  misc_feature (716)..(716): n is a, c, t, g, unknown, or other
  misc_feature (725)..(725): n is a, c, t, g, unknown, or other
  misc_feature (736)..(736): n is a, c, t, g, unknown, or other
  misc_feature (754)..(754): n is a, c, t, g, unknown, or other
  misc_feature (757)..(757): n is a, c, t, g, unknown, or other
  misc_feature (761)..(761): n is a, c, t, g, unknown, or other
  misc_feature (796)..(796): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (804)..(804): n is a, c, t, g, unknown, or other
acggctggagctccccgcggtggcggccgctctataatagtggatcccccgggctgcaggaattcgcacgagaccattacctagaacatcctaatcgaaaaatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacttcgtccgtggcgccttgcctcgggtacgcaaatgggagggctggtgtcggcctcctgggcgtgttgttttgggggggccctcgttggagggcgggtggttttttaattatttattttcccccccacctactcattggctcccaaaanaatgaaaggnnnaggntcccacgncnnncncccccccccgccccacctcccccccaattccccccccccnaanagggaacccctccccttgtgggtgagacccacgattncccngantgttaaaagggnaacaaagaaacangtgaaccnagcgcacccaacaatgnaaacggcnccantcntcctggnnngcgccctatgatttgacaaatcaaccacgaaatnnnntttaatttcgtngncgatatattcccgaaaccaaacgttnanngnacacctcgngccgcatgtancaacgatagtacaacaanagngagnccgtcccatccgaacccatcaaatataaagaaagncnnncccncacaccaacgctaacgtaaaataagaagaaagcgaatgaagaa

SEQ ID NO: 46338 - protein, 132 aa, Zea mays
  misc_feature: Ceres CLONE 1451745-F
  misc_feature (92)..(92): Xaa is any aa, unknown, or other
  misc_feature (96)..(96): Xaa is any aa, unknown, or other
  misc_feature (98)..(98): Xaa is any aa, unknown, or other
  misc_feature (101)..(101): Xaa is any aa, unknown, or other
  misc_feature (102)..(102): Xaa is any aa, unknown, or other
  misc_feature (116)..(116): Xaa is any aa, unknown, or other
  misc_feature (117)..(117): Xaa is any aa, unknown, or other
  misc_feature (129)..(129): Xaa is any aa, unknown, or other
  misc_feature (131)..(131): Xaa is any aa, unknown, or other
MAARSSSSQPQLVAAAAVLAAALLLLAAGAGTASAAVSCGEVTSSVAPCLGYANGRAGVGLLGVLFWGGPRWRAGGFLIIYFPPHLLIGSQXNERXRXPRXXPPPAPPPPQFPPPXXGTPPLVGETHDXPXC

SEQ ID NO: 46339 - DNA, 750 bp, Zea mays
  misc_feature: Ceres CLONE 1451748-F
  misc_feature: Encodes the peptide sequence at SEQ ID NO. 46340
  misc_feature (379)..(379): n is a, c, t, g, unknown, or other
  misc_feature (686)..(686): n is a, c, t, g, unknown, or other
aaagctggagctccccgcggtggcggccgctctataactagtggatcccccgggctgcaggaattcgcacgagaccattacctagaacatcctaatcgaaaagacgccgacgccctatctcacgtcttcgtcggtcccttcccagccttcgtcgcgtccttcgccgtcgacgagaacacacgaggaaacacttgcaggactgaagaatagagaaacatgtcgtctggtggtgtgaaagatttttaccggcagaaaaagaaaggaggcgtggcgaatacagcttcatcctcaaagaataagacacggcattacactggtggggcttctgttggtgcctcagatgcagctcatacatcagctgtagtttcgcatggctccngggatctcacagatgactttggtgatgaagaagaccagctgcgacagtttgacgtggacatgaagtttggtccttgcatcggtgttactcggcttcagcgctgggagcgagcctctgccatgggcctccagccaccagcgcatctccgggacctcctactgcacgcggcatctacaaagaatcgcggtggcggtagcccctctgtcgagtgcctttgggagggtaaagtctagaagaaatatcttctaatcccccatcccaggtcaacttcaggtggttaactggagacgcttgttgtaccatgcancctcgtgttgatgtatgttggcactcggttgtttgtcaagggaggtgttcggtacagtatatag

SEQ ID NO: 46340 - protein, 131 aa, Zea mays
  misc_feature: Ceres CLONE 1451748-F
  misc_feature (4)..(128): Pfam Name: DNA_pol_delta_4 Pfam Description: DNA polymerase delta, subunit 4
  misc_feature (55)..(55): Xaa is any aa, unknown, or other
MSSGGVKDFYRQKKKGGVANTASSSKNKTRHYTGGASVGASDAAHTSAVVSHGSXDLTDDFGDEEDQLRQFDVDMKFGPCIGVTRLQRWERASAMGLQPPAHLRDLLLHAASTKNRGGGSPSVECLWEGKV

SEQ ID NO: 46341 - DNA, 756 bp, Zea mays
  misc_feature: Ceres CLONE 1451749-F
  misc_feature: Encodes the peptide sequence at SEQ ID NO. 46342
ggagctccccgcggtggcggccgctctagaactagtggatcccccgggctgcaggaattcgcacgagaccattacctagaacatcctaatcgaaatgcagcaaggggtacgagaactactgctccaccctcgtgctcacctccaacggcgtggactacgacggcgctaccacccaggggggtttctccgacgtgctcgtcgtcaatcaggactacgtcctccgcgtcccggagagcctgtctctcgccggggcggcgccgctgctctgcgccggcgtcacggtgtacagcccgatgatgcagtacggcctcaacgcgccggggaagcacctcggcgtcgtcggcctcgggggcctcggccacatggccgtcaagttcggcaaggcgttcaggatgaccgtcaccgtaatcagctcgtcgccgaggaagcgcgaggaggcgctcgagcgcctcggcgccgacgcgttcttggtcagccaggacgccgagcaaatgaaggctgcggcgggcacgatggacggaatcatcgacacggtgtcggcggggcacccgctcgtgccactgctggagctgctgaagccgatggggcagatggtggtggtcggcgcgccgagcgagccgctggcgctgccggcctacgccatcatcggaggcggcaagcgcgtagccgggaacggtgtgggcagcgtcagcagctgccaggcgatgctggactttcgcgggagcacggcatcaccgccgacgtcgaggtcgtcaa

SEQ ID NO: 46342 - protein, 154 aa, Zea mays
  misc_feature: Ceres CLONE 1451749-F
  misc_feature (9)..(144): Pfam Name: ADH_zinc_N Pfam Description: Zinc-binding dehydrogenase
  misc_feature: SWISSPROT Homolog: EC 1.1.1.255 Mannitol dehydrogenase
MMQYGLNAPGKHLGVVGLGGLGHMAVKFGKAFRMTVTVISSSPRKREEALERLGADAFLVSQDAEQMKAAAGTMDGIIDTVSAGHPLVPLLELLKPMGQMVVVGAPSEPLALPAYAIIGGGKRVAGNGVGSVSSCQAMLDFRGSTASPPTSRSS

SEQ ID NO: 46343 - DNA, 779 bp, Zea mays
  misc_feature: Ceres CLONE 1451751-F
  misc_feature (374)..(374): n is a, c, t, g, unknown, or other
  misc_feature (432)..(432): n is a, c, t, g, unknown, or other
  misc_feature (489)..(489): n is a, c, t, g, unknown, or other
tggagctccccgcggtggcggccgctctagaactagtggatcccccgggctgcaggaattcgcacgagaccattacctagaacatcctaatcgaaaactctcttctctatctcggtcggtatttcctccccttcgctggtcatctttgccgagggcctgcgtctcgctatctcttccctccgccctcctgctctcccgccgttgtagaaatttccctctcccacgcgtcctcccgctcccgtgcacttgtcactgcgcctagcccgctcgctcgctcccactcccgtacccatgtatcctctcaaccgtgaccagcctgtgtcgccacgttattgcctctgcctcgtcgcgccatgtacagagcgaccccattncacgacgggtgaagaaattgggttgtggaatgcatctgcagagattcccctttcgcangtagcgtcaggaaggctagatccgggaggcacaccgcccggaggaagagctggaacnatccaacgtccattagatgcatcggggtgtgctccctccctaagaatccaagtccaaatggccaaggatctggacaattccacctcaatccaccgggaggaggcctaaaatgggtgatatcctaattgcaaagattaaattttttcctggggaagggccattccaaaccgcgaatccaatttggggggccctttccgccctttctttaaaacaaacaaaaatgtggtgtttttttaaaaaaaaaaaaaaaaactttttttccccccccccccggggggggcccggacccc

SEQ ID NO: 46344 - DNA, 688 bp, Zea mays
  misc_feature: Ceres CLONE 1451753-F
  misc_feature: Encodes the peptide sequence at SEQ ID NO. 46345
ggagctccccgcggtggcggccgctctagaactagtggatcccccgggctgcaggaattcgcacgagaccattacctagaacatcctaatcgaaaaatcgtccatccgtattcccgtcacaactcacaacccgagccccccaaacccgaagcagcaggagctcccctgaccctgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccaccgcagggctacccgcagcagggctacccgccgcagtacgcgcagccgcctccacagcagcagcagagcagcgggccttccttcatggaaggatgcttggctgccctctgctgctgctgcctcctggacgcctgcttctgacggaaccatccgtgccgggtccaacacggctgcaagtgaagcaaccagcttacggaagagctggaactgggccgtgctattctagctttgtcctgcgttatcgccctcctttctttttttttctctctctctccctctggtaggagactacgggtactctgcccatggccattggataaaccagggcgggggggggatcgggggaagcccccgggtttcg

SEQ ID NO: 46345 - protein, 88 aa, Zea mays
  misc_feature: Ceres CLONE 1451753-F
MSYYGQQPPVGVPPQQGYPGKDGYPPAGYPPAGYPPPAQGYPPQGYPQQGYPPQYAQPPPQQQQSSGPSFMEGCLAALCCCCLLDACF

SEQ ID NO: 46346 - DNA, 773 bp, Zea mays
  misc_feature: Ceres CLONE 1451754-F
  misc_feature: Encodes the peptide sequence at SEQ ID NO. 46347
tggagctccccgcggtggcggccgctctagaactagtggatcccccgggctgcaggaattcgcacgagacctttacctagaacatcctaatcttgaacttgagtggaggatccgatcctaagctagaggactgagtcctgcggccgggagggacgcgggaccacgacgagcgtcgtcgtcggtgcctagcaacggcagttgtccctgtccagagcacaggcaagatggttaacgctatcaaggggctgttcatctcctgcgacgtacctatggcacagttcatcgtcaacctgaacgcgtctatgccgccgtcggagaagttcatcgtgcacatgctcgaccctaccaacatgttcgtgcagcctcaggtggcgcacatgatcaggagcaagatcgggggagttcagggacagaacacctacaacaagccgcagtagtgaaggatctaccggggtcctacactccttccttgggacttgctttcgttggccggattattcccgctgggaacgcgacccctcagggaaaacaaggccccaaataaatcccacccgtgcccttaaaaacaaacgggtttgggcttaaaacgggaaaaggccctttttcggggctccccttgggggaaaaaaaaaaaaaaaaaattttttttttccccccccccccgggggggggcccggcacccattccccctaatgggggggaaatacgcccccccctggcccctcttttttaaacaggggggggggaaaaacaccggggttcccccatttttc

SEQ ID NO: 46347 - protein, 70 aa, Zea mays
  misc_feature: Ceres CLONE 1451754-F
  misc_feature (1)..(70): Pfam Name: Tbf5 Pfam Description: Transcription factor TFIIH complex subunit Tfb5
MVNAIKGLFISCDVPMAQFIVNLNASMPPSEKFIVHMLDPTNMFVQPQVAHMIRSKIGGVQGQNTYNKPQ

SEQ ID NO: 46348 - DNA, 761 bp, Zea mays
  misc_feature: Ceres CLONE 1451758-F
  misc_feature: Translation starting site: 170
  misc_feature: SWISSPROT Homolog: EC 2.7.4.6 Nucleoside-diphosphate kinase
  misc_feature (378)..(378): n is a, c, t, g, unknown, or other
  misc_feature (379)..(379): n is a, c, t, g, unknown, or other
  misc_feature (433)..(433): n is a, c, t, g, unknown, or other
aaagctggagctccccgcggtggcggccgctctagaactagtggatcccccgggctgcaggaattcgcacgagaccattacctagaacatcataatcgaaaattcctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccagcccttctttcagggcctcgtggactacatcatctctggccctgtnngtggcatggtctgggagggcaagacgtcccccacactggccgcaagatcatggncgccaccaaccccctggcttctgagccgcgcaccatccgttggcaaatttgctgtccacctgggcaggaatgccattcatgaaagtgaccgccttgaaagggccaaaaaggaaatgcgccggggttccccaagggccctgctattggaaaaacacccccccccccggatctcacaaaaaaaaaaggggaaggtttcccccaaacctggaagccaaaagaaactggccccctttggggtttaaaagtgtttcaaaaaaaaaagaattgtttttgggaccctttttggggggcaattttttcttttttaaaaaaaaaaaaaaaagtttct

SEQ ID NO: 46349 - DNA, 770 bp, Zea mays
  misc_feature: Ceres CLONE 1451759-F
  misc_feature: Encodes the peptide sequence at SEQ ID NO. 46350
  misc_feature (767)..(767): n is a, c, t, g, unknown, or other
ctggagctccccgcggtggcggccgctctagaactagtggatcccccgggctgcaggaattcgcacgagaccattacctagaacatcctaatcgaaaaatagcttcgtctgtataccctaaatctctatagccaacacacacacaaatactctccattccattccatctcaaaggatataataatgggcggtctctccaccaagcttttcgtggtcctcctcctgctcgtttgttacaccgggacgcaaggcgggccggtgactatggtgtctgcgaggaactgctagtcgcagagcttccgcttcaagggaccttgctcgagggacgccaactgcgcatacgtctgcctgaccgaatgattcaccggcggagtgagcaagggcctacgccaccgctgcttctgcaccagagactgctagtactgcctcgtctcgcctcgcctctgctcgtgtcctgcgtgtgcatagccgcagcgaatcaataatacatgcatgcatgcgttaccgaatatttggcagtaccagcaagttaatggactaaataatatgtaatggaacacagcctgttttagacgtggaacagctgactgctaacatcgcacgtgtttattaggataaagaaaacaaaaaaagcttatcgatacagtcgacgtcgaggtgggacccggttcccaattcgacttatagtgagtcgtagtacgcgcgctcactgaccgtcgttatacaccgccctgactggtgaaaccctgacgtacccaacttaatgnctt

SEQ ID NO: 46350 - protein, 34 aa, Zea mays
  misc_feature: Ceres CLONE 1451759-F
MGGLSTKLFVVLLLLVCYTGTQGGPVTMVSARNC

SEQ ID NO: 46351 - DNA, 810 bp, Zea mays
  misc_feature: Ceres CLONE 1451760-F
  misc_feature: Translation starting site: 177
  misc_feature (672)..(672): n is a, c, t, g, unknown, or other
aaagctggagctccctgatctggcggccgctctagaactagtggatcccccgggctgcaggaattcgcacgagaccattacctagaacatcctaatcgaaaactagaacgccgccgccagtcctcactcctcaccatttcccaaaccctacccatacccccgccgccgccgccgccatgccgcccaagctcgacccgtcgcaggtggtggaggtcttcgtccgggtgacgggcggcgaggtcggcgcggcgtcttccctggcgcccaagatcggcccgctcggtctctccccgaagagatcggcgaagacattgccaaggagacggccaaggactggaagggcctgcgcgtcaccgtcaagctcactgtccaggaaccgcaaggcaaggttttcggttgtctcctgcggcgcccccccttgttataaaggggcctcagggagccccaaaggaaccggaagaagggcaaaaacatcaaggacaaggggaaaattggcctcaaagaactcctccaaaatccccggaccctgaagaaacgggcctgggccaaagatttggccggcaccgaaaagaaaacccccgggccccgggcacatggtggggggccccctaaagagaaaagaacccaaagactcctccccagggaaattgagacaggggagaggtaaaaatncccgcgccgttgaaaacaaaaaacccggagggggccccctctcggggggcgccgcacgaaatatttttttctcccacgcgggggaaaaatccctttttttgcaaggcacgggagggcgctctttatctttttttttgg

SEQ ID NO: 46352 - DNA, 811 bp, Zea mays
  misc_feature: Ceres CLONE 1451761-F
  misc_feature (246)..(246): n is a, c, t, g, unknown, or other
  misc_feature (247)..(247): n is a, c, t, g, unknown, or other
  misc_feature (249)..(249): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (301)..(301): n is a, c, t, g, unknown, or other
  misc_feature (302)..(302): n is a, c, t, g, unknown, or other
  misc_feature (306)..(306): n is a, c, t, g, unknown, or other
  misc_feature (311)..(311): n is a, c, t, g, unknown, or other
  misc_feature (312)..(312): n is a, c, t, g, unknown, or other
  misc_feature (435)..(435): n is a, c, t, g, unknown, or other
  misc_feature (458)..(458): n is a, c, t, g, unknown, or other
  misc_feature (462)..(462): n is a, c, t, g, unknown, or other
  misc_feature (463)..(463): n is a, c, t, g, unknown, or other
  misc_feature (483)..(483): n is a, c, t, g, unknown, or other
  misc_feature (509)..(509): n is a, c, t, g, unknown, or other
  misc_feature (510)..(510): n is a, c, t, g, unknown, or other
  misc_feature (525)..(525): n is a, c, t, g, unknown, or other
  misc_feature (536)..(536): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (575)..(575): n is a, c, t, g, unknown, or other
  misc_feature (590)..(590): n is a, c, t, g, unknown, or other
  misc_feature (595)..(595): n is a, c, t, g, unknown, or other
  misc_feature (624)..(624): n is a, c, t, g, unknown, or other
  misc_feature (655)..(655): n is a, c, t, g, unknown, or other
  misc_feature (656)..(656): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (680)..(680): n is a, c, t, g, unknown, or other
  misc_feature (684)..(684): n is a, c, t, g, unknown, or other
  misc_feature (688)..(688): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (714)..(714): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (735)..(735): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (751)..(751): n is a, c, t, g, unknown, or other
  misc_feature (756)..(756): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (780)..(780): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (791)..(791): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
aaagctggagctccccgcggtggcggccgctctagaactagtggatcccccgggctgcaggaattcgcacgagaccattacctaaaacatcctaatcgaaaagaccttgaattcccctgcctgttggcgtacgtgcctaagctagcttcgtcgtctcgttgcacgtacgtagtagctagacagccgaatcgggtctctagctagctcctcccttccgatcgatatcatcgccatgtcggggatctnngnttggacacggtggcgcccaaannnnccggggagcggtccggagaaaccccgnncgancccanngggttcggaaaggggtaaccccaaagggcaataacttgggggggggcgtaagagtgaggttgttccccccgctctaactaaggaaggggacacggggggggcgcctttaaagatggggggggnccatttacaccccaccccccccncccnnccaccccccccacaacacgncggccggcccggcggttcccccgttnnacccctccacccctnccacccaactnttnnnncccggaggagtatcgcgcccccaccacctcccnacagcgcccgacggnggttntcgccagtcgcccgaaaagagacccgccnttttaagagtttttgttggctccaccttttnnccgggttcccttnnnnnnnnactntttntttnagtnnntnnntccatatattcacgcngtgttccaccnnnnnntaaancccaatgccggnnncncaccntcnnnacnnnnnncggagacgctngnnnngcaggnactccnnnnnaaccccnnnn

SEQ ID NO: 46353 - DNA, 780 bp, Zea mays
  misc_feature: Ceres CLONE 1451763-F
  misc_feature: Encodes the peptide sequence at SEQ ID NO. 46354
  misc_feature (407)..(407): n is a, c, t, g, unknown, or other
ggagctccccgcggtggcggccgctctagaactagtggatcccccgggctgcaggaattcgcacgagaccattacctagaacatcctaatcgaaaaaaaacccaaaatcgaccttgtcgacccggatccgagctaggcacccgcacgaccacccgcctcctgccggtcaccgggacctagcatcgccgggtggcggcgggggaggggaaggtaggcgatgaggaaacgtgagcgggagaatccgtgcgggatctgcgggcactaccacaagtacgaggagggggaggtatgcggggtgtgcggccaccgctggaaaccgtcggacggggagggcgccccgtcgaggcacgagtccgcctcccccacagaggtgctcaaggacttcctcttcctcgggagctacgacnacgcctcacgctccgaggtcctcaggacgctcagtatctcccactcccttaatactgtgcctgatttgcaccatcctgtacagaatttccttccaatataaagccctcaacggggacaggctttgggattttgtgaggcaaccctttccttaaaaaagggaaaaaaaaaaacccgggggtcttggccttggaagaggggaaaaaacaggtcccgcgcttttggggcgcccctctttaaaaacccaagggggggaaacttccccctctttttctggggggaaaaacaaaaacccggggacacgggagaggtttctcaaaaagggtttttgggaaaaaggaaacatttttgacaaaaaaaaaaaaatggggccca

SEQ ID NO: 46354 - protein, 96 aa, Zea mays
  misc_feature: Ceres CLONE 1451763-F
  misc_feature (64)..(64): Xaa is any aa, unknown, or other
MRKRERENPCGICGHYHKYEEGEVCGVCGHRWKPSDGEGAPSRHESASPTEVLKDFLFLGSYDXASRSEVLRTLSISHSLNTVPDLHHPVQNFLPI

SEQ ID NO: 46355 - DNA, 753 bp, Zea mays
  misc_feature: Ceres CLONE 1451764-F
  misc_feature: Encodes the peptide sequence at SEQ ID NO. 46356
aagctggagctccccgcggtggcggccgctctagaactagtggatcccccgggctgcaggaattcgcacgagaccattacctagaacatcctaatcgaaaatgccctgcccctcctccgccttttcgcctctctccactttccccgtccttcgccgtcgcggccgcgtcctagtctgatggccagccgctgggtccgacccgaggtgtacccgctgttcgcggcgatgggagttgccgttggcatctgcgggtttcagctcttccggaacatcaccggcaacccggaagtcagggtaaacaaggcagggagggcagccggcgtgcttgagaaccatgaggaggggaggcgttacgccatgcatggcctcagaagctttgtgcacgacaagacccccgagatcatgccagctatcaacaagttctttactgaccccaagtgaagcaaagcagctttggttggccgctgatgacgatggttctgctactagttgcccttggggattgtgtaccctttttatggcaattcgatatgtgaatgagttcgacggtccctgtttgttcctcgtactcacctgtcatgtggatttgatgcacttaagtgataaaactgtcagccaacgttcattacaagtggatttttgcaaactggttatgtaaaggataagtaattgtaatttacaagtgttttagactttgtcttttatgctgtttaagaatatatatggtacacttgatctgatgtaaaaaaaaaa

SEQ ID NO: 46356 - protein, 87 aa, Zea mays; identical to SEQ ID NO: 40041
  misc_feature: Ceres CLONE 1451764-F
  misc_feature (2)..(88): Pfam Name: B12D Pfam Description: B12D protein

SEQ ID NO: 46357 - DNA, 712 bp, Zea mays
  misc_feature: Ceres CLONE 1451766-F
  misc_feature: Encodes the peptide sequence at SEQ ID NO. 46358
  misc_feature (399)..(399): n is a, c, t, g, unknown, or other
aaagctggagctccccgcggtggcggccgctctagaactagtggatcccccgggctgcaggaattcgcacgagaccattacctagaacatcctaatcgaaaatcttcgagagcttccgcacgggggaaggcggcgtggcgcgcctcctggaccacctggtcatcgtcaccatggacccggccgcctacgagggctgcagggccgtgcacagccactgctacttcctgcgcacgggcaacgccgtcgactaccgatcagagaaggtgttcatgagcaaggactacctggagatgatgtggggacgcaaccgcttccagcagacggtgctggagctgggatacaacttcctattcacggacgttgacgtgatgtggttccgcgacccgttcccgcacatcntcatggcggcggacatcgccattctcagcgacgtgtacatgggcgacccctacaggctgcgcaacttccccaacgggcggtttctccttctgggggcctccgaaaagaccgtcccccttctacgggcttgggaaccagggccggtggccccttctcgggaaaacccaaccagaactgtttcaaccctctcaaacccgaaaaagccccccaggtgggacccccccattcagtttcctgaaaaaggccaaaaaaaagggtttttcgcactttaacaaggcccccccacagggtttgtgcccccctccccccaaat

SEQ ID NO: 46358 - protein, 166 aa, Zea mays
  misc_feature: Ceres CLONE 1451766-F
  misc_feature (77)..(77): Xaa is any aa, unknown, or other
MDPAAYEGCRAVHSHCYFLRTGNAVDYRSEKVFMSKDYLEMMWGRNRFQQTVLELGYNFLFTDVDVMWFRDPFPHIXMAADIAILSDVYMGDPYRLRNFPNGRFLLLGASEKTVPLLRAWEPGPVAPSRENPTRTVSTLSNPKKPPRWDPPIQFPEKGQKKGFFAL

SEQ ID NO: 46359 - DNA, 821 bp, Zea mays
  misc_feature: Ceres CLONE 1451772-F
  misc_feature: Translation starting site: 173
  misc_feature: Pfam Name: DUF616 Pfam Description: Protein of unknown function (DUF616)
  misc_feature (376)..(376): n is a, c, t, g, unknown, or other
  misc_feature (704)..(704): n is a, c, t, g, unknown, or other
aaagctggagctccccgcggtggcggccgctctataactagtggatcccccgggctgcaggaattctcacaagaccattaccaacaacatcctaatcgaaaaatctaaaaagggcgcgtgggacaaggactgggtctaaataagacgacgctaatccaacgtagctgactaaatgccctattgctgcttcagcctgcactctgtagaactcctgatcctactgagcactctctttagcagaacgatcaccagcctctcaaagaagacactttgctttgctatgtttctggatgaactcccattgcaaactttacaatctgaaggccagaaaatggacggcatgggtttcattggtatatggaagatcatattgatnaaaaatatgccgtataatgacatgcgtagagtggggaaccaccccaatttttggcacacaggctatttccatcatcgaggttctcaatctggttagacaacaaactgagaacccaaactgatcctatcctttacctagagtattttctctggcgccatggttatgaatatgctatttccaatcactacgatcgccattgtgtttgggaggaagtcgcccaaaattaaaaacctgaaccaggtccaccacgcaaataatttgacccagcaaatttgaggtttttttcaagcccgaatggacttgacaaagggttcaaaccacatcttgnaatccctcaacagtgtctttctagccaacgcctattactctcctctgtaagggcgcctcttttcgtcccctccacgaagagagcactactctgcctggattgttcgcaaagccttta

SEQ ID NO: 46360 - DNA, 749 bp, Zea mays
  misc_feature: Ceres CLONE 1451774-F
  misc_feature: Encodes the peptide sequence at SEQ ID NO. 46361
aaagctggagctccccgcggtggcggccgctctagaactagtggatcccccgggctgcaggaattcgcacgagaccattacctagaacatcctaatcgaaaagtcatcatcccgattcccgacacgcttgtgttgtcgcgattggcaagctcggcggctcgtggcagcgggaacttacgaggcgaaggagagcgagggcgaccgcgcggatcgcatcgcagctctgggcggaggtggggccttgcgcggagatgctagcggtgttcgatcgggcggtggcgccgagcccggaggggctgcggcagccgggcgccgcggggggcggctgcgcggcgggcctcgcggaccggttcagagaggcgcggcccgacgcggtcaccgtcaaccttggcgggtccggcgccctggcgtactcctcgagcaaccagaaccccctcctccccaggttgtttggcgcggtggacggcgtattctgcatgttccagggaacaattgcgaacgttgctgtgctgaagcagcagtatgggttgagcaaaggcgctaatgaggtcagcatcatcatcgaggcttacaggaccttgagggacaggggcccttatcctgcagatcaggttgtgagggacataagtgggaaatttgcatttgtcctgtatgattgctccactaagtcggtcttcatggctgctgacaccgatgggaatgttccgttctactggggcgtggacaccgacgggcgtcttgtggtctct

SEQ ID NO: 46361 - protein, 166 aa, Zea mays
  misc_feature: Ceres CLONE 1451774-F
  misc_feature: SWISSPROT Homolog: EC 6.3.5.4 Asparagine synthase (glutamine-hydrolyzing)
MLAVFDRAVAPSPEGLRQPGAAGGGCAAGLADRFREARPDAVTVNLGGSGALAYSSSNQNPLLPRLFGAVDGVFCMFQGTIANVAVLKQQYGLSKGANEVSIIIEAYRTLRDRGPYPADQVVRDISGKFAFVLYDCSTKSVFMAADTDGNVPFYWGVDTDGRLVVS

SEQ ID NO: 46362 - DNA, 777 bp, Zea mays
  misc_feature: Ceres CLONE 1451778-F
  misc_feature: Encodes the peptide sequence at SEQ ID NO. 46363
  misc_feature (380)..(380): n is a, c, t, g, unknown, or other
atagctggagctccccgcggtggcggccgctctagaactagtggatcccccgggctgcaggaattcgcacgagaccattacctagaacatcctaatcgaaaaattgcctgccacagctcgccgcggacgccgtcgccgctcaagtgaagtccggagtgggggcttgcgatctccgctgcgggcgcggaagatggctgatccagagttggaagctatcaggcagagacggatgcgagaactacaacacggtgcggcaaatcagcaaaatgcgggccaagaaaaggctcaggaagacgcgaaacaggaagctgaggaacgccggcaaatgatgcttgctcagatattatcttctgaagcaagagaaaggctttcccgcatanctttggtcaaacctgacaaagcaagaggggtggacccacctttgctgagagctgctcaaactggtggaatatctgagaaggtgtctgaagaaagactcatctcccttctagagcaaattaacagccacacaagcaagcaaaccaaagttacgattcagaggcgtcggaatgtccttgacgacgatgattagatgcaacctgcaagtctctgcttcgagtgtactattggctggtgataaattaaaagtggaaccgaactgtttagaccatgatctcatgcgactatcagcagcaatgaaaacttggtcctgggaccttggtagactatttcattggaacattcggctggaaaaaaaaaaaaaaaaaagttttccgattccgccggacccccgggggg

SEQ ID NO: 46363 - protein, 126 aa, Zea mays
  misc_feature: Ceres CLONE 1451778-F
  misc_feature (9)..(117): Pfam Name: dsDNA_bind Pfam Description: Double-stranded DNA-binding domain
  misc_feature (64)..(64): Xaa is any aa, unknown, or other
MADPELEAIRQRRMRELQHGAANQQNAGQEKAQEDAKQEAEERRQMMLAQILSSEARERLSRIXLVKPDKARGVDPPLLRAAQTGGISEKVSEERLISLLEQINSHTSKQTKVTIQRRRNVLDDDD

SEQ ID NO: 46364 - DNA, 770 bp, Zea mays
  misc_feature: Ceres CLONE 1451780-F
  misc_feature: Encodes the peptide sequence at SEQ ID NO. 46365
aaagctggagctccccgcggtggcggccgctctagaactagtggatcccccgggctgcaggaattcgcacgagaccattacctaggacatcctaatcgaaagtcgcgtcttcttcagctacaccttccgcaccgcggctgaaaatgcgccgctgccccagatcgtcgtcgtgggctccgccgacatctacgtcgaggtccaccgatccccgctcatcggcgagacggccgcgcgggcggcaagggcgccaacctggccgcctgcggtgcgccctacctacctcgtggcgcgcgtcggggatgacgccaatggccgactactcgaggacgccctagccgacgccggcggcgttgcaccgaccgcgtcgcgcgcgcggccgatgcgccatcgggacacgccatagtcatgctcatgccccacgaccacaactccgtcatcatcgtgggcggggcgaacatggagagctgggcggcggggattggctcggaggacctggattgatccgaaaggaaaatgcagagggagatacccgattgagtcaatccgcaggctgcccaggcgcttgctttttatcaatctcagcttggtttgggcacacatttttctttttttttatgttactgtttgattattttgatctcaattagactgaatagggcaatgtagctttgagcgccaaaaaaaaaaaaaaaaaagcttatcgataccgtcgacctcgagggggggcccggtacccaattcgccctatagtgagtcgtattacgcgcgct

SEQ ID NO: 46365 - protein, 31 aa, Zea mays
  misc_feature: Ceres CLONE 1451780-F
MLMPHDHNSVIIVGGANMESWAAGIGSEDLD

SEQ ID NO: 46366 - DNA, 731 bp, Zea mays
  misc_feature: Ceres CLONE 1451781-F
  misc_feature: Encodes the peptide sequence at SEQ ID NO. 46367
taaagctggagctccccgcggtggcggccgctctataactagtggatcccccgggctgcaggaattcgcacgagaccattacctagaacatcctaatcgaaaaatataggcattcaatcattcaagcgaagcagccaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctccggcggcgcgcgggtggcgctcgtcggccaggccaccgacgaagggtgctcgctggggaagcgcctgacgctggcccagctcccgcagctggcggcgcgggccgggccgaggaagggcgggatcgcgctggtgctcaccgcgcaggacgtgggcgtggacgggttctgcacgagccgctgcggcctgcacggctccgacgcccgggcccccgggaccgcgtacgtctgggtcggcaactccgccacgcagtgccccgggcagtgcgcgtggccgttccaccggcctctgtacggtccccagacgccggcgctcgtgccgccgagcggcgacgtcggcgcggacggcatggtgatcaacatcgccagcatggtcgccggcgcggtgaccaacccgttccgcgacgggttctaccagggcgacaaggacgcgccgctggaggccgc

SEQ ID NO: 46367 - protein, 32 aa, Zea mays
  misc_feature: Ceres CLONE 1451781-F
MVINIASMVAGAVTNPFRDGFYQGDKDAPLEA

SEQ ID NO: 46368 - DNA, 788 bp, Zea mays
  misc_feature: Ceres CLONE 1451782-F
  misc_feature: Encodes the peptide sequence at SEQ ID NO. 46369
  misc_feature (510)..(510): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
aaagctggagctccccgcggtggcggccgctctagaactagtggatcccccgggctgcaggaattcgcacgagaccattacctagaacatcctaatcaaaaaaaaaacggccgtccctatctatcggattgcttccagttccagctcgagcactggggcttcgcaggcgagatgaagaggctgcttgctcatggccagtccggttgcccttcccggactttggttggcagaatccctgccctgcctgtactttgcaacaacgttcttcccgaccataggtactattcagccgagaaacacgatgacgacaccacgctaggtgagatcggggataaggcaaggtcgacagccgaggagttcctgagggtggccaaggagaagaccgacgacgtcgcggaaggcggcgaggacaccctgcaccaagaccattacctcgaacgtccctaatcaaaaaaaaaagccccacccccccccccccacccccaaggggggggccgggacccccaatcnccccaaaaagaaagccgattaaccgccccttgcgcggcccacgtattccaaggttccgaactgggaaaaccctggggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnng

SEQ ID NO: 46369 - protein, 91 aa, Zea mays
  misc_feature: Ceres CLONE 1451782-F
MKRLLAHGQSGCPSRTLVGRIPALPVLCNNVLPDHRYYSAEKHDDDTTLGEIGDKARSTAEEFLRVAKEKTDDVAEGGEDTLHQDHYLERP

SEQ ID NO: 46370 - DNA, 771 bp, Zea mays
  misc_feature: Ceres CLONE 1451788-F
  misc_feature: Encodes the peptide sequence at SEQ ID NO. 46371
  misc_feature (652)..(652): n is a, c, t, g, unknown, or other
  misc_feature (718)..(718): n is a, c, t, g, unknown, or other
  misc_feature (771)..(771): n is a, c, t, g, unknown, or other
aagctggagctccccgcggtggcggccgctctagaactagtggatcccccgggctgcaggaattcgcacgagaccattacctagaacatcctaatcgaaaaatagtagcggtggcacagacctcacacacagcccacctccgacgacacggcgaaatcgaaatcgaaatcatccggggtcttccagcgatggaagcccgacccagcaggatagagtgctcagaacccaacgagcaccccgagccgaaggaccccggccgggtgttccacgccgagcgcgtcgccccgagggacgccacggagtcggtaaccgagaagctggcgcacggcggttgcggccacgacggcgtgatcgacgagacgtacgacacgaggatcaagatcgcggaggcactggaggcgtcggccagggccatcggggacaagcacgtggagccgtccgacgccgcggcgatacgcgtcgcggaggcgagcgccgcggggcgtggggcgatcccaggcggcgtctccgagcgcgcgcaggccgcggtggcggccaacgcccgcgccgcgcgcgacgaggacaaggtcaccatggccgacgtgctgacgtgggaggcgacggtgaagctgccgacgggcaaggccgtgactggcgaggtcgctgcggccgncgcagaagccgaggccgaggcccgcgatgatccccgagcgaagacgaacccccgcggggtgagcgncgcgctgggcatggccgcgaagcacaactgtggacacgagagcgcgcgcacgn

SEQ ID NO: 46371 - protein, 194 aa, Zea mays
  misc_feature: Ceres CLONE 1451788-F
  misc_feature (62)..(122): Pfam Name: SMP Pfam Description: Seed maturation protein
  misc_feature (155)..(155): Xaa is any aa, unknown, or other
  misc_feature (177)..(177): Xaa is any aa, unknown, or other
MEARPSRIECSEPNEHPEPKDPGRVFHAERVAPRDATESVTEKLAHGGCGHDGVIDETYDTRIKIAEALEASARAIGDKHVEPSDAAAIRVAEASAAGRGAIPGGVSERAQAAVAANARAARDEDKVTMADVLTWEATVKLPTGKAVTGEVAAAXAEAEAEARDDPRAKTNPRGVSXALGMAAKHNCGHESART

SEQ ID NO: 46372 - DNA, 955 bp, Zea mays
  misc_feature: Ceres CLONE 1451791-F
  misc_feature (14)..(14): n is a, c, t, g, unknown, or other
  misc_feature (15)..(15): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (308)..(308): n is a, c, t, g, unknown, or other
  misc_feature (465)..(465): n is a, c, t, g, unknown, or other
  misc_feature (466)..(466): n is a, c, t, g, unknown, or other
  misc_feature (955)..(955): n is a, c, t, g, unknown, or other
ccgcgttgttcccnncacaccaccacnnnnncttcnnnnttcaaactggagctccccgcggtggcggccgctctataactagtggatcccccgggctgcaggaattcgcacgagaccattacctagaacatcctaatcgaaaatttcaattacctgcttccggcagcggtacgatggccgctgcgagaatggcgctcgtctcttgagacggccgcctcccgtccttacgctctccgctcaccctctcgaggccccgcgccggcgccgtctcatttctggctgcccagccgtctccggcgacggcaccnaaatccggcaggaatcttgctctcttctgctccttatcaccgacatcgccatccctaactgaagccgccgtagcactgcccctccctgagtggtgttgtgggatgacccccaccccccttgtccttagtgtggttgaaaaagggggaaaccgacctnnccccccaaccaaatgtgacctgggtggaccttcccgcctgggaccaaacggggaccaagccctggaaaggaccccggaagggggggcccccccccctctccctttaatcgagggggggtgacgctacgcggaggggcggggaaagccgccggaacccgatccctgcgtttgggggtgcttttttaaactttccctccccccccctcccaaagagcactccgcggggtggtgagtgggccgttctttggtgttcgtagtggctcaccctgtctacctcataggatccattggggcggtggccgttctggcggtagacgggtggatgggcccatgtggttgctccctctggtctctttgttttgggtagaaaagggagtggagttctgtgttacccgtgtacgtgaggtcgttcttcacgggctgctacacagaggttgtgtcccgggccgcccgaagggagagaggttctggttatctactgctccgttn

SEQ ID NO: 46373 - DNA, 732 bp, Zea mays
  misc_feature: Ceres CLONE 1451793-F
  misc_feature: Encodes the peptide sequence at SEQ ID NO. 46374
ctggagctccccgcggtggcggccgctctagaactagtggatcccccgggctgcaggaattcgcacgagaccattacctagaacatcctaatcgaaaatttttttccccagtactctactcacccacccactcacggactcatctactgagcagcgcggtgggcatccgagcgagagggcgagcgcggaaggatcggaattccgaaggttgggcatggaggcgagcggcgagaaggctgcggtggtgcgacggctgatggaggcgaaggaggtgtccgggaagaccttctcgggaatcgccgccgagacgggtctcaccaacgtctacgtggcgcagctgctgcggcgccaggcgcagctcaaggccgatacggtgcccgcgctgagggcggccctgcccacgctcaccgacgacctcatcgaactcatgatgcagccgcccttccggtcctaccaccccaacatcgtccacgagcccgccatttacagattgaatgaagctgttatgcattttggagagagcatcaaggaaatcatcaatgaggagtttggtgatggaatcatgtcagccatagacttctattgttcagttgacaaggttgaaggggccgacggaaaagatcgtgtggtggtcacatttgatgggaagtatctaccttacactgaacagaaatctgaacatatgatgtctaggccaacccgcaagacatcttgatgtggctggtgaggagg

SEQ ID NO: 46374 - protein, 166 aa, Zea mays
  misc_feature: Ceres CLONE 1451793-F
  misc_feature (79)..(152): Pfam Name: Cyanate_lyase Pfam Description: Cyanate lyase C-terminal domain
  misc_feature: SWISSPROT Homolog: EC 4.2.1.104 Cyanase
MEASGEKAAVVRRLMEAKEVSGKTFSGIAAETGLTNVYVAQLLRRQAQLKADTVPALRAALPTLTDDLIELMMQPPFRSYHPNIVHEPAIYRLNEAVMHFGESIKEIINEEFGDGIMSAIDFYCSVDKVEGADGKDRVVVTFDGKYLPYTEQKSEHMMSRPTRKTS

SEQ ID NO: 46375 - DNA, 795 bp, Zea mays
  misc_feature: Ceres CLONE 1451795-F
  misc_feature: Encodes the peptide sequence at SEQ ID NO. 46376
  misc_feature (231)..(231): n is a, c, t, g, unknown, or other
  misc_feature (344)..(344): n is a, c, t, g, unknown, or other
  misc_feature (345)..(345): n is a, c, t, g, unknown, or other
  misc_feature (349)..(349): n is a, c, t, g, unknown, or other
  misc_feature (350)..(350): n is a, c, t, g, unknown, or other
cgtggatcccccgggctgcaggaattcgcacgagaccattacctaaaacatcctaatcgaaaaatctactcgattacagatccaacagaaaaacttccaagatgtctacgtttaacggcgacgaaacagcacccttcgacggtttcctccgcgccgcagccgcccccacctcttcctgtatgggggctgcttatggaagggaaaaaagtggagttggtgtggattcaaagncagtgatgagacccgagctagagatgaaatccagtggccctgatgccatggctgatgtctaggagatgatggaagtgttcatcgccgaggactacatgaacaagtttggttannagannaaaaattaataactcctggaaatacaggggcctttcgtgggagggttgtgcctaatgggactccccgacccccaccgcaaccaagggaaagcccccataaatcgggatatgattggtgttaaggccgatctggctcagtccgcacgacaaacctttcggatctccagaattctgaagaatcactctaacccaaaaccggctccttaattcacgggccaggtttgccggaaaggcaccccccacaccttaccacccggacaactattgaattaataacggaaaaaaaaacaccaaagcggtaccaaccaattgcccctcaatccagggtgtaattaaacagtgcaagaccgtggcaatgcgacgaacattgcaccacgcactctgtgagaggcttgggttacgaccaactcacagcgggtctcagagcgagtaactaattaggtgg

SEQ ID NO: 46376 - protein, 63 aa, Zea mays
  misc_feature: Ceres CLONE 1451795-F
  misc_feature: SWISSPROT Homolog: EC 3.6.3.14 H(+)-transporting two-sector ATPase
  misc_feature (44)..(44): Xaa is any aa, unknown, or other
MSTFNGDETAPFDGFLRAAAAPTSSCMGAAYGREKSGVGVDSKXVMRPELEMKSSGPDAMADV

SEQ ID NO: 46377 - DNA, 829 bp, Zea mays
  misc_feature: Ceres CLONE 1451798-F
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
aaaactggagctccccgcggtggcggccgctctagaactagtggatcccccgggctgcaggaattcgcacgagaccattacctagaacatcctaatcgaaaaatcatctctctccccattgccaccatcatcacctccatatcccctcgccatcacgcctgcctgcctgcctccctccctccctcctcctttgcactaccgccgctacaaaagagcacaccgcctgcgacctagtgctgccctgttcgtcacaattcacgtacacgacgacgagacgacccctgcgggcagatcttatcttccttgacctagccagttgtgcaggcgccttcgggggccggggcctctccatctgaatgttagaataacccacccaaaggggcgtcaactccaacttctccaatttgggcttttttccccccgtttttaacccnnnnnggggggaaaaggcccggaaaccccccaaaaaggggttgggtacaccccaaagggcggaaagcccctttttccccccccggggccctgggggggggcctaaaggagaaattaaacccccccgggggggtaaaccccaaaagggtcccccgttcctctgtggggccccgcccaggggtgtccccctcccccccaaaaaacaggggggccccccacaaaaaaaaaaaaaaaaaaaaacttttctccccaataaaagacttttttttctccgcggggggagataaacccccaagaaggtatttccccagggggggcccgcccccccccgccgaaagaaatctctcccccctcttgtgggtggaaaaaaaaaaacccccccttcttgggtggaaga

SEQ ID NO: 46378 - DNA, 824 bp, Zea mays
  misc_feature: Ceres CLONE 1451800-F
  misc_feature: Encodes the peptide sequence at SEQ ID NO. 46379
  misc_feature (371)..(371): n is a, c, t, g, unknown, or other
aagctggagctccccgcggtggcggccgctctataactagtggatcccccgggctgcaggaattcgcacgagaccattacctagaacatcctaatcgaaaaatcacctcagtcctcacactgacatttcactctcggctgctggagtgtcggccgctgccatctgcctgccgctcactcccacgcgccgcaatgtgccactccccactcggcgccgccaccaccaccgcgggggcgctagcgctcctcttcctcctgccgctagcctcggccgccgccgccggcggcggcaccgcggcgaaggcgacgcccaacatcacggcgctcatgtccaagggcgggtgcaaggcgttcgcgtcgctgctggaaaancccccgaccctctgtcggcgttcgattcggcgggaacccccccccccaccgccttctgcccaaacgaaaaaggccggccccggtttcatgcccagcttccggaaccctgaccccgaaccgaaagcgcccccttgcgctgtttccacggcggggcccgggtaataaaccctggggggggccttaaaacaaaaaaaggggcccaataaaaacttgggcccaccaacggcgccccccgaaaaaaaaaaccctgagggtgtaaaaaacgggcgtaacaaggaactcttttaaaaacctggggggcaaaaaccccgcccccccgggcgccccccctctataaaaaaggggaccccccccccataactcttggaacccgggtgtgcgcacccttggaagtttatcccccggtggggggagaatcaacaacccccgccccgatattacggtggttgggtg

SEQ ID NO: 46379 - protein, 113 aa, Zea mays
  misc_feature: Ceres CLONE 1451800-F
  misc_feature (60)..(60): Xaa is any aa, unknown, or other
MCHSPLGAATTTAGALALLFLLPLASAAAAGGGTAAKATPNITALMSKGGCKAFASLLEXPPTLCRRSIRREPPPPPPSAQTKKAGPGFMPSFRNPDPEPKAPPCAVSTAGPG

SEQ ID NO: 46380 - DNA, 772 bp, Zea mays
  misc_feature: Ceres CLONE 1451806-F
  misc_feature: Encodes the peptide sequence at SEQ ID NO. 46381
  misc_feature (772)..(772): n is a, c, t, g, unknown, or other
atagctggagctccccgcggtggcggccgctctagaactagtggatcccccgggctgcaggaattcgcacgagaccattacctagaacatcctaatcgaaaaagtcttcacttccattccaccggctccgatcccaactgccatggcgctctccatctacacgcccacctcctcctccctcgtcccgccctccattcaggaggtcaggttgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgtgtttgatgataacaagaggttcgcacccacggcggccacattgagctcgccccccccgcgggggatcactgggctcccagacactaagttcaagagtgccatacatactgcactggcaaaaggtgagtgcaacgcactggagaaggccgaggacacgatgtcctggttacccaccaaggctcttgcaaatctcggccctgaactcgctcatcaagcccctgggagatcttcaacggaaataaatgcccggttagcttatgaccccccagggcataatccccccgggtcacatgcaacgggtaaattctaaacaacccaccgtaaagtcctcaaccgagcccctgggttcattataaaatcccgcttaccttggcaaaggcatatccaagccctctaagtttgn

SEQ ID NO: 46381 - protein, 178 aa, Zea mays
  misc_feature: Ceres CLONE 1451806-F
  misc_feature: SWISSPROT Homolog: EC 2.2.1.2 Transaldolase
MALSIYTPTSSSLVPPSIQEVRLTSRPPKPATFSLRRPHLAARAAAGNAPTSPVREVVTELDAVAGFSEIVPDTVVFDDNKRFAPTAATLSSPPPRGITGLPDTKFKSAIHTALAKGECNALEKAEDTMSWLPTKALANLGPELAHQAPGRSSTEINARLAYDPPGHNPPGSHATGKF

SEQ ID NO: 46382 - DNA, 772 bp, Zea mays
  misc_feature: Ceres CLONE 1451808-F
  misc_feature: Encodes the peptide sequence at SEQ ID NO. 46383
aaagctggagctccccgcggtggcggccgctctagaactagtggatcccccgggctgcaggaattcgcacgagaccattacctagaacatcctaatcgaaaaatcaactcacaattccgcattcgatccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgctggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgctaagtcccccaagaaggcatagactgactggtccggtgtgatctgatgtttagcagtaccttgttaccagtatgcggtgatgcgtaggctgtagatgggacgaatgtgctggctgtgtgtatgtgtcc

SEQ ID NO: 46383 - protein, 159 aa, Zea mays
  misc_feature: Ceres CLONE 1451808-F
  misc_feature (31)..(104): Pfam Name: Histone Pfam Description: Core histone H2A/H2B/H3/H4
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSGGSKEAKSPKKAAKSPKKA

SEQ ID NO: 46384 - DNA, 762 bp, Zea mays
  misc_feature: Ceres CLONE 1451809-F
  misc_feature: Encodes the peptide sequence at SEQ ID NO. 46385
aaagctggagctccccgcggtggcggccgctctagaactagtggatcccccgggctgcaggaattcgcacgagaccattacctagaacatcctaatcgaaaaaaactattctaaaaaatgggctaaaaaaaatcgaccgtcttcctcccaacccaagtggatgtgcaggaccgcgaacacgaggaggcaggggagcagcatccacaaccacaagccatggcggggaggactaacatccccactaacaactccgccctcatcgcaatcatcgccgacgaggacaccgtcactggcttcttgatggccggcgttggcaatgttgatctgcgcaagaaaaccaattacctcctcgtcgacaacaagacgacagttaaacaaatcgaggacgcgttcaaagaatttactgcaagggaggatattgctattgtgctcatcagtcagtatattgccaacatgataagatttctggtggatagctacaacaagccagtccctgctattctggagatcccatccaaggaccatccatatgatccagcgcacgactcggtgctgtctcgagtgaagtatctcttctctgcggaatcggtggcgtctgataggcgatgaaggcatccttgtgtagtagtaccctttggtgtatctgttttgttatgtattgaaaagaagtggcatgcgtccgagcgagacagcaaacaatactaatggttgtggaaccaaaccaacacttttttttctttcataaaaggttggaatgcgaaa

SEQ ID NO: 46385 - protein, 130 aa, Zea mays
  misc_feature: Ceres CLONE 1451809-F
  misc_feature (15)..(115): Pfam Name: ATP-synt_F Pfam Description: ATP synthase (F/14-kDa) subunit
  misc_feature: SWISSPROT Homolog: EC 3.6.3.14 H(+)-transporting two-sector ATPase
MAGRTNIPTNNSALIAIIADEDTVTGFLMAGVGNVDLRKKTNYLLVDNKTTVKQIEDAFKEFTAREDIAIVLISQYIANMIRFLVDSYNKPVPAILEIPSKDHPYDPAHDSVLSRVKYLFSAESVASDRR

SEQ ID NO: 46386 - DNA, 762 bp, Zea mays
  misc_feature: Ceres CLONE 1451811-F
  misc_feature: Encodes the peptide sequence at SEQ ID NO. 46387
  misc_feature (249)..(249): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (409)..(409): n is a, c, t, g, unknown, or other
  misc_feature (410)..(410): n is a, c, t, g, unknown, or other
  misc_feature (412)..(412): n is a, c, t, g, unknown, or other
  misc_feature (429)..(429): n is a, c, t, g, unknown, or other
  misc_feature (444)..(444): n is a, c, t, g, unknown, or other
  misc_feature (446)..(446): n is a, c, t, g, unknown, or other
  misc_feature (454)..(454): n is a, c, t, g, unknown, or other
  misc_feature (455)..(455): n is a, c, t, g, unknown, or other
  misc_feature (461)..(461): n is a, c, t, g, unknown, or other
  misc_feature (468)..(468): n is a, c, t, g, unknown, or other
  misc_feature (471)..(471): n is a, c, t, g, unknown, or other
  misc_feature (480)..(480): n is a, c, t, g, unknown, or other
  misc_feature (491)..(491): n is a, c, t, g, unknown, or other
  misc_feature (493)..(493): n is a, c, t, g, unknown, or other
  misc_feature (496)..(496): n is a, c, t, g, unknown, or other
  misc_feature (517)..(517): n is a, c, t, g, unknown, or other
  misc_feature (554)..(554): n is a, c, t, g, unknown, or other
  misc_feature (557)..(557): n is a, c, t, g, unknown, or other
  misc_feature (637)..(637): n is a, c, t, g, unknown, or other
  misc_feature (654)..(654): n is a, c, t, g, unknown, or other
  misc_feature (664)..(664): n is a, c, t, g, unknown, or other
  misc_feature (684)..(684): n is a, c, t, g, unknown, or other
  misc_feature (738)..(738): n is a, c, t, g, unknown, or other
  misc_feature (741)..(741): n is a, c, t, g, unknown, or other
  misc_feature (747)..(747): n is a, c, t, g, unknown, or other
  misc_feature (759)..(759): n is a, c, t, g, unknown, or other
gcggtggcggccgctctataatagtggatcccccgggctgcaggaattcgcacgagaccattacctagaacatcctaatcgaaaaatcctcccgcagccgtcgccgcccgccagcccgccagcgagagaagtccgcttcatccgttcgccgcctcaaggacgagatggacacatcaagccctgcaggcacttgtcactgcacagatgctgaacatgtttgttgggcgaagagtgcgcacggttgttcgnatcccacacaatgaaggtggagtgcttgtcgggcactcccccgatgggcaccagttgggtggcaaaagtgcatggacgtccccgtatcaggttatatggagggtttatggaatgttgaaagtggtgaaccatttgtgttgaccccccttcgtttnnnggnncnaagtttgatcccagggnatttgaagagtttgncnaacctctnnagtggnagggttnggngaaggtttntggtgagaaancnctngatgggaggaattttttcccnctctaccttttgttaaacatgaaggttgcggttttanttntagagttggggatagggccccatatttttttttggtcgctctttgcagccccgtgctacctcctcggactaggagcttantttttattgtaagcccncccgtatggnagtgggcagctggactcganataaattaagtggtgctgtgtagcccctctcggggcgtttcttatcaatcattntgncccccncctccgctccanacc

SEQ ID NO: 46387 - protein, 61 aa, Zea mays
  misc_feature: Ceres CLONE 1451811-F
MLNMFVGRRVRTVVRIPHNEGGVLVGHSPDGHQLGGKSAWTSPYQVIWRVYGMLKVVNHLC

SEQ ID NO: 46388 - DNA, 548 bp, Zea mays
  misc_feature: Ceres CLONE 1451812-F
aaaagctggagctccaccgcggtggcggccgctctagaactagtggatcccccgggctgcaggaattcgcacgagaccattacctagaacatcctaatcgaaaaatcacgcctcgtcctctccgtcccgaccagaatcatcgcttcttcctgctccggcgatatccgccgccgcctgcggtccggccgagatggggagcacttcctctatgctcacccaatacgaatatcgagggaggtcccagggaccatttgtaaccccccccatttcccgacagggaaccaaaccccctttacccccgttttgcccctttacgaaggggggggttccccccaaaatttgggggcccaggtcccgaaaaccccccccaagcccgggggggggggggccccccgggggggggcatttttgccttttccccccccccccccgcaaaaaaaaaatttttttcgcgggaaaaaaaccccccccgggggggttttttaaaaacccccaccccggagggagggggtttttttttaaaaaaaaaaaaaaaatatttttttttt

SEQ ID NO: 46389 - DNA, 759 bp, Zea mays
  misc_feature: Ceres CLONE 1451816-F
aaagctggagctccccgcggtggcggccgctctagaactagtggatcccccgggctgcaggaattcgcacgagaccattacctagaacatcctaatcgaaaactggcttcatgggggcgcagatttccacgaactcctccatgcgctcgcgggcgccgacggacaagacaaatagtaattggacgccgcggcctccttccgtcgctatcaatagccgccggcctgctcggagaagcgaaggaccatgtaacgcggcatcaggcgccgcccctggggcaaatggagcggcggagatccgggaacgagccgagggcgcgcgcgtctggcacgatggcttacccactagaagaggccgacgcgcacgcctaggaccgactagcgcggcgtatggggggaggccacgcgcccgccaagttccccagggaggacccgcggccagattaccaccaccatgaccacggaggccctgacgaacaaggcgacgcgcttcatgtaatgcaccacatgctcccggttatatggaagtgtgaaccatttccacgtaccattacgtctatttcagagcatgtacgatgtcttcaagcctgaatagtacgtgcaccagctgttgccctgtgaagaactggagccctcatgctatcatgagcgcgagcggcccacattatatgatgttataggtacttcgaacatgaagctgtgtattgcccacttcatgcagtccccgtgccaatgtgatgtgctctccatgccgtcgaccgc

SEQ ID NO: 46390 - DNA, 769 bp, Zea mays
  misc_feature: Ceres CLONE 1451822-F
  misc_feature: Encodes the peptide sequence at SEQ ID NO. 46391
  misc_feature (655)..(655): n is a, c, t, g, unknown, or other
aagctggagctccccgcggtggcggccgctctagaattagtggatcccccgggctgcaggaattcgcacgagaccattacctagaacatcctaatcgaaaaggtcctccattcaagctccactccacacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaaccaggagattgcgtgcgccgcaggacgcgctgagacacaaggcatcatccctatcccacggtgaccgtggaagccctaggagtgcaggggtcgtcgttcctggtgaacgtgttctccgacaagagctgcccggggctgctccgtcccgtgctggaggccttcgacgagctggggctcagcgtgctccaggccaccgcgtcctgcgccgactccttccgcctcgaggccgtgggcggagagaacgtgncggacaacgtggacgagcacgtcgtgaagcaggcagtcctgcaggccgtcaggagctgctccgagggcggcagcgagcacgacgacgaggagtagtagctatagcaagaagcta

SEQ ID NO: 46391 - protein, 62 aa, Zea mays
  misc_feature: Ceres CLONE 1451822-F
MMSRERKKAAALQEKLKILRSITHSHALSNTSIIMDASAYIKELKQKVVRLKPGDCVRRRTR

SEQ ID NO: 46392 - DNA, 766 bp, Zea mays
  misc_feature: Ceres CLONE 1451824-F
  misc_feature: Encodes the peptide sequence at SEQ ID NO. 46393
  misc_feature (760)..(760): n is a, c, t, g, unknown, or other
aaagctggagctccccgcggtggcggccgctctagaactagtggatcccccgggctgcaggaattcgcacgagaccattacctagaacatcctaatcgaaaaacggaacttccggtgccagcggcgaccacttgtggggatccatccctcagcatgtctccgaaggaagagggggcgctcgccgccgtgctcgatgacagccataaccatatttgcacctcatcatccggaaggaaataccttctactgtggtttatcgacgacgagaaggtactggatttcatgcacataaaccctcaagctccaagacacattctgatcatccccaaagtcaacgatggactacctggcctgggaaaggctgaaaagaggcaactagaactacttggatatctcctctaagttgccaaggttgttgccaaccaagaacgacttgaagatggctatcacgtcgtcatcaatgaaggtccaagtggatgtcaatctgtttaccacatccacgttcatctcctcagatgcaggcaaatgaactggcccccaggctaacaatatcttgtgattgatcagtgctaatgcccaggactgctactccatttcactagaataatccctgtaatttccataacagctagtgcgcaatgcgctgaccttgtgctatatttgtgcaattaccggaaccatgctgctgtaatctataattggacacaaccaacttgtacctgctactcctatcatcgagtgacttgtacatattgatcgnctgatg

SEQ ID NO: 46393 - protein, 82 aa, Zea mays
  misc_feature: Ceres CLONE 1451824-F
MSPKEEGALAAVLDDSHNHICTSSSGRKYLLLWFIDDEKVLDFMHINPQAPRHILIIPKVNDGLPGLGKAEKRQLELLGYLL

SEQ ID NO: 46394 - DNA, 778 bp, Zea mays
  misc_feature: Ceres CLONE 1451825-F
  misc_feature: Encodes the peptide sequence at SEQ ID NO. 46395
  misc_feature (394)..(394): n is a, c, t, g, unknown, or other
  misc_feature (404)..(404): n is a, c, t, g, unknown, or other
  misc_feature (406)..(406): n is a, c, t, g, unknown, or other
aaagctggagctccccgcggtggcggccgctctagaactagtggatcccccgggctgcaggaattcgcacgagaccattacctaaaacatcctaatcgaaaaagagaaacacctctgagcattctaaagctcatagccctctccttccagagcatttcacatcgctctcatctccacctgcttgcatccagcgcctcgtcactctgcaaaacaacagcacatacctccaaaggatgagccgcagcagcaggaagagctctaggggccttgacctgaaactgaacctctcacttcctgcaacaggggactcctccagtagggcgatggctgatgatgagtcatctccgagctcctgcctatcgtcagagaacgagcatggcctgcagtggtccancagccctgangncacatccatggattctgctgcatgtccacactgcttcatctacgtcatgctccaacaaaatgacccttcgtggccccagtgcaagaggcctggttccccttgaacttttgggggaaaacaaccgcggtaaaaacaaaaaaaataatttcccccagggagaccggggggggaaaaacaatttgggtttctttggggggcgaaccccaaaaaaaaaattttttgaacgcccagggcccaggaacttatttttccaaggttttccccggggaaagggggaatttccctcttaaaatggaaaaagaaccccccccggggggaaccccaattttgtaaaaccccaaacacgcgggggggggggaggttctttccccc

SEQ ID NO: 46395 - protein, 91 aa, Zea mays
  misc_feature: Ceres CLONE 1451825-F
  misc_feature (54)..(54): Xaa is any aa, unknown, or other
  misc_feature (57)..(57): Xaa is any aa, unknown, or other
  misc_feature (58)..(58): Xaa is any aa, unknown, or other
MSRSSRKSSRGLDLKLNLSLPATGDSSSRAMADDESSPSSCLSSENEHGLQWSXSPXXTSMDSAACPHCFIYVMLQQNDPSWPQCKRPGSP

SEQ ID NO: 46396 - DNA, 746 bp, Zea mays
  misc_feature: Ceres CLONE 1451826-F
  misc_feature: Encodes the peptide sequence at SEQ ID NO. 46397
ctccccgcggtggcggccgctctagaactagtggatcccccgggctgcaggaattcgcacgagaccattacctagaacatcctaatcgaaaaagcgtccgtccccaaaccctaccgcagtcgccgccaccgtctcccctcctgatccaatccaatggcgcgcctccacctcgtggccgtggcaatgggcttgctcttggacttgacgacggcacacgcaccgggcgcgtccacagatgcccgcaccaatggcacagcctccggcaacctcggtgcctcctcgtcccgcgccatcaccgacccataagaccgctccagctccggcgccaaatgccacggtacccgcccccgcctcgccgccggctccgagctctataggacagacgccgacagatgcaccatcatcccctccgccgcccagcaccgcgtcaaacgttgcctccaccttgtacctggccgacgctatgacccctgtcatgtttttcttctgaggtcctgactcagcgcctatggaaccacagcctatggtatgttaccgtcccctgtgtatatgacatcaaggatcccgctaccgctgggctagtttgcttattatcatactactactcaatcaatacttgggttgatcacatcagatatagcgttttatatgagtgcggatattatttcttctacgcatctgcgcactacggttatgtcactatggatgccattgttattaacgaaggcgaaaacttctaattagaa

SEQ ID NO: 46397 - protein, 84 aa, Zea mays
  misc_feature: Ceres CLONE 1451826-F
MPAPMAQPPATSVPPRPAPSPTHKTAPAPAPNATVPAPASPPAPSSIGQTPTDAPSSPPPPSTASNVASTLYLADAMTPVMFFF

SEQ ID NO: 46398 - DNA, 803 bp, Zea mays
  misc_feature: Ceres CLONE 1451831-F
  misc_feature: Encodes the peptide sequence at SEQ ID NO. 46399
  misc_feature (345)..(345): n is a, c, t, g, unknown, or other
  misc_feature (403)..(403): n is a, c, t, g, unknown, or other
aaagctggagctccccgcggtggcggccgctctagaactagtggatcccccgggctgcaggaattcgcacgagaccattacctagaacatcctaatcgaaaaattcggtcgttccaattccaccaatctgtctcccaatcgttcttgctgttccaattccctctctttgctcagccacttcatcgggataggacgggaagatgaccgtggagaacgcggacgcgagactttccgacttctacacccaattcgatcgcctcttcggttctccggactccgcatccgacagagaggtgaagctgatgctcttcctgcccaactcgcagcatggctcctccctcatcntggtgccgcaattgtacgtgctggcaccggtggatctacgagcggttgaagcactggnagggtaagaccgggcgcctctgcctgctacctccgggaccatgccctttgaccccaccccgccccccgggggaggtggaccccagttcgggctaagggctgcccaacctaaccccttgaaaggagggacccccctcccccctcggggaaccaaaagcctcccttaagggaaaaggtaccccctccttttgtctggggaaaaaataagaagagaaaatttttttccccttgggggccaacaggggggagggcgccttaagaatggggggtggtttaaaaaaatatatcccgcgccacaaaggggtggttgtgggggatatttttttttttttttataaaaaaaaaaaaaaaaattttttttcccccccccccggggggggggggggcgccctcccttcttt

SEQ ID NO: 46399 - protein, 69 aa, Zea mays
  misc_feature: Ceres CLONE 1451831-F
  misc_feature (49)..(49): Xaa is any aa, unknown, or other
  misc_feature (68)..(68): Xaa is any aa, unknown, or other
MTVENADARLSDFYTQFDRLFGSPDSASDREVKLMLFLPNSQHGSSLIXVPQLYVLAPVDLRAVEALXG

SEQ ID NO: 46400 - DNA, 766 bp, Zea mays
  misc_feature: Ceres CLONE 1451832-F
  misc_feature: Encodes the peptide sequence at SEQ ID NO. 46401
aaagctggagctccccgcggtggcggccgctctagaactagtggatcccccgggctgcaggaattcgcacgagaccattacctagaacatactaatcgaaaacccgtgttcttcgaccggcggcggtggtgcgaagcgaggcggtaagggagacgagatgagggggacaaagcggccgctcggcgtggtgacgtcgtgggtgcggcggcagccgcccaaggtgaaggccttccttgccgttgtcaccggcatggccgcgctcgtcttcatccgcttcatcgtccacgaccacgacaacctcttcgtcgctgccgaggctgcgcacgcgctcggcataggcgtcctcatctacaagctaaccaaggagaagacctgcgccggtttgtttccgtccgcttccttgacacacgttcccgatctgtcgagatcgccgtgccggcgcgatagggtttaggattttataggatttggtcccccaattcagcgtttcagaagacgatttccctagcatgatttgcaatttttattttgcaaagaattggtagtttactgctgtgtacatctagattctagaagcggaaggttataatgtttattcgatgtatctatagttaccccttatgttttcttgtgaggcattacggtttggggttcttatacgggcccagtgctaaagtatatttcggagctgcaagacgtgtttggttacagtatcctttgatttgactggatgaatctatatagacttatttgagtcgtttttaga

SEQ ID NO: 46401 - protein, 98 aa, Zea mays; identical to SEQ ID NO: 43612
  misc_feature: Ceres CLONE 1451832-F

SEQ ID NO: 46402 - DNA, 822 bp, Zea mays
  misc_feature: Ceres CLONE 1451833-F
  misc_feature: Encodes the peptide sequence at SEQ ID NO. 46403
  misc_feature (114)..(114): n is a, c, t, g, unknown, or other
  misc_feature (319)..(319): n is a, c, t, g, unknown, or other
  misc_feature (354)..(354): n is a, c, t, g, unknown, or other
  misc_feature (363)..(363): n is a, c, t, g, unknown, or other
  misc_feature (366)..(366): n is a, c, t, g, unknown, or other
  misc_feature (367)..(367): n is a, c, t, g, unknown, or other
  misc_feature (380)..(380): n is a, c, t, g, unknown, or other
  misc_feature (383)..(383): n is a, c, t, g, unknown, or other
  misc_feature (386)..(386): n is a, c, t, g, unknown, or other
  misc_feature (394)..(394): n is a, c, t, g, unknown, or other
  misc_feature (413)..(413): n is a, c, t, g, unknown, or other
  misc_feature (461)..(461): n is a, c, t, g, unknown, or other
  misc_feature (482)..(482): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaaactgcgactgtngagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtaccccggacatgggctgagcagggtgaccaccaccacccaggctctcatcatgggtgtcgcaccatccanggggcacgccgaggggcggtttcgaggcgccgccngagctgagnacnngcggtgcagtgcngcngcnactgccantgcgacccctgcaactgcnggcagtgagctaggtgctccacccttgcaggcggcccgaagaaactancctatttttaagcttaataangtttaccgggctcccttgggggggtttccagggcaaccaaccctttttcgtgccccgggcgatgcccctaaactcaaaaaataaaaaaaaggggtaagggggggcccntttgccccccctcggggccctccggggggtctttttgagaaaaattgtgttttgtttttgtgtgggggcgcccccacacaaaaaaaaaaaacgggccccccgtgtgtgtggcgcccccccccttttaatttctccccccccccccttttggtgggggggcgcccctcctctctattttttcccaaaaaaaaaaagaggggtgtttcccctcccccaaaaaaaaaaaaaaaac

SEQ ID NO: 46403 - protein, 131 aa, Zea mays
  misc_feature: Ceres CLONE 1451833-F
  misc_feature (1)..(69): Pfam Name: Metallothio_2 Pfam Description: Metallothionein
  misc_feature (50)..(50): Xaa is any aa, unknown, or other
  misc_feature (62)..(62): Xaa is any aa, unknown, or other
  misc_feature (65)..(65): Xaa is any aa, unknown, or other
  misc_feature (66)..(66): Xaa is any aa, unknown, or other
  misc_feature (75)..(75): Xaa is any aa, unknown, or other
  misc_feature (97)..(97): Xaa is any aa, unknown, or other
  misc_feature (104)..(104): Xaa is any aa, unknown, or other
MSCCGGNCGCGSGCKCGNGCGGCSKMYPGHGLSRVTTTTQALIMGVAPSXGHAEGRFRGAAXAEXXRCSAAATAXATPATAGSELGAPPLQAARRNXPIFKLNXVYRAPLGGFPGQPTLFRAPGDAPKLKK

SEQ ID NO: 46404 - DNA, 711 bp, Zea mays
  misc_feature: Ceres CLONE 1451840-F
  misc_feature: Encodes the peptide sequence at SEQ ID NO. 46405
tggagctccccgcggtggcggccgctctatactagtggatcccccgggctgcaggaattcgcacgagaccattacctagaacatcctaatcgaaaaacaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcgccgccatcggggcgcgggcgcgggcgcccgcccaagcccaaggacccgctggacggcgccgtgaagcaagcccccgcgggaatgcccagggcccgcggccgcccgcccaaaaaggccaagaccgagggcggtgcgtccccggcccccgccggcgacagttccacctctttcaagcgaggctggcgccgcccccccaaggaaacccccgtcgtggcccccgaagacggcgcgggtttgacggaagcctgctgcatgg

SEQ ID NO: 46405 - protein, 190 aa, Zea mays
  misc_feature: Ceres CLONE 1451840-F
  misc_feature (13)..(81): Pfam Name: Linker_histone Pfam Description: linker histone H1 and H5 family
MATEEVAKPSPIPPYPEMILAAIEDLGDKSGSNKSAISRYIEGKYDGDLPPAHASLLAAHLARMKESGELVFVKNNYFRADAPDAPPKRGRGRPPKARDPGAPVSPPSGRGRGRPPKPKDPLDGAVKQAPAGMPRARGRPPKKAKTEGGASPAPAGDSSTSFKRGWRRPPKETPVVAPEDGAGLTEACCM

SEQ ID NO: 46406 - DNA, 759 bp, Zea mays
  misc_feature: Ceres CLONE 1451842-F
  misc_feature: Encodes the peptide sequence at SEQ ID NO. 46407
  misc_feature (480)..(480): n is a, c, t, g, unknown, or other
aaagctggagctccccgcggtggcggccgctctagaactagtggatcccccgggctgcaggaattcgcacgagaccattacctagaacatcctaatcgaaaatatctgagtcgaccacagctctgaatgtcgacaagtcaagcactgctcccaacgagaacgcaccatcgatgccaccggcaatacctacctccgctgcatccagagcacttggcacaaatttgcaggatcagagccctactgtatctgatcctactgtaggagcggcggcggcggcggcggcacaaaggaaggatggcccaatgccttccaaagtacctgttgataggaaaaagatggatgcacggaagatgagcttgaagagattatacgcggaaccttcatagtccagcatttaaatctgtcggaaaataagcagatgcctagcgaagctgggagagagacattagttgggaggcatctgatgacctgccttccggnaaggtagggtccctgggctggaacaaaattgaatatgtgggctgggtggatccttccggacaacttgaggggcaatgtccaatcattggaagaaacccgggcaaattccttccggccccggaattttgtgacctacagggaagtgtaattagtttaaaggggcaattcccttgttaaccagggggtgggtgccccaaaccccgctggaaaaataattttccccggaaatacacatatttgtttttttgggagaaaaaaaaaaaaaaaacttttcgcccg

SEQ ID NO: 46407 - protein, 71 aa, Zea mays
  misc_feature: Ceres CLONE 1451842-F
MPPAIPTSAASRALGTNLQDQSPTVSDPTVGAAAAAAAQRKDGPMPSKVPVDRKKMDARKMSLKRLYAEPS

SEQ ID NO: 46408 - DNA, 732 bp, Zea mays
  misc_feature: Ceres CLONE 1451844-F
aagctggagctccccgcggtggcggccgctctagaactagtggatcccccgggctgcaggaattcgcacgagaccattacctagaacatcctaatcgaaaaattgcgcgctagaactcgcgaccgccgctgcctctcgtacttgcctggcgatgcccgtcaaagtggatatcccgaccgccaccacatttgcggtgagcacctgtaagcaggctcgagatctcatgtactccgctaggtacgacgacatgaaggatggcttaaccctgtcctccgctagtcactctctggactcgcgtgattgcgcaatgccacgtgactcttcagatgatttccgaccctgctctcctgactgagaccgactacttgatatgcatggggcgatatgttacctgcaccatcttggagactaaccgccattcttctgccactgccttgatggacgtatatacgctgtcaaggcttagaacccaactagggctagcgacattgctctgtctgcctcgagaaaccgccaatggtcgatgcgtggaccgcaggcaatgtgctcgtgatcaactcaatatgttccccaatggctaatcccgatctcgactgcgttactggctccctagaggagctgatgagtacctgaagctatgactgacttgcagccttgctcataactcccagcggttctgtctgtatcactctcgagactgactcccgaccgacctgtagcgtggcacatctc

SEQ ID NO: 46409 - DNA, 789 bp, Zea mays
  misc_feature: Ceres CLONE 1451847-F
  misc_feature (259)..(259): n is a, c, t, g, unknown, or other
aaactggagctccccgcggtggcggccgctctagaactagtggatcccccgggctgcaggaattcgcacgagaccattacctagaacatcctaatcgaaatctcgatttctcagtccagcctcagcagtccccttccctccctccatcaggtgttgcctcccgcagatccaaatcggaattcggtccttcgtccccaaaccaccaatccgtcctttggaatgctacagggaagtgaagtgatgggggagtgcgaggacngcaagaagtacaggtgctgggaggagctgctgccggacgcgctgggcctcatcttccgcaacctggccgctgcaggaaggtgggcttcacccgttcttgcccggcgggtggggcaaattccctggggggccgggtggggggcccggccccctactggtgggaggggaatccaacttccaggagatggggaaccccgcacccgggggaaaccccggaaaaaaaatccccccgcagtggggcaaaataattttgggggcccaaaccccgggttttggccccaggataaaagtctccgggcgcggcccgggaataccgcgtttccctttttcggggaaaaattctctgaaaaaaacgggggggtgtttttaaaaattttgagggggggaaccccccgcctttttttttttcaaggggggggggaaaaactcttttttttttttttaaaacggggaaaaagagggccccaaaaaaatttaaaaaaaaatgggggggtcttttagaaaaaaaaaaaccgcctcccaaaaaaaaaa

SEQ ID NO: 46410 - DNA, 765 bp, Zea mays
  misc_feature: Ceres CLONE 1451851-F
  misc_feature: Encodes the peptide sequence at SEQ ID NO. 46411
aaagctggagctccccgcggtggcggccgctctttactagtggatcccccgggctgcaggaattcgcacgagaccattacctagaacatcctaatcgaaaaattcctcggagaggagaatccgccgtcacaccattcccaacagcccggagaacggccagatcggactagatgcgaatctttgtgataactctgatgggcaagaccatctccctcgaggtctagagcaccgacaccatcgaccatgtccaggccaagatccgagacaaggaagggatcccgccagaccagcaacgcctgatctttgccgggaagctgctggaggatggccgcacccttgcggactatatcatccggaaggagtctactctcctcctcgtgctcaggctcctccttgacatcattgagccctcgctgcaggcgctcgctcgcatgtacaaccatgacaagatgatctgccgcaaatgctatgcacggctgcaccctaccgctgtcaactgccgcatgaagaagagtggtcactgcatccagctgagggcctagaagaagatccagatctgaggtgttgctgctagtcagtttcatggacaatgttgtttggttgctgaaccgtgtttgtttacaaactgtatttttgattgcttgtttgaacgtgtttagttactgacacctatgcgcgtatgttatgttttaccatgttgacgatgacctatactatctgacgatacgcactgtgctattggaattcttgtcattgttcacctga

SEQ ID NO: 46411 - protein, 36 aa, Zea mays
  misc_feature: Ceres CLONE 1451851-F
  misc_feature (1)..(37): Pfam Name: Ribosomal_L40e Pfam Description: Ribosomal L40e family
MYNHDKMICRKCYARLHPTAVNCRMKKSGHCIQLRA

SEQ ID NO: 46412 - DNA, 733 bp, Zea mays
  misc_feature: Ceres CLONE 1451854-F
  misc_feature: Encodes the peptide sequence at SEQ ID NO. 46413
  misc_feature (485)..(485): n is a, c, t, g, unknown, or other
  misc_feature (490)..(490): n is a, c, t, g, unknown, or other
aagctggagctccccgcggtggcggccgctctagaactagtggatcccccgggctgcaggaattcgcacgagaccattacctagaacatcctaatcgaaaaaacaaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccgtccatctccgtcggcgccgcggcgccgtcccgtgcagcgggcgcgagcactaaaaacagcgcggacgaggtggagctcctgcggcggcggaacgcggagctggagcgggaggtggcgaccctgcggctggagctgggcgcggcgcggcgccgcgcctaaacggcggaaaaagccgaagagcgtctgtgcttgcanctcgncgacgcgaagtgaaggcgctcgagctcgcgcgcgcctaccatgcccaagtcacgagctcgcaaggaactcgccgccgcgggagcggccccggaacgccgggcaaaaaggttctccgtgggctgggagaaggctactattagctaaaccggggggataagcgggatgcgtggggtcccggttttggttggccccgaaggaaccccaagccggggtgcctttttttgccccccccggaattaaat

SEQ ID NO: 46413 - protein, 55 aa, Zea mays
  misc_feature: Ceres CLONE 1451854-F
MAPSISVGAAAPSRAAGASTKNSADEVELLRRRNAELEREVATLRLELGAARRRA

SEQ ID NO: 46414 - DNA, 762 bp, Zea mays
  misc_feature: Ceres CLONE 1451861-F
  misc_feature: Encodes the peptide sequence at SEQ ID NO. 46415
ggagctccccgcggtggcggccgctctagaactagtggatcccccgggctgcaggaattcgtctcacccctaatcgaaaactctctgtcgccgacgactacgccaggtcttcttcggggcccaggtcgctgccgcctacatcaggggccccaagttttcctaggacccctcgccggcgacgagcaccaccagcttggttcactcccaacaaaatgtcggccaatgtgggtgaatcaactaacggtgtcagcatcagcgatgcatctggggggagctttgagtgcaacatatgcttcgagctgcctcaggagccaatagtgactctctgtggccacctcttctgctggccgtgcctttaccggtggctgcacattcacgcacactcgccagagtgcccagtgtgcaaggccctcgtggaggaggacaagctcgtccccctttatgggcgtgacaaggatcgcgtcgaccctaggtcgaagaacatgcccgagggcgagattcctcaccgcccaacgggccagaggcctgccacagtccgtcgggccgatgctaacagcaacttctgcaatgccaatgccaactcatggttcccgggcgcatgattccctctggcaaatgcgcgatgggagaactacgcattctcagctgctctcaggggacggctacgtatgcttagcttcaaggccatggatttcatgatgccagagcttacgcgcatcctgttgggttcactatggatacggacatgcgcatgggcattga

SEQ ID NO: 46415 - protein, 129 aa, Zea mays
  misc_feature: Ceres CLONE 1451861-F
  misc_feature (24)..(64): Pfam Name: zf-C3HC4 Pfam Description: Zinc finger, C3HC4 type (RING finger)
MSANVGESTNGVSISDASGGSFECNICFELPQEPIVTLCGHLFCWPCLYRWLHIHAHSPECPVCKALVEEDKLVPLYGRDKDRVDPRSKNMPEGEIPHRPTGQRPATVRRADANSNFCNANANSWFPGA

SEQ ID NO: 46416 - DNA, 728 bp, Zea mays
  misc_feature: Ceres CLONE 1451862-F
  misc_feature (703)..(703): n is a, c, t, g, unknown, or other
gctctgaactagtggatcccccgggctgcaggaattcctctcacccctaatcgaaaaagtcccgagtcgatacgctgtcatgcctgtcaatcctcctccgccacctcctgggtcgtcgtctttggctccggcgggggccagctacttcccgctccctttccacctgcagcagcaccagccgccgccgccgcaggtgccgccgcctatggcggcgagcagctatcagcagtatctgcaacagctgcatcaggcccatcagctctttccagcgggacgcgcaaaccataacccccgaagcgctgcaaagcgtcaaggctgccctccgcaccagagaagtcttagaaaaggacgccgccgtcaatgccaggctcttcgatccctccaagatgtaagaacccatcccccgtcgcgttgccggacaatcctgggaggatccttcccccactgaatggcccgaaaacaactaccgccctggctctggggaaatccatgcaacgaaacttaaggaagagggtccaccccaaagcatttttccgggtttccttccctttaacatgccatgggttgttcaaacattaagatggactgcaaaaactaaagggcgccgggatttggtgagatctctctccaacccctcccggaccttggcttgccccaactcataatcacatggaacgggaatatcttgttccgggaaaccgtnccctccataacacctgcgcgaacaa

SEQ ID NO: 46417 - DNA, 764 bp, Zea mays
  misc_feature: Ceres CLONE 1451864-F
  misc_feature: Encodes the peptide sequence at SEQ ID NO. 46418
aagctggagctccccgcggtggcggccgctctagaactagtggatcccccgggctgcaggaattcgtctcacccctaatcgaaaaattgcctgttcagctacccgccgccgcctcttctacccgcaacaacggctgccccgagaccgagcacgcgtctcccggttccctttcctgctcgcctcaggcccgcgtccctcgtcgcccgacggctgacggcggaggcgggggaggcgctgagcgcgttatccgccgcggagggcgacgacgaatacgaagcggagctccaggaggaagggtttccgagctgggcgggcggcggcgaggaggaggactacgaccacgaccccgaaatcggagacattatgggggactacttcgacgaccccaagaagggccaaacccgcatggaggataggataagaaagaaacgccacaagatcgtgcaaaccaagaccggctctccaaaccccatgaaggtcgtcttcaacaaatttgacttctccaattcctatatatggttcgagttctacaatgttttgttgccaaaagatgttacgttgatttctgattctctgcgatcatggcatatagttggccgtcttggtggctgcaattctatgaatatgcagtggatgagacgatactagtcaggttatcgcaattgcctttagattgtaaaaggctgacttatgatgctcttgaaggagctaacgtcactccgacgtccttttacaacattggtgatcttgagattcaagatatc

SEQ ID NO: 46418 - protein, 94 aa, Zea mays
  misc_feature: Ceres CLONE 1451864-F
MGDYFDDPKKGQTRMEDRIRKKRHKIVQTKTGSPNPMKVVFNKFDFSNSYIWFEFYNVLLPKDVTLISDSLRSWHIVGRLGGCNSMNMQWMRRY

SEQ ID NO: 46419 - DNA, 788 bp, Zea mays
  misc_feature: Ceres CLONE 1451866-F
  misc_feature: Encodes the peptide sequence at SEQ ID NO. 46420
  misc_feature (458)..(458): n is a, c, t, g, unknown, or other
  misc_feature (555)..(555): n is a, c, t, g, unknown, or other
aaagctggagctccccgcggtggcggccgctctagaactagtggatcccccgggctgcaggaattcgtctcacccctaatcgaaaaattacttatccgtctcaaagcagcctagtgccgcaaagtcagtccagtccacaggccttcttcaagcagatatatagcagtaccgtccatgggcaactgcacggcgtcgcagcgcgcagcggagtcgtgggccgacgacggcgagtgggaggaggcggcgtcatcgtcgccgttgtcgtcggagggcgaccaccaccaccatcatcatcaccgcgacgagaggagagaggatcacctcgactccgaggtgaccatcaggatcaccaagaggcagctgcacgagctgattgaaaagaaacgcggctgccacgggttaccgctacccgggtcccggaaggcgccggcgggcgtccgcggagcacctgctggccnacttcatggactccggggaggttgcacacccgcaaccaccacagggaaggacccctggcccgggaaccccccgctggaaagcaatccccgagaacgncaaaccatcaaggacgccagggaaaatctttctggggggttggggggtcaaaagcccaaaaggggggcctttttttccccccttgtgcgggggggaaagggaaccccctaaaaaaccggggacgccggggaaaaataaaagtttctcaaaaaagaaaaaaagggccagggggggggggaaccttttttggggggggcccttttttttcaaggtgggggaaaaaaataatccgc

SEQ ID NO: 46420 - protein, 163 aa, Zea mays
  misc_feature: Ceres CLONE 1451866-F
  misc_feature (95)..(95): Xaa is any aa, unknown, or other
MGNCTASQRAAESWADDGEWEEAASSSPLSSEGDHHHHHHHRDERREDHLDSEVTIRITKRQLHELIEKKRGCHGLPLPGSRKAPAGVRGAPAGXLHGLRGGCTPATTTGKDPWPGNPPLESNPRERQTIKDARENLSGGLGGQKPKRGAFFSPLVRGGKGTP

SEQ ID NO: 46421 - DNA, 784 bp, Zea mays
  misc_feature: Ceres CLONE 1451867-F
  misc_feature: Encodes the peptide sequence at SEQ ID NO. 46422
  misc_feature (366)..(366): n is a, c, t, g, unknown, or other
  misc_feature (394)..(394): n is a, c, t, g, unknown, or other
  misc_feature (437)..(437): n is a, c, t, g, unknown, or other
  misc_feature (482)..(482): n is a, c, t, g, unknown, or other
  misc_feature (511)..(511): n is a, c, t, g, unknown, or other
  misc_feature (561)..(561): n is a, c, t, g, unknown, or other
  misc_feature (568)..(568): n is a, c, t, g, unknown, or other
  misc_feature (623)..(623): n is a, c, t, g, unknown, or other
  misc_feature (643)..(643): n is a, c, t, g, unknown, or other
  misc_feature (645)..(645): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (695)..(695): n is a, c, t, g, unknown, or other
  misc_feature (696)..(696): n is a, c, t, g, unknown, or other
  misc_feature (716)..(716): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (735)..(735): n is a, c, t, g, unknown, or other
  misc_feature (736)..(736): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (759)..(759): n is a, c, t, g, unknown, or other
  misc_feature (760)..(760): n is a, c, t, g, unknown, or other
  misc_feature (784)..(784): n is a, c, t, g, unknown, or other
acccgcggtggcggccgctctagaactagtggatcccccgggctgcaggaattcgtctcacccctaatcgaaaaaaatccaatgaaaaagtaacaacagcagcccccggggccacagggcgaggcccgcagccatggaccaggaccacaagaggttagcactcccgtcgccggcgccgcagtccccgccggcatccgccgcgtcggcgtcaaccacggcctcaccgtactccgcgctacacccgctcctcttgccctccccgaacccgcaccttttcctcaagtccaagacgctcactcactccctctcgtcctcctccttcacctccgtgtcctcatcctcgctgcccgccgctgtgaggaaagnctggaaggtcagcacccccactgccgantttgttcccccccccccaccccaggctagatgacccggcccancttccccaccacacctccctgcaggggctcctcactgtaccgggnagggcaacagatgtcccttcaaccgctanctttctccccattgaatccaacccccaaccgaattcaccacactgggggnaagattnaagcttggcgtgttgcgaggtcaaaacccatacctccgacccctcacgcgcgctntgcgcgccctcctacccgancnttcttcacccactcgctttnnnntatttcacttgtccacacctacacggnntcctcaccccaccgtcggcnngnncggcccactcggtcnnctcgcggccccccccccnnnncnngaggagccaccaacccacatccgn

SEQ ID NO: 46422 - protein, 97 aa, Zea mays
  misc_feature: Ceres CLONE 1451867-F
  misc_feature (78)..(78): Xaa is any aa, unknown, or other
  misc_feature (87)..(87): Xaa is any aa, unknown, or other
MDQDHKRLALPSPAPQSPPASAASASTTASPYSALHPLLLPSPNPHLFLKSKTLTHSLSSSSFTSVSSSSLPAAVRKXWKVSTPTAXFVPPPPPQAR

SEQ ID NO: 46423 - DNA, 763 bp, Zea mays
  misc_feature: Ceres CLONE 1451875-F
  misc_feature: Encodes the peptide sequence at SEQ ID NO. 46424
  misc_feature (393)..(393): n is a, c, t, g, unknown, or other
  misc_feature (677)..(677): n is a, c, t, g, unknown, or other
  misc_feature (687)..(687): n is a, c, t, g, unknown, or other
  misc_feature (697)..(697): n is a, c, t, g, unknown, or other
aaagctggagctccccgcggtggcggccgctctagaactagtggatcccccgggctgcaggaattcgtctcaccccctaatcgaaaaagagtcctaccaagtggcaccaaagctcgttctcccgaccccgactgtccccaatgcgcagtccgcgaggcctcctcaccgcctccggctaccttgcgggccggcacgctccgtcggcctccgtgtccaccactggccacaactccctactcgctcgcaccttccaaatcctagcccagccggagtccgtccgtctgcagaagcacccggcacccaactccgggatcttagagctgaggctggagcggccggaagtcaagaacgccattaattgggatatgatgaggatgctgcggagcgccatanagaagattcaggccgacacgacggcgaaggtcgtccttgttgcgagctccgtgccgggggctttctctgcaggcgccgatctcaaggaaaggaggctaatgagttcttctgacgttggggggtatgctagatccttgaggtctacattttcgtcttttgaggcacttcctattccaacaattgctgtcattgaaggagctgcccttggtggtgggctagaactggctttggcatgcgatcttccgatatgtggagaaaatgctgaacttggactgccagaaacnagccttgctnatatacctgnagctggaggtaccgcacgccttcctaggatcatagggaggtccagagcaaagaactaatattcctg

SEQ ID NO: 46424 - protein, 204 aa, Zea mays
  misc_feature: Ceres CLONE 1451875-F
  misc_feature (59)..(204): Pfam Name: ECH Pfam Description: Enoyl-CoA hydratase/isomerase family
  misc_feature: SWISSPROT Homolog: EC 4.2.1.18 Methylglutaconyl-CoA hydratase
  misc_feature (85)..(85): Xaa is any aa, unknown, or other
  misc_feature (183)..(183): Xaa is any aa, unknown, or other
  misc_feature (186)..(186): Xaa is any aa, unknown, or other
MRSPRGLLTASGYLAGRHAPSASVSTTGHNSLLARTFQILAQPESVRLQKHPAPNSGILELRLERPEVKNAINWDMMRMLRSAIXKIQADTTAKVVLVASSVPGAFSAGADLKERRLMSSSDVGGYARSLRSTFSSFEALPIPTIAVIEGAALGGGLELALACDLPICGENAELGLPETSLAXIPXAGGTARLPRIIGRSRAKN

SEQ ID NO: 46425 - DNA, 786 bp, Zea mays
  misc_feature: Ceres CLONE 1451886-F
  misc_feature: Encodes the peptide sequence at SEQ ID NO. 46426
  misc_feature (384)..(384): n is a, c, t, g, unknown, or other
  misc_feature (385)..(385): n is a, c, t, g, unknown, or other
  misc_feature (589)..(589): n is a, c, t, g, unknown, or other
aagctggagctccccgcggtggcggccgctctagaactagtggatcccccgggctgcaggaattcgtctcacccctaatcgaaaagaatgaatcttgctgtaccgctctgtgctgcgagactggaagagactccacggagacaccacatggccgccgccggcgacggcggtgagtcccactaccgggaggcgctccgcgaggccttcggtgactcgtcgagcagcgattccgacacacccgtcggtgtcagccccggagcaggccgcgggcactggaggtgggaggcggtggctggggtcagggggctgtggctctgcgccgccttcctctccgccgacgagcaggcgcgcctcctcaacgccatccagcgagaaggatggttnnataatgcagacaacccagcgatgagattcggcgacctccccttcgtgggcagtcgaactttctgcacttatccgcgaagctatctgcgtcggcgaccccagtgtcggtccttggtgccgaggggacgaacgaggaccaggatgcctgccctctgccatcaaacttgttggggcgggagccatttttttgatccgatgatccccnacagaatacggacccgggcttctgggcctcccgccaatttgagcccctttgaaaaaagggaaccccaatcttccccccaaaaccccctgtgtgaaggcctttatcaagaaaaaaccccccttgaaaccccaaaaagagggggggggcgcctaaaacctttgaaaaagccccctttttgtaaaaccgggctccttttc

SEQ ID NO: 46426 - protein, 213 aa, Zea mays
  misc_feature: Ceres CLONE 1451886-F
  misc_feature (79)..(79): Xaa is any aa, unknown, or other
  misc_feature (80)..(80): Xaa is any aa, unknown, or other
  misc_feature (148)..(148): Xaa is any aa, unknown, or other
MAAAGDGGESHYREALREAFGDSSSSDSDTPVGVSPGAGRGHWRWEAVAGVRGLWLCAAFLSADEQARLLNAIQREGWXXNADNPAMRFGDLPFVGSRTFCTYPRSYLRRRPQCRSLVPRGRTRTRMPALCHQTCWGGSHFFDPMIPXRIRTRASGPPANLSPFEKREPQSSPQNPLCEGLYQEKTPLETPKRGGGRLKPLKKPPFCKTGLLF

SEQ ID NO: 46427 - DNA, 776 bp, Zea mays
  misc_feature: Ceres CLONE 1451889-F
  misc_feature: Encodes the peptide sequence at SEQ ID NO. 46428
aaactggagctccccgcggtggcggccgctctagaactagtggatcccccgggctgcaggaattcgtctcacccctaatcgaaaacaagtgggagaggaagaggtttgggcttcagggtgggtttgtcacaaacccattagccgagccgaacatttcatctgcggggaaaacaatggttactcatgaaggcaggaagaaggataaaactttacaaaagtgaagggcgggttaggcatgaagaagacattctgttccaagcgtgaactgctcgagtttgcttattatcatggaggcggctgtagttctcttttccaccgcgacctctttttgttcctaatgaacgtacattgtcattttaggaagcatctgaagcatggcgtgggcgtgcaccatgagggttggaccccctccaaactaacctggttgagaaactatgcaaggctaagggactgctttcactcgggcgggggaccgggacggagggttcttttttggagaagcttcctttggcccccaaaaaattcggggcccccccacaagcctgggaaaaaaactggggtttgcgttttgaaaaaaaaccccccccctgttttttttccaacccttttggcgaaaaaggaaaaaaaaggggtttttttttttccggggggcccccccccccccaaaaaagggcgccttttgtgaaaaaaggggaaaaaaatttcttaaaaaaaaaaaaaaaaaaaagaacgccggggggccccctctccccccctagaggaaaaaaatccccccc

SEQ ID NO: 46428 - protein, 72 aa, Zea mays
  misc_feature: Ceres CLONE 1451889-F
TGAPRGGGRSRTSGSPGLQEFVSPLIENKWERKRFGLQGGFVTNPLAEPNISSAGKTMVTHEGRKKDKTLQK

SEQ ID NO: 46429 - DNA, 706 bp, Zea mays
  misc_feature: Ceres CLONE 1451892-F
  misc_feature: Encodes the peptide sequence at SEQ ID NO. 46430
  misc_feature (400)..(400): n is a, c, t, g, unknown, or other
ctccccgcggtggcggccgctctagaactagtggatcccccgggctgcaggaattcgtctcacccctaatcgaaaaagattagtcacactccttcgcaagcaaaaaaaaaaaaaaaaaatccccaaatttcggataagcctcgccggcgacgaaatcagggtttcatcgaacaacaagatggctcacgcttgcgtctccacatcagcttcctctctcaggttcacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcanggagtttggtccatcagagatgatttacaagtccccttctcgccgtattttcctgtgtacgctcaagacaaggaccacctcctatggtgcaagagcgtttccagagtatcataagccagctctcccaatataaaattattcctttgggggggggcctgtggataagaaatggccaaaataaatcggaacctcaacttccttacccccaaggcgggtgaacccaccaagggaaattgttttttttggaaccccccggggggaaccttaccggggggaggctttttccaaaccttggggcctacccca

SEQ ID NO: 46430 - protein, 111 aa, Zea mays
  misc_feature: Ceres CLONE 1451892-F
  misc_feature: SWISSPROT Homolog: EC 3.4.21.92 Endopeptidase Clp
  misc_feature (74)..(74): Xaa is any aa, unknown, or other
MAHACVSTSASSLRFTAGFVSASPNASSFDSQKLSLPFEPLRSRKTKKLVSGRKTAPKAVYSGNVWTPETPSPXGVWSIRDDLQVPFSPYFPVYAQDKDHLLWCKSVSRVS

SEQ ID NO: 46431 - DNA, 730 bp, Zea mays
  misc_feature: Ceres CLONE 1451893-F
  misc_feature: Encodes the peptide sequence at SEQ ID NO. 46432
  misc_feature (510)..(510): n is a, c, t, g, unknown, or other
  misc_feature (730)..(730): n is a, c, t, g, unknown, or other
ctggagctccccgcggtggcggccgctctagaactagtggatcccccgggctgcaggaattcgtctcacccctaatcgaaaaaggagaactgggacgacagcagcggcgggcgacggggaacggggaacccctgtactgtatttcgtcgacctttgccatggcgtcgatgatgagttctcgcgcgggcgcggcggcggccggaggaggagaacaccgccgtcagcacgtcacggtggcgtgcggtgggctgacgcggccgagtaccaggcccgtgccgggcgctgctggcccacggcccgggactccgaggccgcggggtcctgctgcagctgcgggcggctcttcgtcttcgtcgccgacggtgcgcgcgatgcccgagtacacctggtggggccctccccccctggtgttgtgcgaccccgaggctgccgaagagcggcagggccccgggcgcgcgggtgctaacgggcaaggggaaccgcgagctggtgagacgggcgctcccgccncccgccgcgggaggccgtggccgtggccgtgccggaggacccctcctcctcaggaggtggagcttccggcccgcgcccattccgcatgaaaaagaggtcttccctctcctcgcagtcccttgaatcaccgcggaccacgtctgtcgtgatctaccgtcgcagaggggaatctttgattcattgtttgggggggcaaaaatccttgggcggcctctgcgtn

SEQ ID NO: 46432 - protein, 146 aa, Zea mays
  misc_feature: Ceres CLONE 1451893-F
  misc_feature (118)..(118): Xaa is any aa, unknown, or other
MASMMSSRAGAAAAGGGEHRRQHVTVACGGLTRPSTRPVPGAAGPRPGTPRPRGPAAAAGGSSSSSPTVRAMPEYTWWGPPPLVLCDPEAAEERQGPGRAGANGQGEPRAGETGAPAXRRGRPWPWPCRRTPPPQEVELPARAHSA

SEQ ID NO: 46433 - DNA, 713 bp, Zea mays
  misc_feature: Ceres CLONE 1451895-F
  misc_feature (713)..(713): n is a, c, t, g, unknown, or other
ggagctccccgcggtggcggccgctctagaactagtggatcccccgggctgcaggaattcgtctcacccctaatcgaaaaacttccgtcattggcttccattcccccctcccatttgttgcccacataagtcggttgtgggaatgatcactggcttcattaataatcgtatgaagtgcggcctcgtgtccgccgggcacggacgtttctcgtggctttggattcacccggttaggtcccggtaacgccggtggcatgctccaccaccgtatcctcttcaacaagtaccatccgggctacttcgtataggttgatatggtttacttccttaagttccgcaactagttctactgccccgcggtcaatatcaagggcctctggttgatggagcccaccgcacaaggtcgcttaggccgtctcttacaatgccccgtatatcgacctctcgacgttcggttacttcattgtgctcgggaatggggtgctgccgctctagcctcattgtcttcaaggccaagctcatctcctatgtcgcttataagaatatccaggcaacttgttggtgccgtctggctctccgcctaggtttcggtccttgttcccctcctggttttgagatctatatctgaactgatagtgctttcctgtccctgcaaattctgttgataaacctgtcagattaaaatatgtggttcctgcttgtttgcaagagtn

SEQ ID NO: 46434 - DNA, 757 bp, Zea mays
  misc_feature: Ceres CLONE 1451901-F
  misc_feature: Encodes the peptide sequence at SEQ ID NO. 46435
  misc_feature (383)..(383): n is a, c, t, g, unknown, or other
  misc_feature (757)..(757): n is a, c, t, g, unknown, or other
ctccccgcggtggcggccgctctagaactagtggatcccccgggctgcaggaattcgtctcacccctaatcgaaaaaagacggatcgagactacacgacgccgatcctagctagctctcccgtttctgctcgcaagtcacacacagctccggtagatccgcccctcgcctctgggctccaggaagagattagcttcagacggcagggatcgatactagcaagcaagcatggcgcacgacttgtgcgaggacttggagctcgtcgccgacgacggcggcttcgatgactactactgggacgacgacttccatttccacgacgacgacggcttctccgcctcccctacgacccccgccagcgttggtgcgccccgccagcagcancaccaccagcagatgggtcacctttcagcctcggactacaaagaaggcgaagacatgcaggggataccctgagaaaggctcaactacaccagggaccagtatcgtcggatgaggctcaaagagtacaagagctaccagaacctcacgaggtcgcacagcggcctacaacaccagggggagaggaaagacccttctacgatttccctctggacccgagagccgttcagtcaacgatagtgcatttccaggccacaacaagcagtgggcggacgtttgggtgtgcgctttctgccttaagccttgagtggaccaacctggaatttatccgaccgatcaggtggatgggcatccccagcagccgggagggaggaccn

SEQ ID NO: 46435 - protein, 75 aa, Zea mays
  misc_feature: Ceres CLONE 1451901-F
  misc_feature (52)..(52): Xaa is any aa, unknown, or other
MAHDLCEDLELVADDGGFDDYYWDDDFHFHDDDGFSASPTTPASVGAPRQQXHHQQMGHLSASDYKEGEDMQGIP

SEQ ID NO: 46436 - DNA, 741 bp, Zea mays
  misc_feature: Ceres CLONE 1451902-F
  misc_feature: Encodes the peptide sequence at SEQ ID NO. 46437
  misc_feature (630)..(630): n is a, c, t, g, unknown, or other
  misc_feature (702)..(702): n is a, c, t, g, unknown, or other
tcaccgcggtggcggccgctctagaactagtggatcccccgggctgcaggaattcgtctcacccctaatcgaaaaatccgaagttccgaacccacgccaagccccagggtccgaccgcagaaccgacccaaaatgtcgcccgcctcttccatgctcaccgccgtgtcgctctcctccccgctcccagccccgcgcctccgagccgccgccgccgcctcctccttcgctccgccgcgccgcgcggcagtcgcactcgtcgtgcgcgcggcgtccacatcttccaagtcccctgccacggcggaggcggccccgaagaagaagagggcgaccggcatcacccagcctaagtccgtgtcgccggcgctgcaggcaatcgtgggcgacccggttattccccgcaccgaggtcctcaagcgcctctgggcctatatcaaggagcataacctccaggatccctctgataaaaaggtggtggtttgtgatgagaagctgaaggtcctgttctcggggcgcgagcgagtggaattccttgagatcgccaagcttctcaaccctcacttcgtgaagtgatgaagaaaactacagccacttccaggaatcgagttagcttatatggtcggtatgctactnatggctggccaaaaggtgcgcgtgcgttgtgtttcgcaacccaacctagctcgctcgctttgtagaagctgnagtagctttaatacaaaccttcactctagccggtatgca

SEQ ID NO: 46437 - protein, 145 aa, Zea mays
  misc_feature: Ceres CLONE 1451902-F
  misc_feature (68)..(144): Pfam Name: SWIB Pfam Description: SWIB/MDM2 domain
MSPASSMLTAVSLSSPLPAPRLRAAAAASSFAPPRRAAVALVVRAASTSSKSPATAEAAPKKKRATGITQPKSVSPALQAIVGDPVIPRTEVLKRLWAYIKEHNLQDPSDKKVVVCDEKLKVLFSGRERVEFLEIAKLLNPHFVK

SEQ ID NO: 46438 - DNA, 733 bp, Zea mays
  misc_feature: Ceres CLONE 1451905-F
  misc_feature: Translation starting site: 366
agctccccgcggtggcggccgctctagaactagtggatcccccgggctgcaggaattcgtctcacccctaatcgaaaaattttttctttcgtctcgctccccccttttctctgatcttcttccgactccaacaactgagccacaaccgtgtcatccccaatggacatgttgaggaagatgtgggacacctttgtcatgacttgcttcaacctccctgccaggaaaacctcatacaacaattgcgagacaagagaagggtgtcacgatcttcccctgtcctactggtggacctcttcgccctgctgtacacggtcagcactcttattctacaacatgagacgcacaaccggctaaggtttcactctatgaacaactcaaggttgctggaatccccaagaagttggctccaaccattggtatctctgttgaccgtcaccgcaagaacagatctctcggagcgtcttcgcgccaatgaccagaggctcaaaacctacaaggctaagttggtcatcttcccacgtcgtgccatcaacgtcaaagctggtgattctcctggctaagagttgggcaatgccactcaagtccattgggactacctgcctattgacagtgagaagcccaccatggatcttgtgaacctgacctctgaaatcacatcattctcggcttttgaccagatccgtgctgatcgcacgcacaccaaacatgcttgagctcatagcaacagagctgg

SEQ ID NO: 46439 - DNA, 782 bp, Zea mays
  misc_feature: Ceres CLONE 1451907-F
  misc_feature: Encodes the peptide sequence at SEQ ID NO. 46440
aagctggagctccccgcggtggcggccgctctagaactagtggatcccccgggctgcaggaattcgtctcacccctaatcgaaaattcctcgtgcccgtcccctcaggcgctcttgctggttctggaagccggagcatcggcgctgtcgctcaggtctgtccattcccctccaaagccctaaagctaggcttcctgtgctaacccgaatcaagcaagccccgtcaacctcccccgccgtcgtcttcttctctgttgctctcctctccaccgggtccccatctcctcccttcaccgccccagaactcctcactcgggcgctgccgctgcgaggtctccgtggcatcgggccttcgtcattacgcagcagacgaagcagtgggaaacttggaactgcatgcacccaaggcaaaacgtcggtcatatatcccaacgaaaaatggaacagccatgatgcttccgctccatattcattacgaagatgtactacgtcaggatctgttgctcaaacagaatcatgccaatatcatgcaagttccagggttgtttgaggtcaaattagcaccaaaagctggctctgatctcaagatcccaattgggaaaatggccatggaggttttgagtggtcagagattcaaagaggcaaaaattgaccctttcgccaaagcaagaaagtcttctcgaaccaatccatttattgggaccgacaaggacggtagcactgtcttcgcgcaacaaccgttcttcgagggcatgcatgtacaactttgtggtgaggatgctt

SEQ ID NO: 46440 - protein, 111 aa, Zea mays
  misc_feature: Ceres CLONE 1451907-F
MMLPLHIHYEDVLRQDLLLKQNHANIMQVPGLFEVKLAPKAGSDLKIPIGKMAMEVLSGQRFKEAKIDPFAKARKSSRTNPFIGTDKDGSTVFAQQPFFEGMHVQLCGEDA

SEQ ID NO: 46441 - DNA, 733 bp, Zea mays
  misc_feature: Ceres CLONE 1451910-F
  misc_feature: Encodes the peptide sequence at SEQ ID NO. 46442
  misc_feature (477)..(477): n is a, c, t, g, unknown, or other
  misc_feature (547)..(547): n is a, c, t, g, unknown, or other
  misc_feature (575)..(575): n is a, c, t, g, unknown, or other
  misc_feature (580)..(580): n is a, c, t, g, unknown, or other
  misc_feature (581)..(581): n is a, c, t, g, unknown, or other
  misc_feature (604)..(604): n is a, c, t, g, unknown, or other
  misc_feature (621)..(621): n is a, c, t, g, unknown, or other
  misc_feature (628)..(628): n is a, c, t, g, unknown, or other
aagctggagctccccgcggtggcggccgctctagaactagtggatcccccgggctgcaggaattcgtctcacccctaatcgaaaacttttgagcttctaccggctccaattccacccctcgccgccatctccgtctctctctctcccgcaaccaagcagttcaactcacacccgaagcggcgccgctagggtttgctccgacagccgcgaaacctagtccttactgcgccctcccacagaggccgtcattcactaatctacctgctacgcttcgcttcccgctccgattgggagctagggtttagcttatctccgagctcagcttcgggtcgcggcacgcggcatggcggggtacggggaagaaaaccagaacgccatgaacgggtacgaggaggaagaggaggaagaagaagttgaagaagtcgaggaggtgtacgaagaggaggaggagggggacggggaagggggaaggagacnaagggggcagccgccgaggcagcagcgatggcggccgagacgagaagtgtcgatggaggccgggccctancggaggcccgttggaaatgtgatgcccngagcnnagatgaaagggatgcaaattctnagcggcgtgacgctccnggaaagnttttcctaagggggggaagcctggaaaacacctgaagtaccgagcattccttttgactcaacatgaactattttgggttaatccccggaaaggttttaacaaaac

SEQ ID NO: 46442 - protein, 97 aa, Zea mays
  misc_feature: Ceres CLONE 1451910-F
  misc_feature (45)..(45): Xaa is any aa, unknown, or other
  misc_feature (68)..(68): Xaa is any aa, unknown, or other
  misc_feature (78)..(78): Xaa is any aa, unknown, or other
  misc_feature (80)..(80): Xaa is any aa, unknown, or other
  misc_feature (93)..(93): Xaa is any aa, unknown, or other
  misc_feature (95)..(95): Xaa is any aa, unknown, or other
MAGYGEENQNAMNGYEEEEEEEEVEEVEEVYEEEEEGDGEGGRRXRGQPPRQQRWRPRREVSMEAGPXRRPVGNVMPXAXMKGMQILSGVTLXEXFS

SEQ ID NO: 46443 - DNA, 719 bp, Zea mays
  misc_feature: Ceres CLONE 1451911-F
  misc_feature: Encodes the peptide sequence at SEQ ID NO. 46444
  misc_feature (409)..(409): n is a, c, t, g, unknown, or other
tggagctccccgcggtggcggccgctctagaatagtggatcccccgggctgcaggaattcgtctcacccctaatcgaaaaattccccaatccccgtgtcgcctgtgcccctctgccacctcgccgtcggcatgacaacagggtcgaccccgggttcggccccctctcagagaaaacgaaattctaccaaggattccgttgccctgtacgcggtgcaatgctataagtgctacaaatggagtacggttccaaaagaagaatttgagacgcttcgtgaaaacttcactaaggatccatggttctgcagcagacgaccagacagctcttgtgaagacgatgctgacattgagtacgacagcagccgcatttgggtttttggacagcccacatacaaaggcctccacaaaacngaaaagctagtgggtatgaagggcgactacggcaaaatgggccccttatatgtcatgccaatgggaaacctgcaagggtgcccggaaaatggaaaatttcggggggcaatcccggaaaaaaaacccgaaacccgctcgaattttcctttcccccccccaaggttttaaaaaaatttttccccaccccggctgggatgttcccaacccaaagagggggagagggggggcccaaaggttattcccccccccggggttgtttttttttaaaaaaaaccccccaaaaaatcccccccctttatgtggttgtttt

SEQ ID NO: 46444 - protein, 148 aa, Zea mays
  misc_feature: Ceres CLONE 1451911-F
  misc_feature (25)..(73): Pfam Name: zf-CW Pfam Description: CW-type Zinc Finger
MTTGSTPGSAPSQRKRNSTKDSVALYAVQCYKCYKWSTVPKEEFETLRENFTKDPWFCSRRPDSSCEDDADIEYDSSRIWVFGQPTYKGLHKTEKLVGMKGDYGKMGPLYVMPMGNLQGCPENGKFRGAIPEKKPETRSNFPFPPPRF

SEQ ID NO: 46445 - DNA, 755 bp, Zea mays
  misc_feature: Ceres CLONE 1451912-F
  misc_feature: Encodes the peptide sequence at SEQ ID NO. 46446
ctggagctccccgcggtggcggccgctctagaactagtggatcccccgggctgcaggaattcgtctcacccctaatcgaaaaacaactcatgaccagtgcctcatcggccaaaaatatccttgtacctgaatctcgacctcaccggcgtccggcggtggtatcacaatggtgcccttgctggaccggcggatagtggtggctgcggaagctgccgcgttcatcgccctcgtggcgttcggatccgcctcatcctcgcccaagtccttcgtgaaatccaccgactccgcccacgacatcgtcatcttctccaaatcatactgcccgtactgcaaaagagcaaaggccgtgtttaacgagcttgagttgaacaaagagccatatgttgtggaccttgatcagcgagaggaccgctcagagattcaggatgccttacttgagatagttggcaggcgtactgtccctcacgtttttgtcactggaaagcacctgggtggttctgacaatactgttgactcctacgaaagtgaaaaactggctagacttctaaacatcggagtcaaggacgacctttgagtgacatgctacatcggtcagcctgttcgtttggcttcaatccgtaccggcatctactacttcgatatagtttgtgactctatggactacagctacaacagtctaaatagctgatttatctccggagcgaacagtccagacagtctcttgttttgcagtaccgatggattctttgtgccac

SEQ ID NO: 46446 - protein, 135 aa, Zea mays
  misc_feature: Ceres CLONE 1451912-F
  misc_feature (44)..(108): Pfam Name: Glutaredoxin Pfam Description: Glutaredoxin
  misc_feature: SWISSPROT Homolog: EC 1.11.1.15 Peroxiredoxin
MVPLLDRRIVVAAEAAAFIALVAFGSASSSPKSFVKSTDSAHDIVIFSKSYCPYCKRAKAVFNELELNKEPYVVDLDQREDRSEIQDALLEIVGRRTVPHVFVTGKHLGGSDNTVDSYESEKLARLLNIGVKDDL

SEQ ID NO: 46447 - DNA, 788 bp, Zea mays
  misc_feature: Ceres CLONE 1451916-F
  misc_feature (328)..(328): n is a, c, t, g, unknown, or other
  misc_feature (742)..(742): n is a, c, t, g, unknown, or other
ggagctccccgcggtggcggccgctctagaactagtggatcccccgggctgcaggaattcgtctcacccctaatcgaaaaatcccggggcacgaaaccctaactgaacccatggcgctctccgccgctcgccggctctccaccaccgcgtcctcctcctccgtcgccgacgcgccgccaaagctctcttcgctgttccagaacccgaagcctcgaccgctgcctgtccgcggcgtcaaggagccgcggcggggggccaggcccaggccgaggcagccctgggaggaggaggcgggggcgctgctgctgcggctccacaaggggaggtnacctccagggcccccgacctctcgtcggcgcccgcatgcatgtctcacccgacgccgtcaagactgctgtcgagtggtctggcatgacaaccagcccgtcgctaatggctgtcagggagtgatttgcacaactttgcctggtttgggtgtcccactgttgaaccaaaaccggtttttgcatccaaagattaagagccttcttccaaatccagaaaaacaaaatggggggttcttggaaatggaaaattccgtgcatttttgagaccccaaaggggcccggcaaaaaaaggggttttttccaaaacggggaaaattcccccctgtttttggaggagccttggccccaaaaccccaaaattccctttaaataaaaaaacagtgttctccctctctataagccctcaaaattctccnttttttctgggcctttccaagaaaatttttttttttttttttgttt

SEQ ID NO: 46448 - DNA, 758 bp, Zea mays
  misc_feature: Ceres CLONE 1451924-F
  misc_feature: Encodes the peptide sequence at SEQ ID NO. 46449
  misc_feature (694)..(694): n is a, c, t, g, unknown, or other
ctggagctccccgcggtggcggccgctctagaactagtggatcccccgggctgcaggaattcgtctcacccctaatcgaaaaaacaaaaaaaccctagaactccaaaaccttcagccccacgctatggccctcgcactgcgcctccgacgggtcctcgcggcggcctccaccgcggcacccctgctccgcccgtccacctcggtcgcccggacttgcccgctcgttcccctcgcctccccagtcgcgccgctcccgctgccgccgtggagattcctgcccggcggcggcgccgggttcaggtccacggcggcggcagctgcttgggtgcgggaccgactatgggacggactacagcaagatctcccccgacaagatcctgcttcgagggctgcgactacaacaactggctcaacaccatggagttcccggaccccaagccgtcgagcaaatagatgatcaagacgtacctccagactctcgacaatgtcttctggagttatgacgaggccaacaagaggatgtatgcttttactacaaccacttatgatggttttcatgctgttaatgaccgaagaaatgtcagataaatttcacaggttgcctggagcagttttcattttgcctgattcatatccatatccacaaacaaaggagtacggaggagacaaatatgacaatggtgtcatatctccnggacctccacctgttcattatagcagaccgtctcgagctgacaggaacccgtaactaccgagga

SEQ ID NO: 46449 - protein, 44 aa, Zea mays
  misc_feature: Ceres CLONE 1451924-F
MIKTYLQTLDNVFWSYDEANKRMYAFTTTTYDGFHAVNDRRNVR

SEQ ID NO: 46450 - DNA, 716 bp, Zea mays
  misc_feature: Ceres CLONE 1451925-F
  misc_feature: Translation starting site: 221
  misc_feature (596)..(596): n is a, c, t, g, unknown, or other
  misc_feature (716)..(716): n is a, c, t, g, unknown, or other
ctccccgcggtggcggccgctctagaactagtggatcccccgggctgcaggaattcgtctcacccctaatcgaaaaaaccctcgttagagtttccttggcagtttttttccctcttgtcacaacaccccccacccacacacacccaaggccccaactgcagtgcccatccggcagtcatgtccatggccgcggaagcagcggcaacggtgaaaagagaagatgcggacgctagtcagcagcgacttcaagaatttccatgtgcaggactctgaggcgagggaatcgctgattatcctgaacctgatggcgcactgcgacgacagtgacatcccggtcttcaacgtcaactccaagatcctcgacaaggacatcgcgtactgcatgaagcacgcctcggcgcctcgcgccgatggcagtgatgctgagccaattgctgcgagtaacaaggcctcagcggacgatctcaactcctttgatgctgacttcgtcgatgttgacctgcacaccctcgtggagctcattaaggctgcagactacctgcacatcaatgggctgctagacctgacctgccacgtcagtctcggacatgatcaangcgaagactcctcatgagatacgcgagacattccacatcaagcatgacttctctcctgagcaagaggctaaagtgaggaccgagaatcgatgggcctttgaatgaacaagctgcaggctn

SEQ ID NO: 46451 - DNA, 772 bp, Zea mays
  misc_feature: Ceres CLONE 1451927-F
  misc_feature: Translation starting site: 197
  misc_feature (352)..(352): n is a, c, t, g, unknown, or other
  misc_feature (353)..(353): n is a, c, t, g, unknown, or other
  misc_feature (375)..(375): n is a, c, t, g, unknown, or other
ggagctccccgcggtggcggccgctctagaactagtggatcccccgggctgcaggaattcgtctcacccctaatcgaaaaacacaatttctcgcgctcctaccgccgccgcttcgttctctaaccttggctcccgctccctccgcaggagcatctcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaattgtcactcaccaagccaaaaggtaccttgaggatgtgattgnnccacagcaggccatcccgtccngcaggtattgtgggcgtgtttgacgtaccgctcaggctaagtctcgtcactccaatgggcagggaacctgccttgccaatctgcaaaattcttccaaaacctcccaaaatgcctaaaacaatgctgaggaaaaaggcttgaattccaaaccccttttgggcccaaattcaggggaaacggctcaaaagacggggcaaagaacctccccggttttggggccaaaaacccttaattggcccccccggggcaaataaaattttttttaaaaaaaaaaaaccccgtaaaaaaaggggtattttctcatcccccccggagttttaagaaggggaacccccccttatattgggggaaaagatatttgggaaattttccccccccttttttcaccaagattggg

SEQ ID NO: 46452 - DNA, 774 bp, Zea mays
  misc_feature: Ceres CLONE 1451932-F
  misc_feature: Encodes the peptide sequence at SEQ ID NO. 46453
  misc_feature (428)..(428): n is a, c, t, g, unknown, or other
  misc_feature (529)..(529): n is a, c, t, g, unknown, or other
ctggagctccccgcggtggcggccgctctagaactagtggatcccccgggctgcaggaattcgtctcacccctaatcgaaaaccggttccccgcggcatactctttcctgcgctctctctctcggttctgccgtgttcctcgcgtgcgctgtgtctccggtggcgccgcctccgccgcctccgtcgccctgcgccagattcgtggatatggctgataatgagaaagaagtgggggagggaaccaccccccgaggggcggattgggaagttgtgactctcacagcatctgcctatgaagcggcgccaggacctgtcggaacagaagtaaagcctgttaatgaaaatcaagagcatagttcatcccatgcactgctcatgtctgaccactttgtgtttccgccgagtgagcacgagaacctgccaatacnaaccagtttcgatgagatacagcctgaaaaagatgtgcaaaaacctagtacccctgtggaggattaaggtataaaaaggtgtttgggcctgaaagagttcntttgatgataaagggaaaccctcttaaatattatttggaaaaaaaattcccaccctgggtcggttccccccccctaaaaaaacccatggtttttttttcccaaaaatggtttaaacccggaaaatttttaaaaaaaagggcccctttaaatccctgaaaaaaagaggttttttcggcccccccacaatttttttgaaaagaaaaatattttgttttaaaaaacaaaaaaaaaaattttttttggt

SEQ ID NO: 46453 - protein, 95 aa, Zea mays
  misc_feature: Ceres CLONE 1451932-F
  misc_feature (74)..(74): Xaa is any aa, unknown, or other
MADNEKEVGEGTTPRGADWEVVTLTASAYEAAPGPVGTEVKPVNENQEHSSSHALLMSDHFVFPPSEHENLPIXTSFDEIQPEKDVQKPSTPVED

SEQ ID NO: 46454 - DNA, 773 bp, Zea mays
  misc_feature: Ceres CLONE 1451933-F
  misc_feature: Encodes the peptide sequence at SEQ ID NO. 46455
  misc_feature (437)..(437): n is a, c, t, g, unknown, or other
ggagctccccgcggtggcggccgctctagaactagtggatcccccgggctgcaggaattcgtctcacccctaatcgaaaaaaccgccgcgcccgatccgtctgctaggtcttgcacctccgggctctggccatggctgccgaagctggcccaatctccaaggtcctcatcgtcgtagcgatgcagacggaggcgatgccgctcgtccacaagttcaagctcgtcgaggcgcccgcccacgaatccacatttcctaaaggtgccccatgggttaggtaccatggcaactacaaaggcctccacattgaccttgtattgcctggaaaggatgctgttttaggagtcgacagtgttggtacggtatcggcagctcttttgactagttgttcccatcaaacattgaagccaaaccttatcattaatgctggcactgctggntgcttcaaggccaaaggggcaagcattggagatgtatcctggcatcaaatgtttctttccttgaccggagaatccaatccctgttttttgacctgattggaatggaaccccggaaaactccgccttttccaaaattcttgagggaaccattttgaaaaattgcaaatttcccacggggggattccctgaaatttcccccccccaagaaagaggggtcccggcaaatgtgtccccccaaaagaatatggggggggcctcttttgtattttgcccccaattttttttccccccccctttttttataaaccccctttttatttcggggggggaaaacac

SEQ ID NO: 46455 - protein, 133 aa, Zea mays
  misc_feature: Ceres CLONE 1451933-F
  misc_feature: SWISSPROT Homolog: EC 3.2.2.9 Adenosylhomocysteine nucleosidase
MAAEAGPISKVLIVVAMQTEAMPLVHKFKLVEAPAHESTFPKGAPWVRYHGNYKGLHIDLVLPGKDAVLGVDSVGTVSAALLTSCSHQTLKPNLIINAGTAGCFKAKGASIGDVSWHQMFLSLTGESNPCFLT

SEQ ID NO: 46456 - DNA, 770 bp, Zea mays
  misc_feature: Ceres CLONE 1451934-F
  misc_feature: Encodes the peptide sequence at SEQ ID NO. 46457
  misc_feature (514)..(514): n is a, c, t, g, unknown, or other
ctggagctccccgcggtggcggccgctctagaactagtggatcccccgggctgcaggaattcgtctcacccctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcccctccgcgggccacccggacccgtccgtcctgaagcagctgctccgcctgctggcgtccccgcgcgttttctccgagtccaccgagtccacgcccaccacgcggcgggcggctattcgcgctcaccgcggtgggccgcaccctgntgccggggccccgcctcgggccgttcttaccccgaattagtgctggaaaacacacagacccgctggggggggggtggcccccctgacaaaagctggtttgaccccgggggcccaacctttttgccgcccaaacccgggggcccccccacccctcttaccggagagaaaaaccccacccgggtttttcccccccgggggggggtatacaacccccttggggggccccccacagaaaagcggccccccgggtgttttt

SEQ ID NO: 46457 - protein, 129 aa, Zea mays
  misc_feature: Ceres CLONE 1451934-F
  misc_feature (117)..(117): Xaa is any aa, unknown, or other
MPPPSANGATAAAAAARDDMSPAEARLAMMELANMVSVPMALAAVIRLGVPAAVWAGGANAPMSAADLPSAGHPDPSVLKQLLRLLASPRVFSESTESTPTTRRAAIRAHRGGPHPXAGAPPRAVLTPN

SEQ ID NO: 46458 - DNA, 758 bp, Zea mays
  misc_feature: Ceres CLONE 1451936-F
tggagctccccgcggtggcggccgctctagaactagtggatcccccgggctgcaggaattcgtctcacccctaatcgaaaaacttatggttctctctgcttcgtgggacattgtgtgtaaaccttctttcttgctgaatactatgtatcaccaaggtggttgagtcgctcttcctacctttgattcgcctatggtttccatgcagtcagacataccagatcacctttctacttgttatttcacaatttgggtaaagtgggcttgcttgagatgattgtctacacaggatgtggagtatatcaatcggggagcctttgcagctacacaatctatgagcatggcgctcaggcaagcatatttctgcaccaattctgcaacacctgggcgatgggttccgaacatgcattctgggattgctgaacgctggatgagatccagcacaactctctttagttgggatgctgaaggtagacacctgttgaagaatgttggtgtgcatacgcattgaatatggtccacgcatttccttgatacccatttggactttcgagttagttgtagagatctcaggtattgactaagctaagcaaaaacaagtttgaaattgtgtggtccagtgctagcgacattttgcaactacacctgttgtaactgtaccagattgttgctgtgaatttgacaaccttaaaggaatattatactcttccgaaaaaaagaacccattcccccttatgtggggcgttctccgcgcttaaggg

SEQ ID NO: 46459 - DNA, 725 bp, Zea mays
  misc_feature: Ceres CLONE 1451937-F
  misc_feature: Encodes the peptide sequence at SEQ ID NO. 46460
  misc_feature (699)..(699): n is a, c, t, g, unknown, or other
  misc_feature (700)..(700): n is a, c, t, g, unknown, or other
ctccccgcggtggcggccgctctagaactagtggatcccccgggctgcaggaattcgtctcacccctaatcgaaaaatcgtttatccacggaacttccggtgccggcggcgaccacttgtggcgatccatccctcaccatgtcgtcggagaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggactaactggcctggcaaaggctgaagagaggcacatagaaatacttggctatctcctctatgttgccaaggtttgtgcgaagcaggaaggactttgagatggctatcgcgtcgtcatcaatgacggcccaagtggatgtcaatctgtttaccacatccacgttcatctcctcggaagcaggcaaatgaactggcccccagctaagaatatcttggaatggatcagggctaaggccaggactgctaccccttttcccaaaaaaccccggaaattccaaaaaactaggggccagggcccaactttgggctattttggggaatcccggaacctgcggcttttattttttaatagacccaaaattgtgtaaaaaaaaaannaaaagggaaaaaaaaaaaaaccgga

SEQ ID NO: 46460 - protein, 93 aa, Zea mays
  misc_feature: Ceres CLONE 1451937-F
  misc_feature (25)..(94): Pfam Name: HIT Pfam Description: HIT domain
MSSEKEAALAAVLDDSPTIFDKIIKKEIPSTVVYEDEKVLAFRDINPQAPTHILIIPKVKDGLTGLAKAEERHIEILGYLLYVAKVCAKQEGL

SEQ ID NO: 46461 - DNA, 755 bp, Zea mays
  misc_feature: Ceres CLONE 1451940-F
  misc_feature: Encodes the peptide sequence at SEQ ID NO. 46462
  misc_feature (410)..(410): n is a, c, t, g, unknown, or other
  misc_feature (450)..(450): n is a, c, t, g, unknown, or other
aagctggagctccccgcggtggcggccgctctagaactagtggatcccccgggctgcaggaattcgtctcacccctaatcgaaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaagatgccttccaccttcgggtccggntccacccctccatgtccttcgtatcaaacagatgctttcnttgtgctgggctgaaaggctccaaactgaatgaagggtggctttggcagcccccaggcacctgggctaggggggaatttggtcaggacccccttctggtcaaagaagggacaaaatgttgccctggcaatgaaactctccaacccccccatttaaatttccctggccccccaaaaatttttgaaaccaaaagtggggttcccccaaattcccgcgccccacctcccgaaaaaaaaaggggggggaaatttttcccggagggggaccccaaattcgccggaaacaaagaaaaaataaaaaagcccc

SEQ ID NO: 46462 - protein, 205 aa, Zea mays
  misc_feature: Ceres CLONE 1451940-F
  misc_feature (5)..(132): Pfam Name: Ribosomal_L16 Pfam Description: Ribosomal protein L16
  misc_feature (91)..(91): Xaa is any aa, unknown, or other
  misc_feature (104)..(104): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVRXHPSMSFVSNRCFXCAGLKGSKLNEGWLWQPPGTWARGEFGQDPLLVKEGTKCCPGNETLQPPHLNFPGPPKIFETKSGVPPNSRAPPPEKKRGGKFFPEGDPKFAGNKEKIKKP

SEQ ID NO: 46463 - DNA, 654 bp, Zea mays
  misc_feature: Ceres CLONE 1451950-F
  misc_feature: Encodes the peptide sequence at SEQ ID NO. 46464
  misc_feature (498)..(498): n is a, c, t, g, unknown, or other
  misc_feature (551)..(551): n is a, c, t, g, unknown, or other
  misc_feature (654)..(654): n is a, c, t, g, unknown, or other
cgattgggtaccgggccccccctcgagccactgcagtggtaaagggaagcagcaacatctcaagctcagagcctcagagcgccagccaagtcttgcggtcccgaagagcaacgcaacacaagatggtgaaggtcgcattcggaagcgtcggtgactccttcagcaccacctccatcaaggcctacgtggccgagttcatcgccaccctcctcttcgtcttcgccggcgtgggttccgccatcgccttcgggcaactgacgaatggcggcgcgctggaccctgcgggtctggtggcgatcgcggtggtgcacgcgctggccctcttcgtgggcgtctccgtggccgcgaacacctccggcggccacctgaaccccgccgtgacgttcggcctggccgtgagcggccacatcaccgtcctcaccggcctcttctactgggtggcccagctgctgggcgcgtccgtggcgtgcctgctcctcaggttcgtgacccacggcnaggacatcccgacccacggcgtctcaggcggcacaccgagctggagggcgtcntggtcgagatcgtcatcaccttcgcgctcgtctacaccgtgtacgccaccgaccgcgaacccaagaagggctcccctcggcacatcgcgcccatcgacatcgn

SEQ ID NO: 46464 - protein, 177 aa, Zea mays
  misc_feature: Ceres CLONE 1451950-F
  misc_feature (11)..(177): Pfam Name: MIP Pfam Description: Major intrinsic protein
  misc_feature (126)..(126): Xaa is any aa, unknown, or other
MVKVAFGSVGDSFSTTSIKAYVAEFIATLLFVFAGVGSAIAFGQLTNGGALDPAGLVAIAVVHALALFVGVSVAANTSGGHLNPAVTFGLAVSGHITVLTGLFYWVAQLLGASVACLLLRFVTHGXDIPTHGVSGGTPSWRASWSRSSSPSRSSTPCTPPTANPRRAPLGTSRPSTS

SEQ ID NO: 46465 - DNA, 687 bp, Zea mays
  misc_feature: Ceres CLONE 1451951-F
  misc_feature: Encodes the peptide sequence at SEQ ID NO. 46466
  misc_feature (16)..(16): n is a, c, t, g, unknown, or other
  misc_feature (22)..(22): n is a, c, t, g, unknown, or other
  misc_feature (304)..(304): n is a, c, t, g, unknown, or other
  misc_feature (312)..(312): n is a, c, t, g, unknown, or other
  misc_feature (382)..(382): n is a, c, t, g, unknown, or other
  misc_feature (390)..(390): n is a, c, t, g, unknown, or other
  misc_feature (393)..(393): n is a, c, t, g, unknown, or other
cgattgggtaccgggnttcttntcgagcactgcagtggtaaaggctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggntaaggggnagactcccgtgttccctcggatctttggccacgaggctggaggtatcatagagagtgttggagagggggngactgacntanctccgggcgaccatgtccttccccccctcactgttgagtgcaaggagtgttgccactgcaagtccgcagaaaagcatttgtggtgatctggttcaggatttacccccaccggcggagagatgattgccaaatgccaagccccgcttttttactctacccacacgcccatctcacccctttgctcgcccccacactcctttcctcaaattaacctctcttgctttccctctcttcttctcccaaacaaccaacatcccccgctcccccctctcatccatgtccgtgtgctccggt

SEQ ID NO: 46466 - protein, 113 aa, Zea mays
  misc_feature: Ceres CLONE 1451951-F
  misc_feature (34)..(114): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (56)..(56): Xaa is any aa, unknown, or other
  misc_feature (59)..(59): Xaa is any aa, unknown, or other
  misc_feature (82)..(82): Xaa is any aa, unknown, or other
  misc_feature (85)..(85): Xaa is any aa, unknown, or other
  misc_feature (86)..(86): Xaa is any aa, unknown, or other
MATAGKVIKCKAAVAWEAGKPLSIEEVEVAPPQAMEVRVKILFTSLCHTDVYFWEXKGXTPVFPRIFGHEAGGIIESVGEGXTDXXPGDHVLPPLTVECKECCHCKSAEKHLW

SEQ ID NO: 46467 - DNA, 668 bp, Zea mays
  misc_feature: Ceres CLONE 1451956-F
  misc_feature: Encodes the peptide sequence at SEQ ID NO. 46468
  misc_feature (547)..(547): n is a, c, t, g, unknown, or other
cgattgggtccgggccccccctcgagccctgcagtggtaaagggggcttcggcccagacggcagcggtaccgcacccgctccaccaagctcgtcggcgacatgaatccgcccgcagcagccgcgtccaccggagcaggaggacacgccgcggcgcctgcggcagccccggagtacgtgcactacccgaggctctcgccagaggaggtggccccgcccccgccttatcacgccgccaccgacgcgccgtccgcctacggaggcaacccctacatctactcccccgccggcggcgccgccacctccccgaagaatacgatggactccgtgaaggacgtgctcggcaagatgagcaagaggtttgtcgaggcggcccgcaagaccgagaccatcgccggcaatttctggcagcacttgaaaactggaccaagcattactgatgcagcaatgagcaggatctcacaggtcaccaaagtcattgcagagggtggatatgacaaaattttccatcaaacttttgaggtcgcccctggtggaaagctcaagaanccatatgcatggtatctgtcaacctcggctggtcctggtatgggtgggctttacctggtccaatgtaaaactggctttttgtaagggatacccatttgcataccaggttggagacaaaact

SEQ ID NO: 46468 - protein, 176 aa, Zea mays
  misc_feature: Ceres CLONE 1451956-F
  misc_feature (149)..(149): Xaa is any aa, unknown, or other
MNPPAAAASTGAGGHAAAPAAAPEYVHYPRLSPEEVAPPPPYHAATDAPSAYGGNPYIYSPAGGAATSPKNTMDSVKDVLGKMSKRFVEAARKTETIAGNFWQHLKTGPSITDAAMSRISQVTKVIAEGGYDKIFHQTFEVAPGGKLKXPYAWYLSTSAGPGMGGLYLVQCKTGFL

SEQ ID NO: 46469 - DNA, 660 bp, Zea mays
  misc_feature: Ceres CLONE 1451965-F
  misc_feature: Encodes the peptide sequence at SEQ ID NO. 46470
cgattgggtacgggccccccctcgagccactgcagtggtaaagggaagcattcgatccgttcccttgccctaagacccacccctgatttcatttccccaatcatggcggcggctctgtcggggacggcggtgtccacggctgcgcttctagccccaatccgagctccaaccagcgcgtttatccggcgctcccagctcacctgtcatcgcctccactcactaaaatgccgccgcgctgggcccatcgtccccgcggccgctgctgccgcggcgggcagcagctcgccgtcgtcagccgatttccacggcgagtgcttcgtggtgggcgacaatatcgacactgaccagatcatccccgacgagcacctcactctggtgccctccaagccggacgagtaccgcaagctcggttccttcgccttcgcggggctcccatccgcagcctacccgacgccgttcgtcgctccgggtgaggagacctcccgctacgccatcattgtcgacggagccaacttcgggtgcggttcctctcgcgagcacgcgcccgtcacgcttggggccgctggcgcacgcgtcattgttgcggagggctacgcgcgcatcttttttcgcaactccgtgaccactgaagaggtgtaccctctggagctcacggacgtg

SEQ ID NO: 46470 - protein, 186 aa, Zea mays
  misc_feature: Ceres CLONE 1451965-F
  misc_feature (61)..(186): Pfam Name: Aconitase_C Pfam Description: Aconitase C-terminal domain
  misc_feature: SWISSPROT Homolog: EC 4.2.1.33 3-isopropylmalate dehydratase
MAAALSGTAVSTAALLAPIRAPTSAFIRRSQLTCHRLHSLKCRRAGPIVPAAAAAAAGSSSPSSADFHGECFVVGDNIDTDQIIPDEHLTLVPSKPDEYRKLGSFAFAGLPSAAYPTPFVAPGEETSRYAIIVDGANFGCGSSREHAPVTLGAAGARVIVAEGYARIFFRNSVTTEEVYPLELTDV

SEQ ID NO: 46471 - DNA, 669 bp, Zea mays
  misc_feature: Ceres CLONE 1451967-F
  misc_feature: Encodes the peptide sequence at SEQ ID NO. 46472
tcaattgggtaccgggccccccctcgagccactgcagtggtaaaggagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaggaaggttacccggcgttcgcgctggtgaacagggcgaccggggaggccatcaagcactcgctggggcagtcccacccggtgccgcctggtgccctacaaccccggactttttggaacgaatcggtgctgtgtgacggaaaagccccgacctcggcaacggcttccgcctgcgtcggatggtccaacaacatcttacctcaacttcaacgccctccacggggacaa

SEQ ID NO: 46472 - protein, 177 aa, Zea mays
  misc_feature: Ceres CLONE 1451967-F
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNRATGEAIKHSLGQSHPVPPGALQPRTFWNESVLCDGKAPTSATASACVGWSNNILPQLQRPPRGQ

SEQ ID NO: 46473 - DNA, 658 bp, Zea mays
  misc_feature: Ceres CLONE 1451975-F
  misc_feature: Encodes the peptide sequence at SEQ ID NO. 46474
  misc_feature (476)..(476): n is a, c, t, g, unknown, or other
  misc_feature (598)..(598): n is a, c, t, g, unknown, or other
  misc_feature (633)..(633): n is a, c, t, g, unknown, or other
cgattgggtacgggcccccctcgagcactgcagtggtaaagggatcggttccacacaagccgccgtcatgtcgaagcgaggtaggggaggttcggctgggaacaagttccgcatgtcactgggtctaccggtggcggccacggtgaactgcgcggacaacacgggcgcgaagaacctctacatcatctccgtcaagggaatcaagggccgcctcaaccgcctcccgtccgcctgcgtcggcgacatggtcatggccaccgtcaagaagggaaagcccgacctcaggaagaaagtgatgcctgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgctagtgcagcanatgccatcgtttgagagcttgttggaatgtgtttagacttgagtatgatcatctcaattgtgtgttgcagctgttgtaagggtgctattggacttgatggctccttttatgtttggtcactncattttgtagtgaacagaaatttgtctaccctggntgcctcaagtttgctgtctgagatg

SEQ ID NO: 46474 - protein, 140 aa, Zea mays
  misc_feature: Ceres CLONE 1451975-F
  misc_feature (19)..(140): Pfam Name: Ribosomal_L14 Pfam Description: Ribosomal protein L14p/L23e
  misc_feature (137)..(137): Xaa is any aa, unknown, or other
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAAXAIV

SEQ ID NO: 46475 - DNA, 678 bp, Zea mays
  misc_feature: Ceres CLONE 1451980-F
  misc_feature: Encodes the peptide sequence at SEQ ID NO. 46476
cgattgggtaccgggccccccctcgagccactgcagtggtaaaggaagagacgagggtggtcgccgccttctcccgctctgcctctcttcatgggccaggtcgagagccaggctacccgtccgtcggaggagccttctccacccgtcgtggagccgtcgccgacgacttctgccccgcctccgtcctcccttgaggcgcttgccgcagaggccatgtcatttgacgaggatgacactgaggagtcaatcgaaatgaaggtacagaaagctctggactgtccatgtgtcgctgatttgaaaaatggtccttgtggaggtcaattcgtcgatgcattttcttgcttcctcaggagcacaaaaaaagagaagggatcggattgcgtgaaacccttcatcacgttgcaagactgcattaaacccaatccagaggcattctctaaggagattttggaggaagaagagaatgatgaggaggcagataagtccaaactgaaagttagagctccatcatggcccagagaatcccaaccttaagggtccaggacccaatacaataaaatgtccaagtgaaggaaccttcagaaagaggagattactctctatatctggatcgcctggaaatctgcctgggggtccctcgggacctgggcatctatggcgggggcccttccggagggg

SEQ ID NO: 46476 - protein, 106 aa, Zea mays
  misc_feature: Ceres CLONE 1451980-F
  misc_feature (26)..(69): Pfam Name: CHCH Pfam Description: CHCH domain
MSFDEDDTEESIEMKVQKALDCPCVADLKNGPCGGQFVDAFSCFLRSTKKEKGSDCVKPFITLQDCIKPNPEAFSKEILEEEENDEEADKSKLKVRAPSWPRESQP

SEQ ID NO: 46477 - DNA, 681 bp, Zea mays
  misc_feature: Ceres CLONE 1451988-F
  misc_feature: Translation starting site: 132
  misc_feature (282)..(282): n is a, c, t, g, unknown, or other
cgattgggtaccgggccccccctcgagccctgcagtggtaaagggagcgaccaagtcgttcttccaggaaacgaaggggaagggaagggcagggagggcgacagaggctgatcggagctcatcatcgttcgatggcggtgaccgcgacgacggtcgcggcggctaccacgatgctggcggccgtggcggcggtcttcctgaccctggtgctctgcttctacgtcttcctctgcgccaagcggtaccgcggcgaggcgccgccgcacgcggtggccgccgccngacgcggcagcgtcaggacgtggctgctcttcgtgttcagcgtccggggaagcgcaggcgcgcacgtcgggcggggcacgggatggtgctacgacgggcggctcgaccaacagtcgatggccaaacctgcccccgcggggaggtgggcagggcccacaaggccgccgactgcgccgtgtgcatcacggagcttgccccggggggagacggcccgccggcctgcccccggtgcgggcccgcccttccacggtggactgggtccaactgggggttccccctccccactcaccttgcccggtctgccggtgcccccgcccggggaaaaacccggccgttcccgcccggcgttggccaccgccccgaggcccgacccgggaattccccccaactttccccacc

SEQ ID NO: 46478 - DNA, 691 bp, Zea mays
  misc_feature: Ceres CLONE 1451992-F
  misc_feature: Encodes the peptide sequence at SEQ ID NO. 46479
  misc_feature (411)..(411): n is a, c, t, g, unknown, or other
cgattgggtaccgggccccccctcgagccctgcagtggtaaaggagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaaatacaccaatgccttccttggctttgggccaaagaacaccaactttgcagttgaattgacatacaactatggcgttgacaantatgagcccccaacgggctttggccatttcccaattgctaatgatgatgtgtacaagttacctgacaatatccaatcccagggtggaaaaaccccccgcaaaccgggtccctgtcaagggaggatccctctgtttttgccctccgcacaggatccctggagggcacactgttttgaacctcacccaaaagggctaaacacccccgtgccccttctttggccagggccaaggccttacttgtatgggggaaccttagaaccgcttccccaccaggttttta

SEQ ID NO: 46479 - protein, 180 aa, Zea mays
  misc_feature: Ceres CLONE 1451992-F
  misc_feature (24)..(144): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
  misc_feature (87)..(87): Xaa is any aa, unknown, or other
MATGSEASKAAEAVVDWHKHDSKRMLHAVYRVGDLDRTIKYYTECFGMKLLRKRDVPDEKYTNAFLGFGPKNTNFAVELTYNYGVDXYEPPTGFGHFPIANDDVYKLPDNIQSQGGKTPRKPGPCQGRIPLFLPSAQDPWRAHCFEPHPKGLNTPVPLLWPGPRPYLYGGTLEPLPHQVF

SEQ ID NO: 46480 - DNA, 828 bp, Zea mays
  misc_feature: Ceres CLONE 1451998-F
  misc_feature: Encodes the peptide sequence at SEQ ID NO. 46481
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (629)..(629): n is a, c, t, g, unknown, or other
  misc_feature (828)..(828): n is a, c, t, g, unknown, or other
cctatttctccacccccttaacttgccgcggttttnnnntttggnnnttttaaaactggagctccccgcggtggcggccgctctagttctagtggatcccccgggctgcaggaattcgcacgagaccattacctagaacatcctaatctaaaaaaaaatagagttcacacgcacaacccgccgccgcacgccgggatctcgatagactctggctgccgcggaaagcggaaagaaggcagggatcgtgggcaagatgcagatcttcgtgaagacgctgtcgtcgacaaggacgatcacgctggaggttgagccttcggacacggtggcggacgtgaaggccaaggtgtacgagtcggagggcgtcccgccggccgagcagcgcctcatcttcgcggggaagcacctgcgcgacgggtgcacgttggttgactacaacatccccaaggaaacaatgctgtcctggtgctgccgcctcctcggaggcgggccctaaaaacgaatagggagaacgtttcacctctccctagaaggggcacgccccagccccaatgaaccccggggcttcgactcccgttgcttgggtccgggtcctggcaccaattgaaggcccccctggggataggtggagnagggctgcgcccatgccagtggccccttaacccgggaggggcgggctcagggggggggctcctgggggggggcccttggcccaacccgggaacttcccccccgggtaatttggggggccctctcccgttcgggcgaatctgagaatttgtggaggggcggggtatagataaggttaggtgaccgcgttgcgataccccn

SEQ ID NO: 46481 - protein, 79 aa, Zea mays
  misc_feature: Ceres CLONE 1451998-F
  misc_feature (6)..(75): Pfam Name: ubiquitin Pfam Description: Ubiquitin family
  misc_feature: SWISSPROT Homolog: EC 3.1.2.15 Ubiquitin thiolesterase
MQIFVKTLSSTRTITLEVEPSDTVADVKAKVYESEGVPPAEQRLIFAGKHLRDGCTLVDYNIPKETMLSWCCRLLGGGP

SEQ ID NO: 46482 - DNA, 653 bp, Zea mays
  misc_feature: Ceres CLONE 1451999-F
  misc_feature: Encodes the peptide sequence at SEQ ID NO. 46483
ccgattgggtaccgggccccccctcgagccctgcagtggtaaaggctacttccaaacggacaaaccccatcgaaaaccctctctcaaattcacaaggccccgccgccgccgcctcgtcccccattcatcttcgccgaaaccctaaccctagtcgccgcggccacccttcccggcgacgccatgtcgaacccgaagggctccaagatgctccagttcatcaactaccgcatgcgggtgacgatccaggacgggcgccaacttgtgggcaagttcatggcgttcgaccgccacatgaacctcgtcctcggcgattgcgaggagtttcgccgcctcccgccctccaagtcctccaagactaccggtgaacgcgaagagcgccgcacgctcggcctcctcctcctccgcggcgaggaggtagtatccatgaccgtcgagggcccaccaccgcccgacgagtcccgcgccaaggccgcggcggcgggcggagccctcgccggccctggaatcggcccgcgcggctgggcgcggggtgcccaccggcccgctgctccagggaactcccggggctccctggccctgtacgtgggggttggtggaacccgcccccgggctgatgcaccccccagaatctcggggccgccgaatgcccaacc

SEQ ID NO: 46483 - protein, 157 aa, Zea mays
  misc_feature: Ceres CLONE 1451999-F
  misc_feature (7)..(84): Pfam Name: LSM Pfam Description: LSM domain
MSNPKGSKMLQFINYRMRVTIQDGRQLVGKFMAFDRHMNLVLGDCEEFRRLPPSKSSKTTGEREERRTLGLLLLRGEEVVSMTVEGPPPPDESRAKAAAAGGALAGPGIGPRGWARGAHRPAAPGNSRGSLALYVGVGGTRPRADAPPRISGPPNAQ

SEQ ID NO: 46484 - DNA, 679 bp, Zea mays
  misc_feature: Ceres CLONE 1452000-F
  misc_feature: Encodes the peptide sequence at SEQ ID NO. 46485
cgattgggtaccgggccccccctcgagccctgcagtggtaaagggcggcctccacggctccacgtgacctcccaaacctagacctagttgtccttcctgttcaacctgcatagcggcggcgcgtcctgccttcagagagagagggagagagagcgcttgatctccgtaggcatggcatgggaggaggaggcggtagaagaggaggattacggggaggagatgtcggcttcggagtcggaggaggacgtcgtggtggggcagatgccgacggttatggtgccaaagcatatcaataagcggtccctgaagaacaaggcgctgtctgttaccctcgacaagaaagcgctcagggatttcgtgactgggttccacaagcggaagaaaaagagaagaaaggaggcgcataagattttgcttgaccaccccagaggaagaagaaaatacaagaccgcaagaggaggaaagaagagaaggagattgctctgtatggtagagtactgacatcggataaaaatgatggtgctggattagaaaacgaaaatatcggcgatgatggtgaggatatggaacatgacaaacctttgtctgaaatctaaacctacgaagatgatgggacccgaactgtagtccccccccctgaaattcctcctgaagaagatgacattgtccccaaaactgt

SEQ ID NO: 46485 - protein, 109 aa, Zea mays
  misc_feature: Ceres CLONE 1452000-F
MAWEEEAVEEEDYGEEMSASESEEDVVVGQMPTVMVPKHINKRSLKNKALSVTLDKKALRDFVTGFHKRKKKRRKEAHKILLDHPRGRRKYKTARGGKKRRRLLCMVEY

SEQ ID NO: 46486 - DNA, 694 bp, Zea mays
  misc_feature: Ceres CLONE 1452016-F
  misc_feature: Encodes the peptide sequence at SEQ ID NO. 46487
  misc_feature (176)..(176): n is a, c, t, g, unknown, or other
  misc_feature (309)..(309): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
cgattgggtaccgggccccccctcgagccctgcagtggtaaagggctcttagacatgattagaaacggctaagcaataacgcaaagattcggctgacaatggggaaggggttcccgtcgtacttggcgatgaagacggggccggagggcggcgacggcgcggcggcggcggcgcancaggcgctcatcgacgcggacctgcggaacctcggcgtcgccgcgcgaaagctcgccaaccacgccttcgtcctcggcggcgggttggggttcggcacttccttcctcaagtggctggccttcctcgccgcantgtatctcttgatattggaccgcacgaactggaagaccaacatgctgacagctctcttggctccttacggtgggggggggctgcctaatgtgctgttttctctgatcaaaggannnagtgggaaaatggattgcgattattgctcttatttctgcgccctattttttccgcgccccttcccagattggttagaggcttcccggtccatcctccctgctcacagcaagtcccccccagtcctgttccgcaccccctttcagggagtgacctcccccgggggcctttcaatggccctggcgatcggagggttccccggccccccaaaaccccctccggggcggtcaaaaggaactccccgaacccccctctccggaagggccaatgg

SEQ ID NO: 46487 - protein, 198 aa, Zea mays
  misc_feature: Ceres CLONE 1452016-F
  misc_feature (9)..(171): Pfam Name: WCOR413 Pfam Description: Cold acclimation protein WCOR413
  misc_feature (26)..(26): Xaa is any aa, unknown, or other
  misc_feature (71)..(71): Xaa is any aa, unknown, or other
  misc_feature (109)..(109): Xaa is any aa, unknown, or other
MGKGFPSYLAMKTGPEGGDGAAAAAXQALIDADLRNLGVAARKLANHAFVLGGGLGFGTSFLKWLAFLAAXYLLILDRTNWKTNMLTALLAPYGGGGLPNVLFSLIKGXSGKMDCDYCSYFCALFFPRPFPDWLEASRSILPAHSKSPPVLFRTPFQGVTSPGGLSMALAIGGFPGPPKPPPGRSKGTPRTPLSGRAN

SEQ ID NO: 46488 - DNA, 663 bp, Zea mays
  misc_feature: Ceres CLONE 1452023-F
  misc_feature: Encodes the peptide sequence at SEQ ID NO. 46489
tcgagccctgcagtggtaaagggttacctacaggctacagctcccgtctctccgccgcttgcttggaaaacgaagaaaccctcctccaccaacccaatccagctacatccgtctgggtgaactccagggccaggagcagttcgccgccttcgttcgcatcacctacgcggttcgatccaactggcaggaaggaacgtgatggccaagacgagctcgttcaagctggagcacccccttgagaagaggcagtctgaggctaatcggatcagagagaagtaccctgacagaattccagtgattgttgagaaggctgagaggagtgacattcctgacatcgacaagaaaaagtacctcgtccctgctgatcttacggttggaaaattccgtgtatgtttgtaggaaaagaaatcaagctcagtgctgagaaagctatcttcaatcttggggaagaaaccctttccaccaacagctgctcttgatgtccttccatcttatgaaaagaacaaggatgaaggatggattcctcctactggaactaccgggggtggaaaaacccccttcggggctcctccaaaaggggtcccccccaaaccggggttcggcccttggccccttggtttcccaaaatggaaggccccgtgccctcggggaaaaaaaaaaacc

SEQ ID NO: 46489 - protein, 66 aa, Zea mays
  misc_feature: Ceres CLONE 1452023-F
  misc_feature (15)..(67): Pfam Name: MAP1_LC3 Pfam Description: Microtubule associated protein 1A/1B, light chain 3
MAKTSSFKLEHPLEKRQSEANRIREKYPDRIPVIVEKAERSDIPDIDKKKYLVPADLTVGKFRVCL

SEQ ID NO: 46490 - DNA, 657 bp, Zea mays
  misc_feature: Ceres CLONE 1452029-F
  misc_feature: Encodes the peptide sequence at SEQ ID NO. 46491
  misc_feature (552)..(552): n is a, c, t, g, unknown, or other
  misc_feature (569)..(569): n is a, c, t, g, unknown, or other
  misc_feature (657)..(657): n is a, c, t, g, unknown, or other
cgattgggtacgggccccccctcgagccctgcagtggtaaaggggagtggacaggacagggtcagagccttttccacgcgggaaccttcgcggcagcgtcgcccccatcctcatccggaggagggcacggggccacgccacgcctggaccgcgcgaggcggcacgagctgggctacgcagcgcagcccatataaacgcgctccgagaccctccattcgccttggtggccaaggaggcaaggaaacaggcagctctccacggacaacgcgattctatttatttatctggctgccagccagccagccgcctttcgaaaccgagcacgagggagccgacgtggtggtctctggaacctggttcgagcgagcgagcgacccatctatccagccgcctgccgggaatttctgtgacgacgacgaggaggaggagggggtatggcaatggtggcggcgcagggaggcggccggagggacgccgaggcggagctcaacctgccgccggggtcccggttccatcccaccgatgaagagctggtggtgcactacctctgcnagaaggtggcgtgtcancagctgcccgtgcccatcatcgccgaggtcgacctttacaatttcgacccgtgggatcttccagaagaggcgctgtttgggcgcaagn

SEQ ID NO: 46491 - protein, 74 aa, Zea mays
  misc_feature: Ceres CLONE 1452029-F
  misc_feature (20)..(74): Pfam Name: NAM Pfam Description: No apical meristem (NAM) protein
  misc_feature (40)..(40): Xaa is any aa, unknown, or other
  misc_feature (45)..(45): Xaa is any aa, unknown, or other
MAMVAAQGGGRRDAEAELNLPPGSRFHPTDEELVVHYLCXKVACXQLPVPIIAEVDLYNFDPWDLPEEALFGRK

SEQ ID NO: 46492 - DNA, 684 bp, Zea mays
  misc_feature: Ceres CLONE 1452031-F
  misc_feature: Encodes the peptide sequence at SEQ ID NO. 46493
  misc_feature (513)..(513): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
acccgcggtggcggccgctctagaactagtggatcccccgggctgcaggaattcgcacgagaccattacctagaacatcctaatcgaaaacacgtttctctgcgactcgcacggcccgcgcccaccaccgaccaccccacctggttcggtcggcactcggcaccccgccccgcatacatgccgccgcccagcctcaccgtggcgcgcgacccggccgccgccgccaccacgcggcaccgcaaggtccacccgacgccgggcggaggcgcagggacgacgaaggagatgggcgcggcggaggggtgggcgcggcccgagtggtgctcggtggcgggcgcctcggccgtgctgcggcggcacccggcgcccgcgctcctcgggtgcggcctcctgctcttcatggccgtcgagtacaccatccccatggtcaggccggacgcgccgccgctcgacctgggcttcgtcgccaccaggggcttgcacgccgccgtcgccgcgaggccctgggtcaantcgnnntctcgcgcgctcaaaacgggtcttcgtcgcgatgcaggcggcgtacatcctggtgggcatccctcgcgagcaggggccgcgcgccgccgtcgccacgctcatgatgtttcacctgccggggcgcgctgggtggcccaccaagcttccggtggccgaaggatttcc

SEQ ID NO: 46493 - protein, 169 aa, Zea mays
  misc_feature: Ceres CLONE 1452031-F
  misc_feature (112)..(112): Xaa is any aa, unknown, or other
  misc_feature (114)..(114): Xaa is any aa, unknown, or other
MPPPSLTVARDPAAAATTRHRKVHPTPGGGAGTTKEMGAAEGWARPEWCSVAGASAVLRRHPAPALLGCGLLLFMAVEYTIPMVRPDAPPLDLGFVATRGLHAAVAARPWVXSXSRALKTGLRRDAGGVHPGGHPSRAGAARRRRHAHDVSPAGARWVAHQASGGRRIS

SEQ ID NO: 46494 - DNA, 781 bp, Zea mays
  misc_feature: Ceres CLONE 1452032-F
  misc_feature: Encodes the peptide sequence at SEQ ID NO. 46495
  misc_feature (21)..(21): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (478)..(478): n is a, c, t, g, unknown, or other
aaaatctctctccccccctanacacgacctgaaannnnnncccccnnnnnnngcgattgggtaccggggcccccctcgagccactgcagtggtaaaggtctacgccggccggtccgcctcccagccccgaccgttcgcgtggttcacgcggcggctgctggccgcgtgcgtggtcatcggcgtgcttatgggcgtgaacaacctgctcttctcgtacagctcctcgtacctgcccgtgtccacctcctcgctgctgctgtccaccccgctggccttcacgctcgtgctggccgccgtcatcgtgcgccacccgctcaccttctctaaactcaatgccgcgatgctcctcacgcctccgctccatgctgcaggcgcttcggttgttcgactcatccgatctcccccacagtggaactcggcgccggtactccaatgggatatgggggtatgtttagggaacaatgacatgataacgganaaacccttccttgatgcaatctggtgcaacgacataacgccgtacaagacccgcccccccttttttccccgcacgtaaaagtgaaacataaacagccgcccaaaaaaactccccttactattacccccctttggccccattgtcttttcccctaagccccctagcacatttggctaacctttcgggaaccccattgcccccccccccgtacatgcgagcaccctaactgcccgcaaaaaacgcccacccaaaggcgctatcgataccccgcaaccagagaacgctattagccagactaccccc

SEQ ID NO: 46495 - protein, 184 aa, Zea mays
  misc_feature: Ceres CLONE 1452032-F
  misc_feature (7)..(7): Xaa is any aa, unknown, or other
  misc_feature (12)..(12): Xaa is any aa, unknown, or other
  misc_feature (13)..(13): Xaa is any aa, unknown, or other
  misc_feature (16)..(16): Xaa is any aa, unknown, or other
  misc_feature (17)..(17): Xaa is any aa, unknown, or other
  misc_feature (159)..(159): Xaa is any aa, unknown, or other
KSLSPPXHDLKXXPPXXAIGYRGPPRATAVVKVYAGRSASQPRPFAWFTRRLLAACVVIGVLMGVNNLLFSYSSSYLPVSTSSLLLSTPLAFTLVLAAVIVRHPLTFSKLNAAMLLTPPLHAAGASVVRLIRSPPQWNSAPVLQWDMGVCLGNNDMITXKPFLDAIWCNDITPYKTRPPFFPRT

SEQ ID NO: 46496 - DNA, 695 bp, Zea mays
  misc_feature: Ceres CLONE 1452037-F
  misc_feature: Encodes the peptide sequence at SEQ ID NO. 46497
  misc_feature (695)..(695): n is a, c, t, g, unknown, or other
tccccgcggtggcggccgctctagaactagtggatcccccgggctgcaggaattcgcacgagaccattacctagaacatcctaatcgaaaaatcgagaccaacagatggaggccggcctgcgcgcgctaggccacagctacttcggcggcggcggcctcggtgggttcgcggccgcgcgtgccacccggctccggcgccagcgccagcgccgcatggccgccttctgctccctcgctgttaatggagatgggaatggcgcggcgggtggccccgtggggagcggcgtcgaggtggcgcgcgccaggaggatgctccatgtcgtgctcgtctcgccgctgataccaggaaatacagggtccattgcaaggacatgtgcagcatctgcagttggcctgcatcttgtcggggtaagccattaggctataaggtagacgacacgaagttgaagcgcgcgggattggattattggccatacgttgttgtcaagattcatgactcttgggaccacttctgtgattatttcatgaaacaggaaggagataaaaggctgttggcgttcaccaaaagaggcacacacatccattcagatttctcctacaggccaggggactggctagtcttcggttccgaaacaaaagggttgcctcagcaagccctcgaggattgctgcagagaaggcctaggcggcgggacn

SEQ ID NO: 46497 - protein, 108 aa, Zea mays
  misc_feature: Ceres CLONE 1452037-F
  misc_feature (1)..(107): Pfam Name: SpoU_methylase Pfam Description: SpoU rRNA Methylase family
MCSICSWPASCRGKPLGYKVDDTKLKRAGLDYWPYVVVKIHDSWDHFCDYFMKQEGDKRLLAFTKRGTHIHSDFSYRPGDWLVFGSETKGLPQQALEDCCREGLGGGT

SEQ ID NO: 46498 - DNA, 653 bp, Zea mays
  misc_feature: Ceres CLONE 1452044-F
  misc_feature: Encodes the peptide sequence at SEQ ID NO. 46499
  misc_feature (485)..(485): n is a, c, t, g, unknown, or other
  misc_feature (490)..(490): n is a, c, t, g, unknown, or other
  misc_feature (553)..(553): n is a, c, t, g, unknown, or other
  misc_feature (588)..(588): n is a, c, t, g, unknown, or other
  misc_feature (589)..(589): n is a, c, t, g, unknown, or other
  misc_feature (611)..(611): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
tgggaccgggccccccctcgagcactgcagtggtaaaggtgcttatctctctgctcgctcatctctctggtgtccatccccagcccaccgagctccctccatcttgatccccatggccgaacgccctcccgtcctccaactcgccagcgcttggcttcctgcttgccaagtccatctccctccctagcgctgtcccacctcctgctcctccaaggcgctcagttccagctcgccggctgtgcaactcgcccatggcgcccatctctctggacgcgacctccctgctcctcctttccccagccgcggtcttccctgctctagcccagccgagctcgtccctgcgcgcgtgttctcctgcgtccagccgagcgcgcgaaacttctctgctcacggcactccctgtctgctcggccatggtgaaaccctccttaccatggatgcccgaagtcctctgctcgttctcatggccaccgtcgaagcttcangcgcngccatcatctctgctgccctgggcgcgtactgtgactctccatcgcgactatctgatgccggncgtggccgtcaaactcgcccagatcggatttttgnntgggcgcgtacacgtccttctnaacggnnnnnnnnnnnnnnnnnnnnnnnnnnnnnnnnnnnnn

SEQ ID NO: 46499 - protein, 68 aa, Zea mays
  misc_feature: Ceres CLONE 1452044-F
  misc_feature (24)..(24): Xaa is any aa, unknown, or other
  misc_feature (26)..(26): Xaa is any aa, unknown, or other
  misc_feature (47)..(47): Xaa is any aa, unknown, or other
  misc_feature (59)..(59): Xaa is any aa, unknown, or other
MVKPSLPWMPEVLCSFSWPPSKLXAXPSSLLPWARTVTLHRDYLMPXVAVKLAQIGFLXGRVHVLLNG

SEQ ID NO: 46500 - DNA, 685 bp, Zea mays
  misc_feature: Ceres CLONE 1452046-F
  misc_feature: Encodes the peptide sequence at SEQ ID NO. 46501
tggagctccccgcggtggcggccgctctataactagtggatcccccgggctgcaggaattcgcacgagaccattacctagaacatcctaatcgaaaaacaataggcattcaatcattcaagcgaagcagccaccactctctccactgtgactccgtgacctgcctgccctgctgcacaagcacagaacacacaccccgcacaccgcaccagctcagcgcagctcaccaagacaatcaatcatggctcacccgcgcagtgtcgctgccgctgcccccctcctcctgctgctcgccgccgccgccgccgccgcagcggggctcgtgtccgccgcgtcgccggcagccagcgacttcgtccgcaagtcgtgccgcacgacgcagtacccgtcggtgtgcgagcaaagcctggcgtcgtacggcgggtcgccgccgccacgaagcccgcgggagctggcgcgcgccacgctgtcggtgagcgcggaccgcgcgcgcgccgcgtcagcttacatgggccgcctgtgcggcgccagcaacggcaaaggcacgaagaaggggtcgggatcggcgtcggagtcggcgtcggcaggtcccgtgcgagactgcctggacaatctggcggacagcgtgggccacctccgcgacgcagcgcaggagatgggcggctcccggatgggccgcgcggtga

SEQ ID NO: 46501 - protein, 148 aa, Zea mays
  misc_feature: Ceres CLONE 1452046-F
  misc_feature (33)..(148): Pfam Name: PMEI Pfam Description: Plant invertase/pectin methylesterase inhibitor
MAHPRSVAAAAPLLLLLAAAAAAAAGLVSAASPAASDFVRKSCRTTQYPSVCEQSLASYGGSPPPRSPRELARATLSVSADRARAASAYMGRLCGASNGKGTKKGSGSASESASAGPVRDCLDNLADSVGHLRDAAQEMGGSRMGRAV

SEQ ID NO: 46502 - DNA, 700 bp, Zea mays
  misc_feature: Ceres CLONE 1452049-F
  misc_feature: Encodes the peptide sequence at SEQ ID NO. 46503
  misc_feature (479)..(479): n is a, c, t, g, unknown, or other
  misc_feature (520)..(520): n is a, c, t, g, unknown, or other
  misc_feature (567)..(567): n is a, c, t, g, unknown, or other
ctggagctccccgcggtggcggccgctctagaactagtggatcccccgggctgcaggaattcgcacgagaccattacctagaacatcctaatcgaaaaaacgcaaaaccacttttccttcacgcatcgcaacgcatctacacttcccaaaacgcagcagcacttctttcctccacttcccaaatcgcagaaggaccagggaacagaagagacccttcgttttcagtccggaactggcgagatcaatggacgccgccggggaggcctcgtcgccgtcgtccccgtcgaagctgcgggacaagctgcggaccacggtgtgctgttgcttcggcgcgggcggcggcccggagaggacgaggtggcggcggcggggcgcggccgcggccgcgggcgagttccgctacgacgcgctcagctacgcgctcaacttcgacgagggcgacgacgacgacgcgtacgcggaccccgccgcggtctccnggtacaggaacttcaacgcgcgcctcccgtccctcgcgggncgcgctgccgcggttggggaccagcggcaacacaccacggccatcgnctagaacgtagaacgtgatgggctctctggtatttttttgggcgaactctgtaattttttttgggcccccctcctttaactggtacgatctactaaacgagcgacagagttcttaaggctcctcggggcaacg

SEQ ID NO: 46503 - protein, 107 aa, Zea mays
  misc_feature: Ceres CLONE 1452049-F
  misc_feature (79)..(79): Xaa is any aa, unknown, or other
MDAAGEASSPSSPSKLRDKLRTTVCCCFGAGGGPERTRWRRRGAAAAAGEFRYDALSYALNFDEGDDDDAYADPAAVSXYRNFNARLPSLAGRAAAVGDQRQHTTAI

SEQ ID NO: 46504 - DNA, 760 bp, Zea mays
  misc_feature: Ceres CLONE 1452056-F
ttccgctatatgtcttggtgggcaggccaacccgtttacgcttctggctgctttcctgggggggctccccgcgggggcggccgctctagagatagtggatcccccgggctgcaggaattctcacgagaccattacctagaacatcctaatcgaaaaaaggaaggttccagcgaccgcgctctgtggagtaggactgcatcctaaagtgcgtatggggaagaagcggtcgcttatctggctcgcagccgccgtcgccgccgcggctgtcctccgagaagcgtcgcccagtgattccggccacgtcttcgaaggtctcatcggcgtcaagtaggaacctgacctatggatcctgcaaggtcgctttccacacagactcaaaggtcattatcgcctatgactcaggtgacccgggtgactttggtctgggaagtggggaacaggtaaaaggccgggactcaagcattggtccgccttttcccccggtgtgaggcggatgcccaagcacacctgtaaagacggtctatggcgggcgacggtcggctccgcagattttaggggtgaccgactctgcaccccgacacggagcgtataggcggttgaggcaaatacctctggccctcgcagctccttacactgtatagcgacctaccttatcttgcatccgggtgggagagttggcttgtcggcggaggcctcctcataggtctggtatttgtttttggatccatcgaaagggcttgtcggctgggtacccccttca

SEQ ID NO: 46505 - DNA, 700 bp, Zea mays
  misc_feature: Ceres CLONE 1452059-F
  misc_feature: Encodes the peptide sequence at SEQ ID NO. 46506
tccccgcggtggcggccgctctagaactagtggatcccccgggctgcaggaattcgcacgagaccattacctagaacatcctaatcgaaaaaaaagattagctgtggcagctcgtcattgaactgctctgggaccgccctgtaacatccaccaactcgaggaggaggaggaggagaagagatccccccaccgagcctcggtttccaagcgccagcagaagaagaagagacaggacacatggcggcaggtttcggcccgaggttcgccgccggcgatgctccggcgagacggtgtaacctggagcggttcctcgaggccaccacgcccgtcgttgcgtcctccagctgctcgtccaaggagaccgcgaacggttgggggcagcggcggtcagacgacgcagacggctcgtcgccgttcttcgctctgggcgacctctgggactcgttcaaggagtgcagcgcgtacggcaccgctgtgccccttgctctgaacggctgcagcgacggcgtcgttcagtactacgtcccctacctgtctgcaatccagctttacggagccctcagcaggcacatcggcccttcgaggacgggtgcagaggagagcgacagcgacgcggagcgcgagacgagctccagcacgaacacgttatcggcgcgggaggaggcgagcgagagcagcaccagcggcagcgaagcctccg

SEQ ID NO: 46506 - protein, 154 aa, Zea mays
  misc_feature: Ceres CLONE 1452059-F
  misc_feature (19)..(154): Pfam Name: DUF789 Pfam Description: Protein of unknown function (DUF789)
MAAGFGPRFAAGDAPARRCNLERFLEATTPVVASSSCSSKETANGWGQRRSDDADGSSPFFALGDLWDSFKECSAYGTAVPLALNGCSDGVVQYYVPYLSAIQLYGALSRHIGPSRTGAEESDSDAERETSSSTNTLSAREEASESSTSGSEAS

SEQ ID NO: 46507 - DNA, 659 bp, Zea mays
  misc_feature: Ceres CLONE 1452063-F
  misc_feature: Encodes the peptide sequence at SEQ ID NO. 46508
  misc_feature (404)..(404): n is a, c, t, g, unknown, or other
cgaatggtgactgggtccccctcgagccactgcagtggtaaaggggacgccaaggaaacagtaacgtctcccagatctaactgccccccgactcacgaatcccaaagcctccatggcgacgcaccgccactgcctcccactcctcctcctcgtggccgccgccctcgccgccgtccctgctcgcgcggcgctgggcggcgggcgcggcccgctgctgggcgggtggaacccgatccctgaagtgagagactcgcacatccaggagctaggcgggtgggcgctggggcaggcgaagcaccagaagctggccgccgacgggctgcggttccgccgcgtggtgcgcggcgagcagcaggtcgtgtccgggatgaaactacgcctccacgtcgacgccgccgaccccngcatgcgcaccgcgccctacgtcgccgtcgtgtacgagcaggtctggacccgcacccgccagctcgcctccttcaacccggtgcccccgcgcccactgaaaccatacgcacacgggtggggcccgaagcgacgttctcccgtcaattacgtggcaagctaatcttaataattgttcccaataaaaaaaaaaaggcttctcccctgttcctaagggacctatagaaatatactaagtatggttgcgaagggacaca

SEQ ID NO: 46508 - protein, 150 aa, Zea mays
  misc_feature: Ceres CLONE 1452063-F
  misc_feature (98)..(98): Xaa is any aa, unknown, or other
MATHRHCLPLLLLVAAALAAVPARAALGGGRGPLLGGWNPIPEVRDSHIQELGGWALGQAKHQKLAADGLRFRRVVRGEQQVVSGMKLRLHVDAADPXMRTAPYVAVVYEQVWTRTRQLASFNPVPPRPLKPYAHGWGPKRRSPVNYVAS

SEQ ID NO: 46509 - DNA, 670 bp, Zea mays
  misc_feature: Ceres CLONE 1452072-F
  misc_feature: Encodes the peptide sequence at SEQ ID NO. 46510
cgattgggtaccgggccccccctcgagccctgcagtggtaaaggaggggagcagcgagatcgtgcgcgcctccgagatctccacgaagttgtggtaacatggggctcaccttcacgaagctcttcagccggctcttctccaagaaagagatgaggatccttatggttggtctcgatgcagctggtaagaccaccatcctctacaagctcaagctcggagaaatcgtgaccaccatccctacaatcgggtttaatgtggagactgttgaatacaagaacattagcttcactgtctgggatgttggaggtcaggacaagatcaggccattgtggaggcactatttccagaacacccaaggccttatctttgttgttgatagcaatgacagagatcgtgttgttgaagcaaaggatgagctccacaggatgctgaacgaggatgaattgagggatgctgtcttgctcgttttcgcaaacaagcaagatctaccagatgcaatgaacgctgctgagatcaccgataagcttggtctccattccctgccgccaacgccactggtatatccagagccacttgtgctaccacagggaaaaggtttgtacaaaggtccttgaattggcctctcccaacaacattgacaaacaaggcctgaaatggaccaattcttgcc

SEQ ID NO: 46510 - protein, 171 aa, Zea mays
  misc_feature: Ceres CLONE 1452072-F
  misc_feature (5)..(170): Pfam Name: Arf Pfam Description: ADP-ribosylation factor family
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPDAMNAAEITDKLGLHSLPPTPLVYPEPLVLPQGKGLYKGP

SEQ ID NO: 46511 - DNA, 1236 bp, Zea mays
  misc_feature: Ceres CLONE 1452077-R
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (19)..(19): n is a, c, t, g, unknown, or other
  misc_feature (32)..(32): n is a, c, t, g, unknown, or other
  misc_feature (42)..(42): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
nccaaaannncccaaaacnttaacgacacccnatgggccccnaccacgccgaataannnnggaaaaannnnnnnnacgattgggtacggggccccccctcgaggtcgacggtatcgataagcttttttttttttttttttggttaaactaattcattattcaaatacccacaatattaagtaagcccgcgatactaccaccttccaagtctcaaaagcaaactaattaccttaactagctactaccccacacgttaacaacccagtagtccagtacagtcaggggcccctagggaaatgaaaattttacatggaggacactaaaggggaatcatgcccccccccccaaggtttcggtccccaacagagtcctggaacccatcccccgaaaatgcgaaaccttttcaggggaaaaagaaatagttttcccccccgaggggggggggggggggcgggactagcctcaaacgagggtagctagcccggaagggccagaacccacgcccaggggcaaaatggcgcaactcatcaaaaaacgacccttatccctgaagggaaaagcggggcacaagaaaaaagagggggcggcaaggtcccgacccaaaagaggaaggagggagtgccccaatctgccaaaagtgagaacaaccctctggaacaaaatagtcccgcccagaaacagtggtggtgcgcacacaacaagagaacagcaagatgggagagaagggggacgccaaacaaaagataagaatgtatggtaaggcaacaataatgaaccgtcaccgcgtgctcacaggagagcgacgcggagaggcgactcgcccaaccaagagcaaggcaggaggtgggtgacagagagtgtggacaaaggtgggcgcgcgagaatgaggaagtgcctatataacgcaatatcaccacctatcgctaggcgccactatccaaagtatcctacgtggagtgaacataggaaggggggagagcgcgcgtgcggcgagggcagcacctccgaggccgcactcgtatccgcgaaggtggacgagtgacctcactacaatagatgacaaaactcgccagatacatcataaatagacttgtggaatgagaaggaggtgaacaatatcgtgcgtcgacactgtccgtgcgtggtggcggccgacccacctccgcgacacgtagttcagatacagatgtctaaacaaacggagcatgtatggactagccccgagaaagaaaaaaa

SEQ ID NO: 46512 - DNA, 648 bp, Zea mays
  misc_feature: Ceres CLONE 1452088-F
  misc_feature: Encodes the peptide sequence at SEQ ID NO. 46513
  misc_feature (378)..(378): n is a, c, t, g, unknown, or other
  misc_feature (385)..(385): n is a, c, t, g, unknown, or other
  misc_feature (471)..(471): n is a, c, t, g, unknown, or other
  misc_feature (476)..(476): n is a, c, t, g, unknown, or other
  misc_feature (500)..(500): n is a, c, t, g, unknown, or other
  misc_feature (516)..(516): n is a, c, t, g, unknown, or other
  misc_feature (553)..(553): n is a, c, t, g, unknown, or other
  misc_feature (554)..(554): n is a, c, t, g, unknown, or other
ctccccgcggtggcggccgctctagaactagtggatcccccgggctgcaggaattcgcacgagaccattacctagaacatcataatcgaaaagtaaaacctgtgcatattattgatgttcctggtcatgctaggctcaaacccaaacttgatgaagtcctgcctaaagctgctgcggttgtctttgttgttgatgctcaagatttcttgtctagcatgcaagctgctgcagagtacctttatgacattctgacaaaggcaactgtagtgaagaaaaaggtccctgtgcttatattctgcaacaagacagataaagttaccgcccactcgaaggaattcatcaagaagcagttggagaaagaattgaaacagctcaggnaatctangaaacgcgtatcgtcagccgacatctctgatgaagtccagcttgggggtccctggagaggcatttcacttcagccagtgccaaaancaggnttgctgttgcgagggtgcttgttngacaggtgatgtttcngccgtggaacaatcatccgtgaactgtgaggcataanngtgtcctattgtttttgggctccaatggctatccgagaaaaaaatgacatggcgccaattggtttgtacctttcaggatgaacccctcacccgg

SEQ ID NO: 46513 - protein, 168 aa, Zea mays
  misc_feature: Ceres CLONE 1452088-F
  misc_feature (126)..(126): Xaa is any aa, unknown, or other
  misc_feature (128)..(128): Xaa is any aa, unknown, or other
  misc_feature (157)..(157): Xaa is any aa, unknown, or other
  misc_feature (166)..(166): Xaa is any aa, unknown, or other
PRGGGRSRTSGSPGLQEFARDHYLEHHNRKVKPVHIIDVPGHARLKPKLDEVLPKAAAVVFVVDAQDFLSSMQAAAEYLYDILTKATVVKKKVPVLIFCNKTDKVTAHSKEFIKKQLEKELKQLRXSXKRVSSADISDEVQLGGPWRGISLQPVPKXGLLLRGCLXDR

SEQ ID NO: 46514 - DNA, 707 bp, Zea mays
  misc_feature: Ceres CLONE 1452089-F
  misc_feature: Encodes the peptide sequence at SEQ ID NO. 46515
aagctggagctccccgcggtggcggccgctctagaactagtggatcccccgggctgcaggaattcgcacgagaccattacctagaacatcctaatcgaaaaagagtggacccaattccaaagagggccgaaggccgggcaggcaggcagcacccgcggagacgcggagcctccactccccgtctcgcttcctcctctggatctagccgacgccgccctcaccctgtcacccaccgacgtcgccgtcgccacctatatcacccaccgcctctgaagaagaagacgcggatccgagggtagttaactgctgaagaagaagagccggtacggagaagacgcggagcagtacgtctccgatctgataacgagttcctgggaggaggaagctagacgatttctgttagaggaggaagaagaggatgatgaactcgtcttagtacttgtctctactattctctcggtcatgcaagaagagaaaagagccatagtagcatctgctgctgaaccggtgcaacatgtaccaagagagggcagcgagatcaatgttgctggaccaagtgtgggcagtgagactaatgttgatggactatatcgataccgtcgacctcgagggggggcccggtacccaattcgccctatagtgagtcgtattacgcgcgctcactggccgtcgttttacaacgtcgtgactgggaaaaccctggcgtt

SEQ ID NO: 46515 - protein, 81 aa, Zea mays
  misc_feature: Ceres CLONE 1452089-F
MQEEKRAIVASAAEPVQHVPREGSEINVAGPSVGSETNVDGLYRYRRPRGGARYPIRPIVSRITRAHWPSFYNVVTGKTLA

SEQ ID NO: 46516 - DNA, 638 bp, Zea mays
  misc_feature: Ceres CLONE 1452094-F
  misc_feature: Encodes the peptide sequence at SEQ ID NO. 46517
ggagctccccgcggtggcggccgctctagaactagtggatcccccgggctgcaggaattcgcacgagaccattacctagaacatcctaatcgaaaaacgaagcctagaatagccctcccctgctccgccacctcctcggatcccgaccaccccacccccaccccagacaacaggttgatggaggctaagatgggacgcttcttcgagtccgtgagcaatttcttcaccggaggcgaccacatcccctggtgcgaccgcgacctcatcgccggctgtgaaggagagcttgtcaatgctgcaaatgaggaacagaggaatgaaagccttatgaggttgtcatgggcccttgtgcactccaggcagacagacgatgtaaaccgtggaatcagcatgcttcaagcttctttggataattctgccagtcctctgcagactagggaaaagctgtacttgttggctgttggattctacaggattggcgactactcaaaaagcaggcaacttgcagatcgttgtttggagattcagcggatgggcggcagccatatcgctgaagaggcaatagaagataaattgccaagatgtctgatgggataggattgcgacactgcgtcggactctggtggtggattgcagct

SEQ ID NO: 46517 - protein, 139 aa, Zea mays
  misc_feature: Ceres CLONE 1452094-F
MEAKMGRFFESVSNFFTGGDHIPWCDRDLIAGCEGELVNAANEEQRNESLMRLSWALVHSRQTDDVNRGISMLQASLDNSASPLQTREKLYLLAVGFYRIGDYSKSRQLADRCLEIQRMGGSHIAEEAIEDKLPRCLMG

SEQ ID NO: 46518 - DNA, 754 bp, Zea mays
  misc_feature: Ceres CLONE 1452107-F
aagctggagctcaccgcggtggcggccgctctatactagtggatcccccgggctgcaggaattcgcacgagaccattacctagaacatcctaatcgaaaaagtattatgagggcgaccccgcgcctcttcgagcgactctaccggcattgcgtcggtaacaacggcagagtcgtcatcggcggggcggcaccggagggccctggcagcggcagccgtggagcacttcctcggctcctccctgcctgtcggggttccaaaatttttgaatcatcttttccgatactcgagcacgcatatcccagaaaaatgcttgcctcatctgtcccccccccccataataccattatgctgttgtgattctaaagaaaaaagaaaggggccttaactcccatcaaaccaaccacccccccccaacaggaaaagaaaagcctgagaacgcctaaccgatgaatctcccccaaccatgacccgtgaggaggaaaggtttttctaaacccaaaaaaagggggaacaaaaagggtttccccccgcttatggtttcgcgacccccttcccaaaaattagaaaaaatccttcccccggacataaaagagggtgcttctaaaacaccaaaaaaaatttccctcacaaaacctcttccaaaaaaacccctctaaaatttccccccaaaatccccctagaggggaccctcccttccataaaaaagagaatttccggctcaagaatttttcacacaacagaaaaaaatctcgt

SEQ ID NO: 46519 - DNA, 692 bp, Zea mays
  misc_feature: Ceres CLONE 1452108-F
  misc_feature: Encodes the peptide sequence at SEQ ID NO. 46520
aagctggagctccccgcggtggcggccgctctagaactagtggatcccccgggctgcaggaattcgcacgagaccattacctagaacatcctaatcgaaaatttaccaagtacactgctgcaattggtgtaaccaagccagactaccatgctgcattcattctggcggacaaaggagacaccattaaagtgtcaggtgtttatcaccttgaacagaaacacaacggctcagctgaggctgatctaacccggaggctctcaacaaatcagaacacactcacagtcggtggactgtacacaattgatccccaaacagctttgaaggcaagactcaataacactgaaacgcttgccgcgcttctttaccaagatcttaaacccaagtcgctcttgacaatctctggagaattccacacaaaggccctgcacacatccccaaagtttgagttggcgcttgcactgaaaccctgatcaaatcatcccatgttgattgtgcgccaatcttgaattcatttttttgtttttgctcagctgtaaccaataattcaatacaccaaccttttctgtcaatctggccaatatttggagcaccgtgggtaggacccgcatgggtcgcctacctgaaattttccctgtctaccctgattgttgaaagcatctgcctgttgggaaatggacatcctccttgtttcc

SEQ ID NO: 46520 - protein, 155 aa, Zea mays
  misc_feature: Ceres CLONE 1452108-F
AGAPRGGGRSRTSGSPGLQEFARDHYLEHPNRKFTKYTAAIGVTKPDYHAAFILADKGDTIKVSGVYHLEQKHNGSAEADLTRRLSTNQNTLTVGGLYTIDPQTALKARLNNTETLAALLYQDLKPKSLLTISGEFHTKALHTSPKFELALALKP

SEQ ID NO: 46521 - DNA, 659 bp, Zea mays
  misc_feature: Ceres CLONE 1452110-F
  misc_feature: Encodes the peptide sequence at SEQ ID NO. 46522
  misc_feature (622)..(622): n is a, c, t, g, unknown, or other
  misc_feature (659)..(659): n is a, c, t, g, unknown, or other
ggagctccccgcggtggcggccgctctagaactagtggatcccccgggctgcaggaattcgcacgagaccattacctagaacatcctaatcgagaaataaataagccctcccaaaccccttccatttcccgtgctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccaggggcaacgccactgttcctgctatggagatgaccaagtggtttgacaccaactaccactttattgtccctgaattgggccaaacaccaagttctcctatgcttctcacaaggctggtaacgaatatnaggaggctaaagcgcttcgtggttgaaaccgtggccn

SEQ ID NO: 46522 - protein, 153 aa, Zea mays
  misc_feature: Ceres CLONE 1452110-F
  misc_feature (2)..(153): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (141)..(141): Xaa is any aa, unknown, or other
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGQTPSSPMLLTRLVTNXRRLKRFVVETVA

SEQ ID NO: 46523 - DNA, 752 bp, Zea mays
  misc_feature: Ceres CLONE 1452113-F
  misc_feature: Encodes the peptide sequence at SEQ ID NO. 46524
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (752)..(752): n is a, c, t, g, unknown, or other
tctgggtttttctcccctctcccgccctctccttcgtccccctctaggatccnnnnnccaaaactggagctccccgcggtggcggccgctctattcctagtggatcccccgggctgcaggaattcgcacgagaccattacctagaacatcctaatcgaaaaaccaccacaaccggtcctcacataatcatcttcattcactcactctcttcgatcactgtactgaagataccatggccaagtcgaccgcgatgtttgtagccgccctggccctggtggtggtgatggcgacgacgagcactggcggtggcagggcggtagcggcgtgcgatcccaagccgctggtggtgtgcgatccggcgttcatggacggagcgaaacccgcggcagcatgctgctccaccctgcgcgcgcaggaggcatgcttgtgcgtgtataccaaagaccccaagtttgcaaaatacatcaaccaccccaccacggtgcgaaacctttacctcggggcggcataagccatccccaaatgctaaggcaagcgcatgctgcgtcgtccgctctcactaggctctttgctctttgcggcgtaaacacaccccagcggtaattcaatgaataaagggcctgcattcagtttgaagtagttccaccgccactttgataagaaagtttacaaagcctttattccacttccgtgtccgtaccctctgagggggggggggcccccgggtaacccccaggtgtgggcacccgtan

SEQ ID NO: 46524 - protein, 92 aa, Zea mays
  misc_feature: Ceres CLONE 1452113-F
MAKSTAMFVAALALVVVMATTSTGGGRAVAACDPKPLVVCDPAFMDGAKPAAACCSTLRAQEACLCVYTKDPKFAKYINHPTTVRNLYLGAA

SEQ ID NO: 46525 - DNA, 674 bp, Zea mays
  misc_feature: Ceres CLONE 1452117-F
  misc_feature: Encodes the peptide sequence at SEQ ID NO. 46526
  misc_feature (405)..(405): n is a, c, t, g, unknown, or other
aagctggagctccccgcggtggcggccgctctatactagtggatcccccgggctgcaggaattcgcacgagaccattacctagaacatcctaatcgaaaaaaggaaacagtcacgtctcccagatctaactccccccgactcacgaatcccagagagcctccatggcgacgcaccgccactgcctcccactcctcctcgtggccgccgccctcgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgccgattgcctccggttccaccccgtggtgcgcggcgagcancaggtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgccccgcgccccctgaaccatacggacaccggtgggccgaagcgacacgaccatgttctcccgtcattacgtgtcgagctaacctattattggttcaacaataaaaaaagcttccccccggtcctatggaccaaa

SEQ ID NO: 46526 - protein, 130 aa, Zea mays
  misc_feature: Ceres CLONE 1452117-F
  misc_feature (81)..(81): Xaa is any aa, unknown, or other
MATHRHCLPLLLVAAALALAAVPARAALGGGRGPLLGGWNPIPDVSDSHIQELGGWALGQAKHQKLAADCLRFHPVVRGEXQVVSGMNYRLYVDAADPAGRTVPYVAVVYEQVWTRTRQLASFNPVPRAP

SEQ ID NO: 46527 - DNA, 701 bp, Zea mays
  misc_feature: Ceres CLONE 1452125-F
  misc_feature: Encodes the peptide sequence at SEQ ID NO. 46528
  misc_feature (701)..(701): n is a, c, t, g, unknown, or other
ggagctccccgcggtggcggccgctctagaactagtggatcccccgggctgcaggaattcgcacgagaccattacctagaacatcctaatcgaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattcattcgctgctgtactcctcctcgtctcttcagtatgcagtactttattactttcccgtccgcccgtcccaaccaaccaaattatatgacattaataatatatagcgcataataaataaacctcgaaaaaacactaaaacgtcttacgatttaaaacn

SEQ ID NO: 46528 - protein, 58 aa, Zea mays
  misc_feature: Ceres CLONE 1452125-F
  misc_feature (6)..(56): Pfam Name: UPF0057 Pfam Description: Uncharacterized protein family UPF0057
MSEGTANCVDILIAIILPPLGVFLKYGCGHEFWICLLLTFLGYIPGIIYAIYAITKNN

SEQ ID NO: 46529 - DNA, 621 bp, Zea mays
  misc_feature: Ceres CLONE 1452126-F
  misc_feature: Encodes the peptide sequence at SEQ ID NO. 46530
ggagctccccgcggtggcggccgctctagaactagtggatcccccgggctgcaggaattcgcacgagaccattacctagaacatcctaatcgaaaagctaacgccgctcgcgcatcctattgccctcgcgccaccgtcgccgccgctgcagcgagccaccgccctgccgtcgcctgaggtagacaccaagccaccgccatggggcgtatgcacagccgcgggaagggtatctcttcatcggcgctgccgtacaagaggactcctccgatctggctcaagacagctaccaccgaggtggaggagatgattacccaaggctgcgaaaagaaagggcagatgccgtcccagaatggtgttctggtccgtgacagaaggcatcccgctgtcaagacgtgactgtatccagatcctcccatcctcaggcccatgggtggcgcccgaaatccggaaggatccccccttccccataaaaaaagcgggggcaaattagaaacctttgggaaggaaacgggagggccaagggcccccaattttgaaacccttttttgtttaagaaaaagagatccccccccttttggcccccttttaaaaaaggggtacaaaaaaaaacccccccccccc

SEQ ID NO: 46530 - protein, 65 aa, Zea mays
  misc_feature: Ceres CLONE 1452126-F
  misc_feature (1)..(58): Pfam Name: Ribosomal_S13_N Pfam Description: Ribosomal S13/S15 N-terminal domain
MGRMHSRGKGISSSALPYKRTPPIWLKTATTEVEEMITQGCEKKGQMPSQNGVLVRDRRHPAVKT

SEQ ID NO: 46531 - DNA, 695 bp, Zea mays
  misc_feature: Ceres CLONE 1452128-F
  misc_feature: Encodes the peptide sequence at SEQ ID NO. 46532
ggagctccccgcggtggcggccgctctagaactagtggatcccccgggctgcaggaattcgcacgagaccattacctagaacatcctaatcgaaaaattttctctgcccatccacgtgaaaagcagcagcagtggtccgtaagtagatcttggattcgtctcatcaatcacactccaccaggagtaggagcttgcgggcgtggcggcggccgtgaccggcgctggagatcttggacgcgcgcgacatcctggtctccgctctgtgcctctggtctccgaaggcgccgccaccctattttttttaaaaaaaaatcctaagatagtttcttcagtccgacaccgcttctagcttcccctcggcgatctgtgaagctatgaagccacctctcgagaggaacccgactaagaagcgccactcgtggtggtgggacagtcacattagccctaagaactcgaaatggctcgcggaaaatctcgaagaaatggacaagcaagtgaaggaaatgctccagctgatcgaggaggacggcgactccttcgctaagaaagcgcaaatgtattaccagaggcgtccgatgctcgtcacccacgtcgagaacttctaccgtatgtatcgtgctctagccgagcgctacgacaatgtaaccggcgagctgcgcaagaacatccctacaaggctgcagacaaccggatct

SEQ ID NO: 46532 - protein, 107 aa, Zea mays
  misc_feature: Ceres CLONE 1452128-F
  misc_feature (15)..(88): Pfam Name: KIP1 Pfam Description: KIP1-like protein
MKPPLERNPTKKRHSWWWDSHISPKNSKWLAENLEEMDKQVKEMLQLIEEDGDSFAKKAQMYYQRRPMLVTHVENFYRMYRALAERYDNVTGELRKNIPTRLQTTGS

SEQ ID NO: 46533 - DNA, 568 bp, Zea mays
  misc_feature: Ceres CLONE 1452129-F
tggagctccccgcggtggcggccgctctagaactagtggatcccccgggctgcaggaattcgcacgagaccattacctagaacatcctaatcgaaaaatctctcttccatcgacaaatctctcctccatcttctattttcagatttcatctcctctatctttattcttaatcatctctctctctctctctctctctctctctctctctctctctatctctctctctactcccctcactcacgaacaagattcatctcacacggacacgtttctgtgtctcagtctcgtaatctttctctcacatacgacacatctcaaaaaagcagattttccaaaccagggtcgattccacacatgagaggttggagaaaatgatggaccatccgttcattaaaacccacaaaccattgcccccccaaattccatttttccgccgtttaaaaaagggcgttaggaggggtgaaaaaaaactttggtgggggggggggggccccgggcaattttaaaagggggggggggggtcccccgggggccttaacaaaaaagggggtgggtatcctttttcccc

SEQ ID NO: 46534 - DNA, 689 bp, Zea mays
  misc_feature: Ceres CLONE 1452131-F
  misc_feature: Encodes the peptide sequence at SEQ ID NO. 46535
  misc_feature (689)..(689): n is a, c, t, g, unknown, or other
aagctggagctccccgcggtggcggccgctctagaactagtggatcccccgggctgcaggaattcgcacgagaccattacctagaacatcctaatcgaaaaacggacaaggacctgctctgtttctcggcgagtttttcccacttccacctctccgtccctgccgagctgcggcggccgcatcgactgttagggcgaaaatccgttctagtctctcggcgattttcggcaggcggaggcagcaggatctgcgggaaggatttcgtgtcgagatggctgggcgcaaggaaactgcactcgacctggcgaagttcgtcgacaagggcgtccaggtgaagctcaccggcggccgccaagtgacaggaactctaaagggatatgaccaactactcaacttagtgctagatgaagcagttgagaatgaaagagagcaagatgatccattgaagctatcagggaaaactagacaacttggcctcattgtgtgcagaggcacagcagtcatgctggtctcaccgactgatgggactgatgagatcgccaaccctttcctcgcggacggagcatagcttgcacccctcggaacaatatgtccctgtgggaaaagaaccgtttctcgtgtatttgttgtacctggtgctacggttactaatgtgctgctgctgagtacttccgttttctttcctctcn

SEQ ID NO: 46535 - protein, 98 aa, Zea mays
  misc_feature: Ceres CLONE 1452131-F
  misc_feature (9)..(82): Pfam Name: LSM Pfam Description: LSM domain
MAGRKETALDLAKFVDKGVQVKLTGGRQVTGTLKGYDQLLNLVLDEAVENEREQDDPLKLSGKTRQLGLIVCRGTAVMLVSPTDGTDEIANPFLADGA

SEQ ID NO: 46536 - DNA, 644 bp, Zea mays
  misc_feature: Ceres CLONE 1452134-F
  misc_feature: Encodes the peptide sequence at SEQ ID NO. 46537
cgattgggtaccgggccccccctcgagccctgcagtggtaaaggggtggccaaggaggcaaggaaacaggcagctctccacggacaacgcgattctatttagttatctggcggctgccagtgccagccagccgcctttcgaaaccgagcacgagggagccgacgtggtggtctctggaacctggttcgagcgagcgagcgatccatctatccagccgcccgccgggaatttctgtgacgaggaggaggaggaggagggggtatggcaatggtggcgtcgcagggaggcggccggagggacgccgaggcggagctcaacctgccgccggggttccggttccatcccaccgatgaggagctggtggtgcactacctctgcaggaaggtggcgtgtcagcagctgcccgtgcccatcatcgccgaggtcgacctttacaaattcgacccgtgggatcttccagagaaggcgctgtttggccgcaaggagtggtacttcttcacgccgcgggaccgcaagtacccaaacggctcgcgccccaaccgcgccgccgggagagggtattggaaggcaacgggcgcagacaagccgatcgcgcccaagggcggtggcggggcggcaggaatcaagaaggctctcgtcttcta

SEQ ID NO: 46537 - protein, 127 aa, Zea mays
  misc_feature: Ceres CLONE 1452134-F
  misc_feature (20)..(127): Pfam Name: NAM Pfam Description: No apical meristem (NAM) protein
MAMVASQGGGRRDAEAELNLPPGFRFHPTDEELVVHYLCRKVACQQLPVPIIAEVDLYKFDPWDLPEKALFGRKEWYFFTPRDRKYPNGSRPNRAAGRGYWKATGADKPIAPKGGGGAAGIKKALVF

SEQ ID NO: 46538 - DNA, 671 bp, Zea mays
  misc_feature: Ceres CLONE 1452135-F
  misc_feature: Encodes the peptide sequence at SEQ ID NO. 46539
  misc_feature (1)..(1): n is a, c, t, g, unknown, or other
ncgattgggtaccgggcccctcctcgagccctgcagtgggaaagcccgcccacatgttccatagcttgcatccggcggcggagtaccacggcgcggcgagggccatcggtggctgcccgatatacgtcagcgacaagccggggaaccacaacttcgagctgctcaggaagctcgtgctccccgacggctccgtgctacgcgcgcagcttcccggccggcccacacgcgactgcctcttctccgacccggcgcgcgacggcgcgagtttgctcaagatctggaacctgaacaagtgcggtggcgtggtgggtgtgttcaactgccagggagccgggtggtgccgcgtgaccaagcggacgcgcgtgcacgacgcgtcgccgggcacgctgaccggcaccgtgcgtgccgacgacgtcgacgccatagcgcgcgtcgctagtgacggcggcgggtgggacggcgagaccgtggtgtatgcgcaccgcacgcgggagctagtgcgacttccgcggggcgtcgcgctgcccgtgacgctaggcccgctccagtatgaggtgttccatgtgtgcccgctccgcgccgtcgtgccgggggtctcgttcgcgcccgtcgggctgctggacatgtttcacgccgggggcgccgttgaagaatgcgacgtgatcagcgag

SEQ ID NO: 46539 - protein, 223 aa, Zea mays
  misc_feature: Ceres CLONE 1452135-F
  misc_feature (1)..(223): Pfam Name: Raffinose_syn Pfam Description: Raffinose synthase or seed imbibition protein Sip1
  misc_feature: SWISSPROT Homolog: EC 2.4.1.67 Galactinol--raffinose galactosyltransferase
DWVPGPSSSPAVGKPAHMFHSLHPAAEYHGAARAIGGCPIYVSDKPGNHNFELLRKLVLPDGSVLRAQLPGRPTRDCLFSDPARDGASLLKIWNLNKCGGVVGVFNCQGAGWCRVTKRTRVHDASPGTLTGTVRADDVDAIARVASDGGGWDGETVVYAHRTRELVRLPRGVALPVTLGPLQYEVFHVCPLRAVVPGVSFAPVGLLDMFHAGGAVEECDVISE

SEQ ID NO: 46540 - DNA, 687 bp, Zea mays
  misc_feature: Ceres CLONE 1452138-F
  misc_feature: Encodes the peptide sequence at SEQ ID NO. 46541
  misc_feature (17)..(17): n is a, c, t, g, unknown, or other
  misc_feature (21)..(21): n is a, c, t, g, unknown, or other
  misc_feature (408)..(408): n is a, c, t, g, unknown, or other
cgattgggtaccgggcntctntcgagccactgtcagtgggaaaggccgcgcatggcgccggcgccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccaaggcatcgcctggtccttcggagggatgatcttcgcgctcgtctactgcaccgccggcatctccggaggacacatcaacccagctgtgaccttccggctgttcttggccaggaagctgtccctgactagggccatcttctgttttatcatgnaatggatggaccccatctgtggagcctggagcggtgaagggcttccagcaggggcttttcatgggcaacggcgctggcgccaatgttgtcccccccggggtacacaagggggatggcctttggagctgagattgctggcaccttcctccctggaagtacaccaggtattcccggtccccgcatggccaagaaggaacgcccggggaacttcccaatggtcacccatcacttggcccccaactggcccaaattggggtttccccgggagattccccaggg

SEQ ID NO: 46541 - protein, 228 aa, Zea mays
  misc_feature: Ceres CLONE 1452138-F
  misc_feature (41)..(222): Pfam Name: MIP Pfam Description: Major intrinsic protein
  misc_feature (7)..(7): Xaa is any aa, unknown, or other
  misc_feature (136)..(136): Xaa is any aa, unknown, or other
IGYRASXEPLSVGKAAHGAGAGDDDKDYKEPPPAPLFEPGELKSWSFYRAGIAEFVATFLFLYITVLTVMGVSKSTSKCATVGIQGIAWSFGGMIFALVYCTAGISGGHINPAVTFRLFLARKLSLTRAIFCFIMXWMDPICGAWSGEGLPAGAFHGQRRWRQCCPPRGTQGGWPLELRLLAPSSLEVHQVFPVPAWPRRNARGTSQWSPITWPPTGPNWGFPGRFPR

SEQ ID NO: 46542 - DNA, 684 bp, Zea mays
  misc_feature: Ceres CLONE 1452141-F
  misc_feature: Encodes the peptide sequence at SEQ ID NO. 46543
  misc_feature (1)..(1): n is a, c, t, g, unknown, or other
ncgaattgggtacgggcccccctcgagccctgcagtgggaaaggctgtggcgctgtcgatcctaacagacgtcgatcgttccatcgaccggccggccggccagcctagctcttggcaggctcttgctccgatcggatcgagcgccggacaaggcaaggcagccgtacgtacgagtacgacgatggcgcagggcagccgcagcgctgccgtgcccgccgcagcgtccttcttcgcccttctcgccgtggcggccccgctgctcctgtgctgcgcgccggccgccgcggagctggccaggctggagcacccgcccaaggacggcggctcgctcagcctgctcgtcgtcggcgactggggccgaaagggcacgttcaaccagtccagggtcgcccatcagatgggcagggtcggggagcagctcagcatcgacttcgtcatatccaccggcgacaacttctacgagaacggcctgacgggcacggacgacgaggcgttcgagcagcctttcaccgatatctacacgggcgaaaagcctgccaaaagccgtgggtacctgggggctggggaaacccatgactaccgggggtgacgccgctccgcgcaagctgagcccggggtcctggcggaaagatcgaccagccgggttccatcctggcatgaaaaatccttcggtcggtcaaagcc

SEQ ID NO: 46543 - protein, 135 aa, Zea mays
  misc_feature: Ceres CLONE 1452141-F
  misc_feature: SWISSPROT Homolog: EC 3.1.3.2 Acid phosphatase
MAQGSRSAAVPAAASFFALLAVAAPLLLCCAPAAAELARLEHPPKDGGSLSLLVVGDWGRKGTFNQSRVAHQMGRVGEQLSIDFVISTGDNFYENGLTGTDDEAFEQPFTDIYTGEKPAKSRGYLGAGETHDYRG

SEQ ID NO: 46544 - DNA, 640 bp, Zea mays
  misc_feature: Ceres CLONE 1452145-F
  misc_feature: Encodes the peptide sequence at SEQ ID NO. 46545
tcgagccctgcagtggtaaaggaggctaatcccgtccgccgccccccaccaaccaacgcaagcgaacccggccggcgcggggcagcggcgatggcggagatcccggtgatcgacctgcgcctcgccggctcgtcgcccgacgagtcggcgcggctgcgcgacgcgtgcgagcgcctgggctgcttccgggtgaccggccacggcgcgcccgcggggctcctggccgacatgaaggccgccgtgcgcgcgctcttcgacctccccgacgacgccaagcgccgcaacgccgacgtcatccccggcagcggctacgtcgcgccctgccccgccaacccgctctacgaggccttcgggctcctcgacgccgccgcgcccgccgacgtcgacgccttctgcccgcgcctcgacgcgccgcccaaagtcaggtagaccgctcagacctacgcggagaagatgcacgacgtgatccgtctgcgtcgccggcgagctggccaccagcctggggctgggcctggaggagcactcgttccaggactgggcgtgccatttccgcgctaccaggtacaactactcccaggagacggggggctcctccggcgtgaaaaccccgcggaatcgggcttcctccccgtgctccagg

SEQ ID NO: 46545 - protein, 112 aa, Zea mays
  misc_feature: Ceres CLONE 1452145-F
  misc_feature: SWISSPROT Homolog: EC 1.14.11.15 Gibberellin 3-beta-dioxygenase
MAEIPVIDLRLAGSSPDESARLRDACERLGCFRVTGHGAPAGLLADMKAAVRALFDLPDDAKRRNADVIPGSGYVAPCPANPLYEAFGLLDAAAPADVDAFCPRLDAPPKVR

SEQ ID NO: 46546 - DNA, 660 bp, Zea mays
  misc_feature: Ceres CLONE 1452154-F
  misc_feature: Encodes the peptide sequence at SEQ ID NO. 46547
tcgagccctgcagtggtaaagggcagtcccggcgtcccgcacccacgccctacaggcagaccaagcaaatggcgatctcgatctcgcaggaggccttcgactccatggtccgggagaacatggaggacctcggcatggaccccgatgaggccctcgctgacgccgttgaggcgctcaccctccagggcgccgatctctcaggtatcgttaagcgcgtgccgggagaggccaccgcggcggaggtgagcccggtggtgcgggttctggacgaactgaaggcctctctcagcgccagcggcgggtcggagcaggatctcgacggactcgtctctctgttcgatgagttgcgcaatctgtgctgctccggcgagggttcggagaatgcagcgatcgcggtacggaatggcgtcgtggaggcgctcgtccgccctgtgcgcgtccgccttcggggtcgagcaggagaggttgctttgcttcggccttgaagagtctgagctccgtactccgtgatgtggcaagccctggaaaagttcagacgaagggagggacccaaaatttgtcttggatctctttgcagggagggttcagaaaaattcagaatttcatgggatggctggattttagggttgggggcagccgggttctggctgggaaatggaa

SEQ ID NO: 46547 - protein, 138 aa, Zea mays
  misc_feature: Ceres CLONE 1452154-F
MAISISQEAFDSMVRENMEDLGMDPDEALADAVEALTLQGADLSGIVKRVPGEATAAEVSPVVRVLDELKASLSASGGSEQDLDGLVSLFDELRNLCCSGEGSENAAIAVRNGVVEALVRPVRVRLRGRAGEVALLRP

SEQ ID NO: 46548 - DNA, 688 bp, Zea mays
  misc_feature: Ceres CLONE 1452162-F
  misc_feature: Encodes the peptide sequence at SEQ ID NO. 46549
  misc_feature (1)..(1): n is a, c, t, g, unknown, or other
ncgaatgggtaccgggccccccctcgagccctgcagtgggaaagggtcggtagccgtcggttcacttctccaggtaaggaaagggttcgtactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaaaaagaaatagagagcatttcaagttcatggagctggctgccagagattatgttccagtgtctgattttccatacatgtagaacctaatagacatgtcaaagtattatgtatcgaaacagctcatgggattttgctcctttcaatgcatcccaggtttatgtatcgaacccagtttatggggatctttgctctatttctaatggcatccatgggtttggtgaaataaaaaaaaaaaaaaaaccagaagttcttgggaaattcctggcag

SEQ ID NO: 46549 - protein, 111 aa, Zea mays
  misc_feature: Ceres CLONE 1452162-F
  misc_feature (5)..(103): Pfam Name: Ribosomal_L36e Pfam Description: Ribosomal protein L36e
MAPPQPKSGLFVGINKGHVVTKRELPPRPCHRKGKSTKRVSMVRGLIREVAGFAPYEKRITELLKVGKDKRALKLAKRKLGTHKRAKKKREEMAGVLRKMRSAGTHTDKKK

SEQ ID NO: 46550 - DNA, 679 bp, Zea mays
  misc_feature: Ceres CLONE 1452171-F
  misc_feature: Encodes the peptide sequence at SEQ ID NO. 46551
cgattgggtaccgggccccccctcgagccctgcggtggtaaaggtttggcctgtccatcctcacctacgcgccgtcgaacgcggtgtggtggtccacctacgccgtggcgcagcggtgcctgtggcgcgccgtggggaccgagcgctccgagagctgcgcctgcctgatggccgtgcagggcgcgagcgcggccctggccgggggcaccgcggcgctggtgacgatgccgctggacaccgtgaagacgcggctgcaggtgatggaggccgacgcggcggcgcggcccacgctggccagcaccgtgcgcgggctgctcaaggagggcggctgggcggcgtgctaccgtgggctggggcccaggtgggggtccatgtcgctgtccgcggccaccatggtgaccacctacgagtttcctcaagcggctctccggcaagggaggctccctgggctagatccttcttggccgtcctcagcgactctaggaatcgccgggggtctccgccgtctcaaatttaaaattcacccaatcatcgaccctggggatgaagttaagggaaattgggccccctttccccctggaaaattggcccacggggttttttccccgcggtttttgttccctaaaacccgggcctttaaggggggggcgggaaaaaaaaaaaaggggttttaagaggg

SEQ ID NO: 46551 - protein, 168 aa, Zea mays
  misc_feature: Ceres CLONE 1452171-F
  misc_feature (5)..(91): Pfam Name: Mito_carr Pfam Description: Mitochondrial carrier protein
MAVQGASAALAGGTAALVTMPLDTVKTRLQVMEADAAARPTLASTVRGLLKEGGWAACYRGLGPRWGSMSLSAATMVTTYEFPQAALRQGRLPGLDPSWPSSATLGIAGGLRRLKFKIHPIIDPGDEVKGNWAPFPPGKLAHGVFSPRFLFPKTRAFKGGAGKKKKGF

SEQ ID NO: 46552 - DNA, 675 bp, Zea mays
  misc_feature: Ceres CLONE 1452172-F
  misc_feature: Encodes the peptide sequence at SEQ ID NO. 46553
  misc_feature (406)..(406): n is a, c, t, g, unknown, or other
  misc_feature (675)..(675): n is a, c, t, g, unknown, or other
ccgattgggtaccgggccccccctcgagccactgcagtgggaaaattgattctatgctcaaggagctaaagcattcttctgaatttcacaaacgaccttttgagtctgctgtcggctcaatacgtacaattgcagctaatcatctctggcagctagtggtggtacgtgctgatctcaacggtcatttgaaggcattgaaagattattttcttttagcaaaaggtgactttttccagtgttttcttgaggaaagccgccaattaatgcggttaccacctcgtcaatctacagcccaagcagatctcatgattccatttcagctggctgcactgaagactatcggtgaggaagacaagtactttaccagagtctcattaaggatgctatcatatggtatgaaaagtancacgtctcagaaacatctccaaaagcctaatgcttcagagcttccttcacaaggaaaagctgcatcagaattgacacttgatgggtgggatagtattgctctggaatattctatttgactggcctctgcagctcttcttccctcctgacgctctggtccaagtatcccaagggtttttcagtatttcctccccattgaaaaacgaaacaaatgggaactttggagaaatcccggggcacccggcaacggcttaaaaaaaccatgcccgn

SEQ ID NO: 46553 - protein, 173 aa, Zea mays
  misc_feature: Ceres CLONE 1452172-F
  misc_feature (135)..(135): Xaa is any aa, unknown, or other
DWVPGPPSSHCSGKIDSMLKELKHSSEFHKRPFESAVGSIRTIAANHLWQLVVVRADLNGHLKALKDYFLLAKGDFFQCFLEESRQLMRLPPRQSTAQADLMIPFQLAALKTIGEEDKYFTRVSLRMLSYGMKSXTSQKHLQKPNASELPSQGKAASELTLDGWDSIALEYSI

SEQ ID NO: 46554 - DNA, 678 bp, Zea mays
  misc_feature: Ceres CLONE 1452174-F
  misc_feature: Encodes the peptide sequence at SEQ ID NO. 46555
cgattgggtaccgggccccccctcgagccactgcagtggtaaagggcttcctggcgctggactggtgcgactacaccccggtgctgtctaggctcgccgcgggcctcctgcgtgctctactcgccgcctgggagaagccctcggcggcggcaacgcctacgggttccggcccgtccacaccctctccatcctgctcccccggcaccccgccgcctcctcctcctctccgcagcacccgctggtcccgccctgggtcgaccgctccgcgtccgccgctccgccgagggagatagggactcccgacaccaccgtgcaggtccacgcgggcctcttcaacaaggacgtcctcgccgagtcgggagccgaggtcgacatcggcgaggtggagcgcgtcgtcgtggcccgtgacggccgcttctccggcgtcgagctcagggggcgcgacggcctgctgaacgccgacgtcgtcgtgctcgcgctcggccctgggtctcgccgcctcgaggtggtcaacgaggtgttcgacgtgtccaggctcatggcgcacagcatcctgctcctgccgcacgagcccgagaatgacacgccgcactggctcttcctcagctactgtcctgaggccggcaccaagatgctcaacgccgaggtgtaccctcggcctaccgggggaggtgtacg

SEQ ID NO: 46555 - protein, 46 aa, Zea mays
  misc_feature: Ceres CLONE 1452174-F
MAHSILLLPHEPENDTPHWLFLSYCPEAGTKMLNAEVYPRPTGGGV

SEQ ID NO: 46556 - DNA, 657 bp, Zea mays
  misc_feature: Ceres CLONE 1452177-F
  misc_feature: Encodes the peptide sequence at SEQ ID NO. 46557
  misc_feature (545)..(545): n is a, c, t, g, unknown, or other
cgattgggtaccgggcccccccctcgagccactgcagtggtaaaggtctatcttatgtcaaacttttctgtgcttcattggtcagcaatgacttataagaagcaagaagtcattaatcttcaaggacatgtgacaccgtgcgagaagcaccatcggaatcactacgagggtttttatcagactccagtcagtactttggcggtgaagcataacttgcttgttactggtgggtttcatggggagataatatgcaagtttctggatcgtcaaggagtaagctactgttgcaagacaacaaatgatgacgacggtattactaattctctggagatatttgagaagcctagtggttctctgcacttccttgcgtcaaacaatgattgtggacttagagactttgacatggaaaagtttcgaatatgcaaccacttccattttgcttggcctgtgaatgtaagcctgcagtgcttgttgaattttcaattttctatctaaatctagctgctgaagtcaatgctcatgttttgtcaaagagcatgtcttanataaggacagaaacacattactgcatcctgtgttggcccctgttttaattttctgcagcatacatcgttgagcccagatggtaaacttgctgctattgtgggggacagtcct

SEQ ID NO: 46557 - protein, 164 aa, Zea mays
  misc_feature: Ceres CLONE 1452177-F
RLGTGPPPRATAVVKVYLMSNFSVLHWSAMTYKKQEVINLQGHVTPCEKHHRNHYEGFYQTPVSTLAVKHNLLVTGGFHGEIICKFLDRQGVSYCCKTTNDDDGITNSLEIFEKPSGSLHFLASNNDCGLRDFDMEKFRICNHFHFAWPVNVSLQCLLNFQFSI

SEQ ID NO: 46558 - DNA, 657 bp, Zea mays
  misc_feature: Ceres CLONE 1452182-F
  misc_feature: Encodes the peptide sequence at SEQ ID NO. 46559
  misc_feature (1)..(1): n is a, c, t, g, unknown, or other
ncgattgggtaccgggccccccctcgagccctgaagtggtaaaggcgacatcaccatctgtgcgtctcttccacgagagggaacctaccgtatagtactgccgacatggtgctctccggcggcctagtcgtgccgtggctcgcggcggcggtaggcggaggccgcgctggccatcaccgccgccccggtcggcgccgatgcctacaagaactacaccgtcggcgatgacaagggctggtacgacggatctcagcctgcccggggtcgactaccatgcgtgggctgacagcaagaacttcagcctcggggatttcctcatcttctacacggacaagaaccactctgtggtgcagacgcggaacgtgacgctgtacgaaagctgcgactacaacgactcagggcccgacgacaccgtcgagtgggtcgccgcgccgccggagttcagcaaggacgccgtcacggtcgccgtgccgctcctcgacgagggccgcgcctacttcttctcgggcaactacgacggcgagcagtgcgagagcggccagcgcttcgccgtcgacgtggcccacggtcagggcctgccgcctgaactcaagccgcccgtcgacgacgcgccggcgccctcctccgcgtggcccgacgacggcgccgccgcgctcg

SEQ ID NO: 46559 - protein, 144 aa, Zea mays
  misc_feature: Ceres CLONE 1452182-F
  misc_feature (10)..(106): Pfam Name: Cu_bind_like Pfam Description: Plastocyanin-like domain
MTRAGTTDLSLPGVDYHAWADSKNFSLGDFLIFYTDKNHSVVQTRNVTLYESCDYNDSGPDDTVEWVAAPPEFSKDAVTVAVPLLDEGRAYFFSGNYDGEQCESGQRFAVDVAHGQGLPPELKPPVDDAPAPSSAWPDDGAAAL

SEQ ID NO: 46560 - DNA, 639 bp, Zea mays
  misc_feature: Ceres CLONE 1452183-F
  misc_feature (255)..(255): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (466)..(466): n is a, c, t, g, unknown, or other
  misc_feature (485)..(485): n is a, c, t, g, unknown, or other
  misc_feature (491)..(491): n is a, c, t, g, unknown, or other
  misc_feature (533)..(533): n is a, c, t, g, unknown, or other
  misc_feature (534)..(534): n is a, c, t, g, unknown, or other
  misc_feature (538)..(538): n is a, c, t, g, unknown, or other
ggagctccccgcggtggcggccgctctagaactagtggatcccccgggctgcaggaattcgcacgagaccattacctagaacatcctaatcgaaaaaacgaagaacggaaagagcatcgagagcgagccgccattgcctagaggaactcggcgagagctccattcgattcgaggacctccgaagaaggcccatagccgtgcactggggaagaagaggtctaggagcaagatgaagccggggcctttggggaagancctggggaaccttggggcccctggaacccctaaggggggttcctttcattcgaaacggttcctttccaaaaaaaaaaaaaggtgggaaagggccgggaaaacccccctccccccggggcccaaaaaaaaaacttccccccccgtgggccccccccgcggcccctgggggannntttcccaaaaaaagtgggggaggaaccccccccgcaanagaaaatttccggggggcntccccncccccttttttttgaggaggaaagaacccccccccccccgcnncccnaagaggggggggggggagttgttttttggggcggcgggaggagaataattattttttggtccgccccccgccgggggaatataataaaaaaaaaaaccggc

SEQ ID NO: 46561 - DNA, 688 bp, Zea mays
  misc_feature: Ceres CLONE 1452184-F
  misc_feature: Encodes the peptide sequence at SEQ ID NO. 46562
  misc_feature (688)..(688): n is a, c, t, g, unknown, or other
tggagctccccgcggtggcggccgctctagaactagtggatcccccgggctgcaggaattcgcacgagaccattacctagaacatcctaatcgaaaaaaacgctccgacctaaaccatattcctttcatcattgcatcttccctccgatccttccggtgggggcggccagatgcgaccaaattcctcctattccctctcctctccgcccacccttctctcgcccgcgtaactcctctgtgtcgcctaccagaagcggagcaaccgaggcaagaggaaggggtgggcgaggaaaagcgatttggcttctcttccagttccggattcatcgtaagaaacacatgactgcaatggatatctgaagcatgaaaagacaaaccatctcactcttcaaacagttcacctagcacacttaatggcggaggtgtttgcatgacattctctttgagctgatatatatgggagcagtggctgcattggtaatttaagaaaatctcagtcacttccagattctaagccgaaacgatctttaagaaagaaatctctggattcatctactggaaacagaagacgatggcaatcgagtctagaagcaatggagaagaatgttagcatatcagtttctcttgaggggaatatctcttctattcccaactcgatagtcaacgattctaaaacattaatggaaan

SEQ ID NO: 46562 - protein, 31 aa, Zea mays
  misc_feature: Ceres CLONE 1452184-F
MEKNVSISVSLEGNISSIPNSIVNDSKTLME

SEQ ID NO: 46563 - DNA, 746 bp, Zea mays
  misc_feature: Ceres CLONE 1452186-F
  misc_feature: Encodes the peptide sequence at SEQ ID NO. 46564
  misc_feature (746)..(746): n is a, c, t, g, unknown, or other
ggagctccccgcggtggcggccgctctagaactagtggatcccccgggctgcaggaattcgcacgagaccattacctagaacatcctaatcgaaaaatattccagcccacactacgcctctaaccctaggccacccggccatgcccaggctcccacccgccaggccgccacccaccccactcggccactcccccaggcggcgaggcgcggcgcccataccccaacccctgttcgcaggtcgcagcagccgctagcacccagatcccagagtcccagaccatgccgccactgtgccttcttattttgtccgccgaacaagccagtagtggctacatcgtgaagggcggcaaggcagatctagggcgatcatggcttacgtcgagagaggtgttggaaggtctcgtttatctgcatgaacaaggtgtcattcatagagatatcaagggcgcaaatatactgagtaccaaagagggtcttggcaaacttgctgattttgaagttgccactaaattgactgaagctgacatcaacactcattctgtggtcggcactccatactggatggcgcctgaggtcggctattgactaaccatttgttgaatatgatgtttctactgcagagaatgtaccatgaatcacatgaatttggtggtcatatgttcaacactctcctagagggtgttctcgacaaagaaagcttgtaccttaaaacaggaggatacaagaagctggagtggttgtctgan

SEQ ID NO: 46564 - protein, 101 aa, Zea mays
  misc_feature: Ceres CLONE 1452186-F
  misc_feature: SWISSPROT Homolog: EC 2.7.11.1 Non-specific serine/threonine protein kinase
MPPLCLLILSAEQASSGYIVKGGKADLGRSWLTSREVLEGLVYLHEQGVIHRDIKGANILSTKEGLGKLADFEVATKLTEADINTHSVVGTPYWMAPEVGY

SEQ ID NO: 46565 - DNA, 695 bp, Zea mays
  misc_feature: Ceres CLONE 1452190-F
  misc_feature: Encodes the peptide sequence at SEQ ID NO. 46566
tggagctccccgcggtggcggccgctctagaactagtggatcccccgggctgcaggaattcgcacgagaccattacctagaacatcctaatcgaaaaatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgaacctttgagtgacatgctacatcggtcagccctgtcgtttggtttcaatccgtacccggcttccacaacatccaaaatggtttttggcccccaaggattcaagcctccaccggcctaaatagctaaatttaaatccaaaccaaacgg

SEQ ID NO: 46566 - protein, 172 aa, Zea mays
  misc_feature: Ceres CLONE 1452190-F
  misc_feature (44)..(108): Pfam Name: Glutaredoxin Pfam Description: Glutaredoxin
  misc_feature: SWISSPROT Homolog: EC 1.11.1.15 Peroxiredoxin
MVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDEPLSDMLHRSALSFGFNPYPASTTSKMVFGPQGFKPPPA

SEQ ID NO: 46567 - DNA, 705 bp, Zea mays
  misc_feature: Ceres CLONE 1452191-F
  misc_feature: Encodes the peptide sequence at SEQ ID NO. 46568
ggagctccccgcggtggcggccgctctagaactagtggatcccccgggctgcaggaattcgcacgagaccattacctagaacatcctaatcgaaaacagttcgttgccgtcttctcttgctttgggtggttcgtccgaccttgcctcggcggatctgctcctccagacacagtgcacccgccttcctcatcctgattccgtggccggcggccgcctaacctcagccccctcacccccaccgacgccgccggagcccttgaagtagcggacccgggctctcgcgcccatccgcgtctggagttcgatgtcgcgtttgagcctgatgcatccgcaccggctgaccggccccgacgcgtcctacgccgacgatgccgatgactggaataatgatgactttgtgactcccaagttttagttgtatgaagaatctgatgtcactgactggtcaagcttctcgggctaccgatcctcatccacctccaaggcccagctgagatacacagaacatatgtcttggaccacacggagcaccgccttctacgagcgaacaaagccttaggatactttgggctacgggtggggcccgtgggtatgaaaaacaaacccgagggaaacttgaacaaaaaggccttttgggaactgggcggaaaagacaaaggggcccaccccgggaaatattcccccgctccatagggggggggcccc

SEQ ID NO: 46568 - protein, 30 aa, Zea mays
  misc_feature: Ceres CLONE 1452191-F
MHPHRLTGPDASYADDADDWNNDDFVTPKF

SEQ ID NO: 46569 - DNA, 750 bp, Zea mays
  misc_feature: Ceres CLONE 1452192-F
  misc_feature: Encodes the peptide sequence at SEQ ID NO. 46570
  misc_feature (444)..(444): n is a, c, t, g, unknown, or other
  misc_feature (557)..(557): n is a, c, t, g, unknown, or other
ctggagctccccgcggtggcggccgctctagaactagtggatcccccgggctgcaggaattcgcacgagaccattacctagaacatcctaatcgaaaaacccgatccggacaccgctccaggctccacctctctcccatctcacgccaacgctcactggaccattcctccgtgcttgggagcggcggagagctatccacctcgtctcaggcaccctctggcgtccccctccccccgccgcgtgctggcgagctgcggagatccgggattttgacctcgcctccttctgctgacttgtgaacgaggcagcatcatagttcagtttggaaacatgtcatcgaagaagatagagttggatcacaaggacatggtccatgattctgccatcgactactatggcaagcgccttgccactgcctcttcagacttcaccgtgaagatcgtncacattggtgctgcaaatgccccatcccaggtcctttgcacgcttagtggccactatggtcctgtgtggcgtgttgcttgggcccatccaagtatggtgcaatccttgcatcntgcagttataagggccgtgtccttattgggaaggagatgcccaaggcattgggcctcaggccccgtcttccatgaaaacaagcaccggcaactcattgttgggctccgaagaagtggccccgccctgccgggcctcttcgggggaaaaatcccctcttgccaaccacttaagggggttgggaaaccgaaccct

SEQ ID NO: 46570 - protein, 140 aa, Zea mays
  misc_feature: Ceres CLONE 1452192-F
  misc_feature (76)..(76): Xaa is any aa, unknown, or other
MSSKKIELDHKDMVHDSAIDYYGKRLATASSDFTVKIVHIGAANAPSQVLCTLSGHYGPVWRVAWAHPSMVQSLHXAVIRAVSLLGRRCPRHWASGPVFHENKHRQLIVGLRRSGPALPGLFGGKIPSCQPLKGVGKPNP

SEQ ID NO: 46571 - DNA, 699 bp, Zea mays
  misc_feature: Ceres CLONE 1452199-F
  misc_feature: Encodes the peptide sequence at SEQ ID NO. 46572
  misc_feature (147)..(147): n is a, c, t, g, unknown, or other
  misc_feature (376)..(376): n is a, c, t, g, unknown, or other
  misc_feature (699)..(699): n is a, c, t, g, unknown, or other
tggagctccccgcggtggcggccgctctagaactagtggatcccccgggctgcaggaattcgcacgagaccattacctagaacatcctaatcgaaaaactcttcgtcccctcccacccgcaaccgcacagagaaaggggaggaggcntcttctacccagcgcagcccgagcacccctccccccccggatcgggacccctgctctgcgcaatccacccatggcggaggaatcaggccgcccccttgcaaaatttggcgattgggatgttaatgatccagcttctgcagacggattcactgtcatattcaacaaagccagagatgagaagaagggtggggaacggaccagacactgagtcaccttccaaggacaccangactgagagggttgaaatcttatgctgccaaagccaacaccaaagaaatgggttttgttgtgtgacaacccacccctacccaatccctggaggaaaaacactgcctgccccttttgggaaaaccggccccctttaattttccaaaccaacctcttccctaaaaacaagtggagggggtacccaaggccttctcccggttcccggaagggggctatttcccgaaaaactctttggcgggggggtttttatggggggggaaaaaaatttccaaaagggggcacctcgggggggaaatttttaaaccggttttttttctcttcttn

SEQ ID NO: 46572 - protein, 45 aa, Zea mays
  misc_feature: Ceres CLONE 1452199-F
  misc_feature (1)..(44): Pfam Name: NOI Pfam Description: Nitrate-induced NOI protein
MAEESGRPLAKFGDWDVNDPASADGFTVIFNKARDEKKGGERTRH

SEQ ID NO: 46573 - DNA, 797 bp, Zea mays
  misc_feature: Ceres CLONE 1452201-F
  misc_feature (15)..(15): n is a, c, t, g, unknown, or other
  misc_feature (17)..(17): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttttcccctcccccncncggttggcgtttcgnncnccgcccnnnnctaaaactggaactccccgcggtggcggccgctctagaatagtggatcccccgggctgcaggaattcgcacgagaccattacctagaacatcctaatcgaaaacccgatgccctaacccatggttacgactccgacgacgcgaccccggcggcctgctgcccagctccctctgccttcgcgccgtgcctcctaccctcctgaatccgcgccgtgccacccgagtccaggcccccagggtgcgagggcggcaccggcgcaggcgaaccgcagtccgcgcctccgcactccgccccatccgaagctccgagcacagcaggagcagcaaagcaagcgagcgtcagtggcagactggctgaatcgagaggtggaggcagcaaggaaccaaggtaccactatgaacgtcaagattctccaccgccatgcaggtgggcttcttggacgtgggatgccccggatgagacatgtgggcatatgccggatggctgttgagggctgctgtcctgagtgtgacttccctgggtgatgattggccccctccgtttgcggtgactggcagccaaggctgagtagggtggcgggggccgccgggagggggtgcagttctttagaagtcccccgggaggtgggcggcgataggtggtgccaacgagaggggtggcgtgtttggggggcgcatcgggacctttgtggcgcgctcgggagggatggccccaagaggagaattctttttggtttaccgccagagaaaggg

SEQ ID NO: 46574 - DNA, 742 bp, Zea mays
  misc_feature: Ceres CLONE 1452202-F
  misc_feature: Translation starting site: 205
  misc_feature: SWISSPROT Homolog: EC 1.7.3.3 Urate oxidase
tggagctccccgcggtggcggccgctctagaactagtggatcccccgggctgcaggaattcgcacgagaccattacctagaacatcctaatcgaaaaaacgcaaacccagacggcccgccagacccagcggtcgcttactcgcatcgcagcgcactcgcgccacagtcggcatcacagaccagatccctgcgggtgcggcggccatggccgagaacttccaactccagggccggcacggcaagtcccgcgtccgcgtctcccgcgtctggcgccgcccggccgcggcggggggcgacgtcatcgttgagtggaacgtcgccgtcagtatcgtctccgactgcctcccctcctacacctccagcgacaactccgccatcgtcgccacagattccatcaagaacaccgtgtatgtcaaggcgaaagagtgcacggaagtggtgtcccatggagaattcgccgtgattcttggaagcatttcacctcgctgtaccctcaggtttcagaagccacggtgactatcgtgaagcgccatgggagcgtgtgactgtcaacggaaaacctcatcgcatggggtcaaagttgtggttaaaaaccccgcacaaaggcatgtaaaaaatccggaaactgctttaaattcggaatccaggaacccccggccaaaaaaacccaccgggtttaaggtccggaagaacctaaaggttttcccgaccggggaaggatttcccccaaaaaacggtgggg

SEQ ID NO: 46575 - DNA, 762 bp, Zea mays
  misc_feature: Ceres CLONE 1452203-F
  misc_feature: Translation starting site: 166
  misc_feature (762)..(762): n is a, c, t, g, unknown, or other
ggagctccccgcggtggcggccgctctagaactagtggatcccccgggctgcaggaattcgcacgagaccattacctagaacatcctaatcgaaaagcatctacgttctactcccactcgcggtcgcggtagccggcggcggcggcggaggaaagcaggcaggccatggcgtcgtcgtcgtcttcgaccccggcggccgtccgcgagatgcaaaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaacctcatcggaccggtgctggtcaagtaggacctctccccaccccaacgccaacgtcaagaagcgcatcgagtacatctccgcagagctgaaccggatggatcgggcgctcaaagacttggaggaaaagcaaaacagcaagaaggaatcgatattcaagttgcagcagaggatgcaggctgtacaagcttaggcttacacaactgtttgttggttgcaactagttcaaggccatgcttcatttcatccccatttcctcccgggtttttttttgttgggaggaatcaggtgtctgatgttctctgtccccctaccaaaaaagacggaaaaacggttccctaggaaataacaggtttattttgtttgccctaaaaagagaagggtgcccctaataan

SEQ ID NO: 46576 - DNA, 692 bp, Zea mays
  misc_feature: Ceres CLONE 1452204-F
  misc_feature: Encodes the peptide sequence at SEQ ID NO. 46577
tggagctccccgcggtggcggccgctctagaactagtggatcccccgggctgcaggaattcgcacgagaccattacctagaacatcctaatcgaaaaaagaacacccgtatccccgtcgctgcaggaccggccggcgtccaacagagacagaccccaactcggagagcaggctgtttctgctgaacctgaacatctacgtcccgcgcgacgagcggtttgggcatctcaagatgtcggacttcctcgggtactcactgaaggcgatcatcgaggctgtccttccgacgctggggacgttcgtcgacgatacgcccaaggagttcgattcgttcgaagacatccttgggctctacgagccgggtccagaggcgcccaacaacccactggtagcagaggtcaggaagagaatccccagcgagttcctcagaagcattctgcccaatggtagccatgaccaccccctgaagatgccccttccaaatatcatcagatcagatgtgttgaaaaaggctccagagtttaagtttggctggaggaccgacgaagagtttgcgagggagacgcttgcaggcgtgaaccagtgctcatcaaacgcctgaacgagttccccagctaaaagtaccctgggacccaagcattccggagacctacaagcaaaatccccttatcatcccgcaaccccaaggggggc

SEQ ID NO: 46577 - protein, 122 aa, Zea mays
  misc_feature: Ceres CLONE 1452204-F
  misc_feature: SWISSPROT Homolog: EC 1.13.11.12 Lipoxygenase
MSDFLGYSLKAIIEAVLPTLGTFVDDTPKEFDSFEDILGLYEPGPEAPNNPLVAEVRKRIPSEFLRSILPNGSHDHPLKMPLPNIIRSDVLKKAPEFKFGWRTDEEFARETLAGVNQCSSNA

SEQ ID NO: 46578 - DNA, 781 bp, Zea mays
  misc_feature: Ceres CLONE 1452205-F
  misc_feature: Encodes the peptide sequence at SEQ ID NO. 46579
  misc_feature (362)..(362): n is a, c, t, g, unknown, or other
  misc_feature (363)..(363): n is a, c, t, g, unknown, or other
tccccgcggtggcggccgctctagaactagtggatcccccgggctgcaggaattcgcacgagaccattacctagaacatcctaatatcggatcggttggtttatgcaccagcgcccagcggtttctcgaggtgcgtgcgtgcgtgcgtgagagagaggcgacttcccggaggtttagcatcttcttctctcactctcagtctcaccctgtccctcgcaaaagcatctccatccttcgctcctctcttcccgcactgttctcggaatcgctcttctcctccgcgctgttcttggaatcgaaaggtgggaagcgcaatgagcaacgagttcgattacctgttcaagcttctcctgatcggggannccacggggggcaagtcctgcttcctcctccgcttcacccaccactcctacccgaacagctacatcagcacgatcggggtcgactttaaaatccgcacggtcgaggtggagggcaagaccgtaaagctggggattttgggaccaccgcaggcctggagcggttcaggaccattcccgaccgccttcctacggaggagctcccggggattattattggtttttgacctcccgggactcgggagagcttctaccaccgggaaacccgtggtttggcacaaatccgaccggttcgcccaacgcactgtcgggcgccaagttttcttggtgggcaacaagttggggatctgggccataaaactgggggttgtcccgatgccgttcagctatgcgcaaggcttttcccgctgaagaagagattg

SEQ ID NO: 46579 - protein, 151 aa, Zea mays
  misc_feature: Ceres CLONE 1452205-F
  misc_feature (10)..(136): Pfam Name: Ras Pfam Description: Ras family
  misc_feature (16)..(16): Xaa is any aa, unknown, or other
  misc_feature (17)..(17): Xaa is any aa, unknown, or other
MSNEFDYLFKLLLIGXXTGGKSCFLLRFTHHSYPNSYISTIGVDFKIRTVEVEGKTVKLGILGPPQAWSGSGPFPTAFLRRSSRGLLLVFDLPGLGRASTTGKPVVWHKSDRFAQRTVGRQVFLVGNKLGIWAIKLGVVPMPFSYAQGFSR

SEQ ID NO: 46580 - DNA, 623 bp, Zea mays
  misc_feature: Ceres CLONE 1452207-F
  misc_feature: Encodes the peptide sequence at SEQ ID NO. 46581
  misc_feature (202)..(202): n is a, c, t, g, unknown, or other
ggagctccccgcggtggcggccgctctattctagtggatcccccgggctgcaggaattcgcacgagaccattaccagaacatcctaatcgaaaactctgcttctggcgaccaaattctgccgtctccaccgccgccgcagccagcgtcaccggagggatctgccgtctcccttgctccacgcgatgaacaccgacatcaccngcctcgactaagccggagtacccggtggtggatcggaacccggccttcaccaaggtggtcggcaacttctctgcgctcgactacatgcgcctctccaccatctccgccgtctccgtcaccgttggctacctctccgggatcaagccggggatccgggggccccgtcgagggccacggggcgggcctcatccgggggtcatggggaaggggttcatggacccctatcccaaaaattcccgccggggggccccaaatggggattttttttttccccccaaaaaaaccccccaaaggtggccgcgtataaaaaaaaaaaagttttttttgaggaaaacaaagtcccctttccccgcttttttttttttaaaaaaaccgtttcccccccgttttcttttctccggagatacggcgggaaaaaact

SEQ ID NO: 46581 - protein, 112 aa, Zea mays
  misc_feature: Ceres CLONE 1452207-F
MRLSTISAVSVTVGYLSGIKPGIRGPRRGPRGGPHPGVMGKGFMDPYPKNSRRGAPNGDFFFPPKKTPQRWPRIKKKKFFLRKTKSPFPAFFFLKKPFPPRFLFSGDTAGKN

SEQ ID NO: 46582 - DNA, 911 bp, Zea mays
  misc_feature: Ceres CLONE 1452210-F
  misc_feature (9)..(9): n is a, c, t, g, unknown, or other
  misc_feature (10)..(10): n is a, c, t, g, unknown, or other
  misc_feature (17)..(17): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (308)..(308): n is a, c, t, g, unknown, or other
  misc_feature (447)..(447): n is a, c, t, g, unknown, or other
  misc_feature (448)..(448): n is a, c, t, g, unknown, or other
  misc_feature (466)..(466): n is a, c, t, g, unknown, or other
  misc_feature (473)..(473): n is a, c, t, g, unknown, or other
  misc_feature (475)..(475): n is a, c, t, g, unknown, or other
ggggggggnnaccaaanaaaaaaaacannnnacaaaaaaaaaaaactggagctcaccgcggaggcggccgctctataatagtggatcccccgggctgcaggaattcccacgagaccattacctaaaacatcctaatcgaaaaaaccaggaacggagccagacctcggccggccggtcccatcaaaacccatcccccacggccgcggaagctcgctcgactcaacaccccaacccttcccacgttccagctttcaacaacacacccggggctcctcggtggcctttcccctcgccccctagcgacaccnaccccaacccatggtcggtggcgccgaccgcccggcgccagtgcgcgccgaggactccggctccggcggcatcaacgtctggatcgattatgtctcgtgttataaaacaaaccacttcttagtaatggccaaggggatnnaggggccccacacccaanagaaaananagaagtaagtgaatttgcaaatacaactcccctgaccccgaaaagacctgcaccgcccctgaaataaaaaggatcccaatgcttcactctcagacgggagataggatacaagttggagttaaaagttttaaaccattctgaatgtggttgagatgtttacgatcggcccacacatccagtatctctatcaaaatgatttgcctttccattggcgcaacctctcattgtgtactgattaaacccaaggagagatattacatgttggcgtagggacttggtagtgctctttttgataatctcccttgtgctataatagggaatagacactaatgaggataacccctctgtccggccacgcggcacaggggatataccactccgcgtacaacgtggacggaaaccccccctcaacatgctgtgtgttcacataatcggg

SEQ ID NO: 46583 - DNA, 733 bp, Zea mays
  misc_feature: Ceres CLONE 1452213-F
  misc_feature: Encodes the peptide sequence at SEQ ID NO. 46584
  misc_feature (733)..(733): n is a, c, t, g, unknown, or other
gggctgcaagaattcgcacgagaccattacctagaacatcctaatcgaaaaatttttttgttcgccaacccgatgctgctgtgctgccactgccagtgggcacggtcctcggcgcgatcaccagtggactcatcggcctggccacacacactggcgtgatacacggcacgggcgtcggcggcatcatggcccccctggcgtccatggaggacaccaagtcgatgtgtcgctcccacaagccggcaatcttcgacgtcgtctacctgctagatgtcatctggagcttgctcaccagccgccttgtgctcaaaaaggtgaaccccgccccactcaaccccaccacacagccttattgagtgtaccccactctcacgcctttgcctggcacaccacgtcgtacatcttcataaacagaccggcacccacaagcccgggtgagtgtccaccatggtacgcgctccctcgtcgttaggttcacccaaccaccaaaacgtcaaaggccattcggggagctctacccctggaaccctcttcccccaccaactcctatcccacccaaccactacagaatacttctcgttaatccaccacacagttccacatgcaaaggtttggaaatgtggttgaaatgaaaaattcaccagccccctgtcctccccccccacgtaggggggagtccgtatctcctaatcttgaaagtatgtgtggtcctcaaaattgttatgacaaaacn

SEQ ID NO: 46584 - protein, 56 aa, Zea mays
  misc_feature: Ceres CLONE 1452213-F
MAPLASMEDTKSMCRSHKPAIFDVVYLLDVIWSLLTSRLVLKKVNPAPLNPTTQPY

SEQ ID NO: 46585 - DNA, 967 bp, Zea mays
  misc_feature: Ceres CLONE 1452215-F
  misc_feature (12)..(12): n is a, c, t, g, unknown, or other
  misc_feature (20)..(20): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (36)..(36): n is a, c, t, g, unknown, or other
  misc_feature (41)..(41): n is a, c, t, g, unknown, or other
  misc_feature (422)..(422): n is a, c, t, g, unknown, or other
  misc_feature (482)..(482): n is a, c, t, g, unknown, or other
  misc_feature (483)..(483): n is a, c, t, g, unknown, or other
  misc_feature (495)..(495): n is a, c, t, g, unknown, or other
  misc_feature (679)..(679): n is a, c, t, g, unknown, or other
  misc_feature (776)..(776): n is a, c, t, g, unknown, or other
  misc_feature (815)..(815): n is a, c, t, g, unknown, or other
ccctttgtgagncccagggnangaaanncaaantcnccctntaaaattggaactccccacggaggcggccgctctttactagtggatcccccgggctgcaggaattcccacgagaccattacctaaaacatactaatcaaaaaacggatccaccggagagatctggtctgccgttccctcgctccttcccgtgaaccacaaacctaacacggagcggcgcgggccggccgccgggcgaggtgcgcgtagctgccgtcgattgtcgcaagatccatccaccatgggaggtggcaagggccagaaggtccaacatggtcccggagggcaacttgtaaaaaaacaagggggccaaggggagccagctcgagaccaaaaagaaagccatgaccatccatagtatagtgtgtttgtgtaaccccccncgggtaccactattggaagtggatttgttgagagttagatgcgaaccccacccccccccnnaaccacacaganaaacacaccgcccatcccccccccatacaaaaaaccccaaccacgcccaacaaaccacaagcccacaaacatggttgagttttgtttttctctttcaggtttatgacatacaataacagcatgatgtcctattgcaggcatctgacactatgatatatatgtgagatggcatttagccttgtantgttacttagattcgtaatagttacattgtgaattagattttctagacttaatcgtgtgacaaaagaaataaatttattgtgatataagatgtatcngtcgttaacaccaaacgcggacatgttagctcaagggcnccgttatttggttaatagtttatccagtatctattagttcttatgtgaagtcgaaaatatatacgaaattccatcataaccatagagcatcaacattagattagactcacctcacttctccgtctctttctgtctttttataagacaaaatt

SEQ ID NO: 46586 - DNA, 638 bp, Zea mays
  misc_feature: Ceres CLONE 1452217-F
  misc_feature: Encodes the peptide sequence at SEQ ID NO. 46587
  misc_feature (493)..(493): n is a, c, t, g, unknown, or other
  misc_feature (547)..(547): n is a, c, t, g, unknown, or other
aagctggagctccccgcggtggcggccgctctagactagtggatcccccgggctgcaggaattcgcacgagaccattacatagaacatcctaatcgaaaaagaaccgagatcctcaaaacccttttccctcctcccttctcccctctcggatcgagtgcttgagctccgaccaaatctcgcagcggctgcaattccgagcccgaagagcggatcaggcgaggacgacgccttcgattctgatctgcggtcggcgcgacccagagagaaccggagatgcagcagggcgacggcacggaggcgcaggtgacgtgggaggaccagcagaacatcaaccgcttcggtcgcctcaacaaccgcctccacgagctccaggaagagatcaagctcgcaaaggagacgaatgagaaccttgatgatgctgggaatgaactcatcttgtccgatgaagacgttgtacgcttccaaattggggaagtgtttgctcacatgccnaggggatgacgtcgagactaggctgggagcagatgaaagagggatgcggctaanaacctgggagagggttagaggaggaaaaggaatccctcccgggccccaaatggcccaacctgaaaaaaaaaaccgttacggggaagttcca

SEQ ID NO: 46587 - protein, 75 aa, Zea mays
  misc_feature: Ceres CLONE 1452217-F
MQQGDGTEAQVTWEDQQNINRFGRLNNRLHELQEEIKLAKETNENLDDAGNELILSDEDVVRFQIGEVFAHMPRG

SEQ ID NO: 46588 - DNA, 711 bp, Zea mays
  misc_feature: Ceres CLONE 1452221-F
  misc_feature: Encodes the peptide sequence at SEQ ID NO. 46589
aaagctggagctccccgcggtggcggccgctctagaactagtggatcccccgggctgcaggaattcgcacgagaccattacctagaacatcctaatcgaaaaaacagaacagacagaggaggggaggcgaggcgaggcggaaatggggctccgcgtccgcgcctcctcgcttctgctatccctcgccatcgagctcgcggccgtgctcgtctcagtgtcggcgcagcagaaattcgggatcaactacgggcagatcgcgaacaatctcccggacccgacgcaggtggcgaccctcctccggtcgatgaacgtgaacaaggtgaagctctacgacgcggacccccgggtgctgaccgcgttcgcccacacgggcggtggagttcatcatcgccggtggcaaacaagaacttgcaaaccttggccggcaaccccgcccccggcccggtattgggtggcgggaaaaactggggccccttaattccgggcaccgggaatacccggggttccccgggggaaaagaaggtcttctcccggaaaaaacagggccccaaagggccccctccccccccccccctaaaaggcccccccccgggggcttccgggaaaacggggccccgggggggcacagccccccctctcgttggggggcccttccgggaaagggttctccccccccattttccccccccctttctggggggggtttcccgg

SEQ ID NO: 46589 - protein, 111 aa, Zea mays
  misc_feature: Ceres CLONE 1452221-F
  misc_feature: SWISSPROT Homolog: EC 3.2.1.39 Glucan endo-1,3-beta-D-glucosidase
MGLRVRASSLLLSLAIELAAVLVSVSAQQKFGINYGQIANNLPDPTQVATLLRSMNVNKVKLYDADPRVLTAFAHTGGGVHHRRWQTRTCKPWPATPPPARYWVAGKTGAP

SEQ ID NO: 46590 - DNA, 681 bp, Zea mays
  misc_feature: Ceres CLONE 1452224-F
  misc_feature: Encodes the peptide sequence at SEQ ID NO. 46591
ggagctccccgcggtggcggccgctctagaactagtggatcccccgggctgcaggaattcgcacgagaccattacctagaacatcctaatcgaaaaaaatctctcagataagttgaatagtatcgaaaaccctaatccgtctccctcctatcgcactcgcgtctctttcctattcgcgccgccaccgctgctgcaagcgccagctcgccgtcgtccgaatagtacactctaacgccgccatggggcgtatgcacagccgcgggaagggtatctcgtcgtcggcgctgccgtacaagaggacgcctcctacctggctgaagaccgccgcctccgacgtggaggagatgatcacaaaggcagcgaagaagggacagatgccgtcgcagatcggcgtcctgctccgtgaccagcacggtatccccctttgtcagagtgtcaccggcagcaaaatcctccgcatcctcaaggccatggggctggcacccgaaatccccgaagacctgtactccctcatcaagaaggcggtggccaataaggaagcacctttgaaaggaccgggaggaccaagaactctaattcgggctcatcttgccaaagaaggatcccccgccctggccctatataaaagggacaaagaaactcccccccccgggaaattcaaagcaacccctggaaagccct

SEQ ID NO: 46591 - protein, 147 aa, Zea mays
  misc_feature: Ceres CLONE 1452224-F
  misc_feature (1)..(60): Pfam Name: Ribosomal_S13_N Pfam Description: Ribosomal S13/S15 N-terminal domain
MGRMHSRGKGISSSALPYKRTPPTWLKTAASDVEEMITKAAKKGQMPSQIGVLLRDQHGIPLCQSVTGSKILRILKAMGLAPEIPEDLYSLIKKAVANKEAPLKGPGGPRTLIRAHLAKEGSPALALYKRDKETPPPGKFKATPGKP

SEQ ID NO: 46592 - DNA, 731 bp, Zea mays
  misc_feature: Ceres CLONE 1452241-F
  misc_feature: Encodes the peptide sequence at SEQ ID NO. 46593
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (646)..(646): n is a, c, t, g, unknown, or other
  misc_feature (656)..(656): n is a, c, t, g, unknown, or other
  misc_feature (673)..(673): n is a, c, t, g, unknown, or other
ctggagctccccgcggtggcggccgctctagaactagtggatcccccgggctgcaggaattcgcacgagaccattacctagaacatcctaatcgaaaaacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtcccccaagaaccagcgccccaagtgcccctaggccctaccgctctaagggagggaggatgacccaggatttcgctcgcgatcctgcacagcttctagtcttgtactgctagtttagcgcgccgagcgtcggaatgtcgcgacggttccttccgtgcttgtgtgctgtgtttctcctcggacgtgctataacctagaataataaccaaaaaatttnnnanaaaaaaaaanaaaaaaaaaaaccccanaaaaaaaaaaaaaagcttatcgataccgtcgacctcgagggggggcccggtacccaat

SEQ ID NO: 46593 - protein, 96 aa, Zea mays; identical to SEQ ID NO: 44310
  misc_feature: Ceres CLONE 1452241-F
  misc_feature (1)..(96): Pfam Name: GASA Pfam Description: Gibberellin regulated protein

SEQ ID NO: 46594 - DNA, 745 bp, Zea mays
  misc_feature: Ceres CLONE 1452243-F
  misc_feature: Encodes the peptide sequence at SEQ ID NO. 46595
  misc_feature (428)..(428): n is a, c, t, g, unknown, or other
  misc_feature (449)..(449): n is a, c, t, g, unknown, or other
ctggagctccccgcggtggcggccgctctagaactagtggatcccccgggctgcaggaattcgcacgagaccattacctagaacatcctaatcgaaaaatcgattcgctgccacacagatagggttttctctctacgcagcgcgctcctcgatccccaacaggcaacagccaagccgccgtcgtcccccgctccgtagtacggcgccgccagatcgtcagccaccatgatcatctccaagaagaaccgccgcgagatctgcaaatacctgttccatgagggggtcttgtacgccaagaaggactacaacctggccaagcaccctaagcttgatgtgcccaacttggaggtgattaagctcatgcagagcttcaagtcgaaggagtatgtgagggaaaccttctcatggcagtactactactggtaccntcacaacgatggcattgagcnactccgcagcttcctcaaccctgcatcagagggtggtgcctaataccctcaagaagtcttccaagcccccgtctcgttctttcggttctggcccacttggtgaacggcccaggggcccctcctcgttatgaaggggaagggcctaagttgggggaaagggatggttaaaaagaaggcccccgggggctccccgggaactttggggggaaaagggggggggccccgcaaatttccaccctctttttaggggaaaaaacgtggttttggccggggggggcgggggttttttgggtggc

SEQ ID NO: 46595 - protein, 88 aa, Zea mays
  misc_feature: Ceres CLONE 1452243-F
  misc_feature (3)..(86): Pfam Name: S10_plectin Pfam Description: Plectin/S10 domain
  misc_feature (68)..(68): Xaa is any aa, unknown, or other
  misc_feature (75)..(75): Xaa is any aa, unknown, or other
MIISKKNRREICKYLFHEGVLYAKKDYNLAKHPKLDVPNLEVIKLMQSFKSKEYVRETFSWQYYYWYXHNDGIEXLRSFLNPASEGGA

SEQ ID NO: 46596 - DNA, 784 bp, Zea mays
  misc_feature: Ceres CLONE 1452246-F
  misc_feature: Encodes the peptide sequence at SEQ ID NO. 46597
  misc_feature (20)..(20): n is a, c, t, g, unknown, or other
  misc_feature (424)..(424): n is a, c, t, g, unknown, or other
  misc_feature (425)..(425): n is a, c, t, g, unknown, or other
  misc_feature (428)..(428): n is a, c, t, g, unknown, or other
  misc_feature (429)..(429): n is a, c, t, g, unknown, or other
tttttgtctttctctcttcnctcccgtgtcttctctccttctttatcttcccaaatctggaactccccgcggtggcggtcgctcttccctagtggatcccccgggctgcatgttttcgcacgagaccattacctataacatcctaatcgaaaatacgacaaagaaaagaagcgtcacattgaagaattgaagaatagaacaagtgctgtgaagcctggacaatcagtaggcactgcagccattggcggtccattcaagcttttgaatcatgatggaaaacctgttactgaaaaggatttcttgggcaaatggacgctgctttatattggatttacacactgtcttgacatttgtccagatgaactccagaaaatggctgcagcgattgacaaaattaaggaaaaggcaaaactggatgttgtgnnaanntttattacagttgacccagaacagagatactgcctgagcaggttcgggactatgttaaagagttccatccagatctagtatgcctcacgggcacgatatatgaagtaagacaagttgcacgtgcttatcgagtttacctttatcaacacagatgaggagggttctgactaccttgctgatcacccatattgtcattgaccctgatggaccccgcagatcgaactttgtccacgttcttatgggcaagtaactattcactacatatttccccttgcctgacgcgctatctcgttttaaatgatatctcaagtactccccaatgtaaatcaccccacttgcgaaactggcccccttt

SEQ ID NO: 46597 - protein, 44 aa, Zea mays
  misc_feature: Ceres CLONE 1452246-F
  misc_feature (18)..(18): Xaa is any aa, unknown, or other
  misc_feature (19)..(19): Xaa is any aa, unknown, or other
MAAAIDKIKEKAKLDVVXXFITVDPEQRYCLSRFGTMLKSSIQI

SEQ ID NO: 46598 - DNA, 765 bp, Zea mays
  misc_feature: Ceres CLONE 1452248-F
  misc_feature: Encodes the peptide sequence at SEQ ID NO. 46599
ctggagctccccgcggtggcggccgctctagaactagtggatcccccgggctgcaggaattcgcacgagaccattacctagaacatcctaatcgaaaagaaatatcttgccacctgacgcgacagcgacaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgttctcttcaacgacgatcggtgtgcaaatatctttgaagcactagttggcaccttgagggccgccaagaagaggaagatcttgacctacgaaggcgagctgcttctgcaaggtgcccatgacaacgtggagataaccctgttgcccccacctgcagttgctgccgcttgaagcgaagagcaacaccaagttctcgattccatacaactcgtatgcttgtattctgccgtgcctatattagattctctcgaaccatttggtgttccttgaaaactgctatcgtgtgatgtatgaaattgtggtgctcaagaaattgccttgcttgcatatggttgtgttgcttaataaattcaatgctggtatagcattcgtgtcatgagacatgaaaacagcagactggagttaatggccgcggggtattgacgtcttccataaaaaaaaaaaaaaaaagcttatcgataccgtc

SEQ ID NO: 46599 - protein, 87 aa, Zea mays
  misc_feature: Ceres CLONE 1452248-F
MNVEEEVGRLKEEIHRLGQQQPDGSYKVKFGVLFNDDRCANIFEALVGTLRAAKKRKILTYEGELLLQGAHDNVEITLLPPPAVAAA

SEQ ID NO: 46600 - DNA, 702 bp, Zea mays
  misc_feature: Ceres CLONE 1452256-F
  misc_feature: Encodes the peptide sequence at SEQ ID NO. 46601
tggagctccccgcggtggcggccgctctagaactagtggatcccccgggctgcaggaattcgcacgagaccattacctagaacatcctaatcgaaaaggggcgccgcctcgccgggtgcgtgctgctgtggcccttcttcggcggcgagcggaggacgcggtcggaggcggcctacctgggagacgcgttcctgacgctcccgctgtacgaccagatgtggcgcctggcgctgccggcgggggcgacgcgggaccacccggccgcgaacccggaggcgggcgagctcccgccgctgctcgtcgcggccggcgaccgcgacatgctgatcgaccgcatcagggagtacgtggcgcgggtgcgggccgccgccgcgggcaacaggcgcgtcgacctcgtcgagttcccgggcgcggggcacgggttcgccatcctcgagcccgatggcgaggctgcgagtgagctagtccgcgtcgtgcggcggttcgtgcatggcggggatgccgccggcccggcgccgcacagcggccgcggatgagacagggagtcgttgggatttgtccggacacctttctcgtcacgcttccaggtgcagcactttgaacgtttaggtatccgggcgcgtgacatggttgtatcccccccccgggacttgcccaatggaatggggctggcccccccaatattttcggaaaaaacctgcc

SEQ ID NO: 46601 - protein, 106 aa, Zea mays
  misc_feature: Ceres CLONE 1452256-F
MWRLALPAGATRDHPAANPEAGELPPLLVAAGDRDMLIDRIREYVARVRAAAAGNRRVDLVEFPGAGHGFAILEPDGEAASELVRVVRRFVHGGDAAGPAPHSGRG

SEQ ID NO: 46602 - DNA, 897 bp, Zea mays
  misc_feature: Ceres CLONE 1452257-F
  misc_feature: Translation starting site: 144
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (138)..(138): n is a, c, t, g, unknown, or other
  misc_feature (461)..(461): n is a, c, t, g, unknown, or other
  misc_feature (470)..(470): n is a, c, t, g, unknown, or other
  misc_feature (472)..(472): n is a, c, t, g, unknown, or other
  misc_feature (545)..(545): n is a, c, t, g, unknown, or other
  misc_feature (642)..(642): n is a, c, t, g, unknown, or other
  misc_feature (768)..(768): n is a, c, t, g, unknown, or other
  misc_feature (806)..(806): n is a, c, t, g, unknown, or other
ntttgtgcacnnacnnnnnnnnnnnnnttttttnnnnnnnaaaactggggctccccgcggtggagggccgctctataatagtggatcccccgggctgcaggaattcgcacgagaccattacctagaacatcctaatcnaaaagatgaccaccgccgcggacgccgacgtcgacgactaccaccactccgacggattcgtcatgtccgacgtcctcgctcagggccgggaggcctgctacaaggcacgggatgccttctacccgtgcttagagaggcgccccgaaaacagcccaccgagatcgccaccatgggtctcctctaccccgccgactgcaacaagtcccgggacgacttcgtcagcaactgccgccccacctggggcaaggcctccggccggtaggttttgagtcgtggaccccgtgcagaggttgtttctatgcttatgaggtttttccccccgncctccgaananggcccaaggaactaagaccttaaactgcattcagagccgtcccccgggaactgcgaacccgggaaacgcaccncgcctgccaccaaggcacaacgctgcgtggccgggtcttgtctcacgatgctccagagaccatattttgacttgcacctctgcgcgcgctggatacntacctcgacggatacactcgtggtgagcttctccatgtcgcttgctaaagatagcgagcttccccctgtacccctctctatctcccacggccggagcccagagcacctctcactctctcccagatnatgtacactctatcatatgggatcttcgatcgcgtcgnctcgtctctcacccacccctttacctgccatgtgtctcctgtgcgtgtccgccgtccatgctatacgcccagtcttctacattgtcctgtg

SEQ ID NO: 46603 - DNA, 665 bp, Zea mays
  misc_feature: Ceres CLONE 1452260-F
  misc_feature: Encodes the peptide sequence at SEQ ID NO. 46604
ggatcccccgggctgcaggaattcgcacgagaccattacctagaacatcctaatcgaaaaacaacaccgagaagcatgaaaactagaaaaggctcctcccgaccgcaacgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaacaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcaaggccgccaagctggggcggtacaacaagaagcccaccatcacgtcccgcgagatccagacctccgtgcgcctagtcctccccggagagctcgccaagcacgccgtctccgagggaaccaaggccgtccccaagtttcaccagctactgagcgcgctgctgcatccgcggatctgttaatagggttctttgctgtgccctttccccattcccccaccctag

SEQ ID NO: 46604 - protein, 158 aa, Zea mays
  misc_feature: Ceres CLONE 1452260-F
  misc_feature (55)..(125): Pfam Name: Histone Pfam Description: Core histone H2A/H2B/H3/H4
MAPKAEKKPAEKKPAAEEKAEKTTAGKKPKAEKRLPASKSSGKEGGENKGKKKAKKSVETYKIYIFKVLKQVHPDIGISSKAMSIMNSFINDIFEKLAGKAAKLGRYNKKPTITSREIQTSVRLVLPGELAKHAVSEGTKAVPKFHQLLSALLHPRIC

SEQ ID NO: 46605 - DNA, 664 bp, Zea mays
  misc_feature: Ceres CLONE 1452262-F
  misc_feature: Encodes the peptide sequence at SEQ ID NO. 46606
aaaactggagctccccgcggtggcggccgctctagaactagtggatcccccgggctgcaggaattcgcacgagaccattacatagaacatcctaatcgaaaaaaaaaaaaatatttgtttggtgagccacgctcccatccggatccgcgggggaggacggcgatttcgtccccagcctcatgaggtcgggaaggggttcccgcacccacatttgtgaacctcgccggcgcccatcccctgccttcacgaacccgccgccgcccgtcccctactcttcctcgtgcacccaccgtcgctcgtcccctcgtcttccttgcgcactcgccgtcgcctcctcctcaccctcacgcacttgaggccagctgcagaacgaggtcggacggcggagacgaggtcgaggtctacaacctcctcaacttgcgcaagactgccgagactgcagggacaagctctttgctgcctcgtcagctgctagctgacttctcgtttgtagtatgtgaatatcttatttgacaaagtgatacacaagggtttttcatcaacaagtggtcgccagaagaactgaaacatcaagatggcgtttgcttttaggtcatgcccttccggagatgatgctaagctaaataatcacatctatgtgtacactgagactgttttattatag

SEQ ID NO: 46606 - protein, 58 aa, Zea mays
  misc_feature: Ceres CLONE 1452262-F
MRSGRGSRTHICEPRRRPSPAFTNPPPPVPYSSSCTHRRSSPRLPCALAVASSSPSRT

SEQ ID NO: 46607 - DNA, 733 bp, Zea mays
  misc_feature: Ceres CLONE 1452266-F
  misc_feature: Encodes the peptide sequence at SEQ ID NO. 46608
  misc_feature (409)..(409): n is a, c, t, g, unknown, or other
  misc_feature (527)..(527): n is a, c, t, g, unknown, or other
aagctggagctccccgcggtggcggccgctctagaactagtggatcccccgggctgcaggaattcgcacgagaccattacctagaacatcctaatcggaaacattattggcaagagcaaaattctgacctattgctctggagaacaggaactcttcctgcaggccttttgacattttatggcctgatggagcccctagaccgcagatggcatgtcttgggtctcgggtatgatgtagacatagatgatcgtctgattgagagtgctgctgttgtgcactataatggaaacatgaaaccctggctgaagctggctattcgccgttacaagtatatatgggaacggtatgtgaatatctcacacccgtatgttacagagtgtatgttgcattagaaagtctgcaaatctcngcacgttcttgcatggcactgaagctgcatgcttcagtttcttcacatgaggctgcttttgagcaccttatgtgccggaaagttccagaggtagaatatatactcaagggacagcatncaagaagtcaactgttaagttttctttttgggttgggagaagatcattttgggatgaaaataattcctttgcagagtttacatacaatttggactgggaaaatttacagtctaaccgatacatctggatagatactgtaaaagagatacagttggaacaatggacattcctttttttaaattaggaaatgccaaaaaaaaaaaaaa

SEQ ID NO: 46608 - protein, 129 aa, Zea mays
  misc_feature: Ceres CLONE 1452266-F
AGAPRGGGRSRTSGSPGLQEFARDHYLEHPNRKHYWQEQNSDLLLWRTGTLPAGLLTFYGLMEPLDRRWHVLGLGYDVDIDDRLIESAAVVHYNGNMKPWLKLAIRRYKYIWERYVNISHPYVTECMLH

SEQ ID NO: 46609 - DNA, 833 bp, Zea mays
  misc_feature: Ceres CLONE 1452268-F
  misc_feature: Encodes the peptide sequence at SEQ ID NO. 46610
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
gtttctcccgtttttctcttctctcgcacgagggnnnngccgtttnttttcaaactggggctccccgcggtggcggccgctctagaactagtggatcccccgggctgcaggaattcgcacgagaccattacctagaacatcctaatcgaaaagatccgattccaccctcgttctcaggcactgtcacacagacacagttgacctgccactgccagcaaaggaggtcgaggatgccccgcagcggcttttcggggtccttctggtcgcccaagatcgacgtcgtcatcgacatgggaaaccccttcctcaaccgcaccgtcgacggcttcctcaagatcggcgccgtcggctcctgcgaggtggctgccgaggacaccttcgagtgcccccaccaggggggatgttctcgaagcagagggttgatcttgacctcaagaacatgtgcaacgcaaccctcatatttgccccatttgttggcggcagtttatggggggcctggtggtacggggatgagaacagggtccgttgtgcgcacttggacgtggcaccaagcgcgattagatggagggtgcgactattgtgccagggctcccctgcatcgcccctgctgcgctgacacccttcactccgcatgttatatgtctttccaacggtagtcttatccaacccgtacggtgtcttgttcccccagtggctcttccaagttcagtccgccccggcgctcatcctatggccagagagatgtagacgtattgccattgtctggggggggcccacacgccgctgtcatatcagttgaaataagacgaccgtggcgcaagcataaatcccat

SEQ ID NO: 46610 - protein, 141 aa, Zea mays
  misc_feature: Ceres CLONE 1452268-F
MPRSGFSGSFWSPKIDVVIDMGNPFLNRTVDGFLKIGAVGSCEVAAEDTFECPHQGGCSRSRGLILTSRTCATQPSYLPHLLAAVYGGPGGTGMRTGSVVRTWTWHQARLDGGCDYCARAPLHRPCCADTLHSACYMSFQR

SEQ ID NO: 46611 - DNA, 669 bp, Zea mays
  misc_feature: Ceres CLONE 1452272-F
  misc_feature: Translation starting site: 170
  misc_feature: SWISSPROT Homolog: EC 3.2.1.23 Beta-galactosidase
tggagctccccgcggtggcggccgctctagaactagtggatcccccgggctgcaggaattcgcacgagaccattacctagaacatcctaatcgaaaaaaaatcatcttcctcctcttctctcctctcctcttactcttccccaccaacgccaccaaaaccaacactccgatggatgttttcaccaagcaactcctccccatgcctcaccagcgggaccccaactacccttcctcttccacctcttcctcctcgtcgtcgtcctcctccacgcccccatctcgccctcaccaccgtgcgcaaccccaaccccaaccccacaacctcccccagtccccgagacccgtcgccgtaccgtccgtccttgtttcgtgaggtgcttgctttgctgttctccttgatcgacgccgtatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggggtaattaacaagaaggcccgacccaatcgccccttcccaaaaattgccccaaccctgatggggaaatggaaatttgtaacctttaattttttgtta

SEQ ID NO: 46612 - DNA, 695 bp, Zea mays
  misc_feature: Ceres CLONE 1452273-F
  misc_feature: Encodes the peptide sequence at SEQ ID NO. 46613
aagctggagctccccgcggtggcggccgctctagaactagtggatcccccgggctgcaggaattcgcacgagaccattacctagaacatcctaatcgaaaaaaaatagaggaggtagtgccgacagaggcacgagcgcctccctcgtcttcgttccgtctctccccacagggaaccgccgcccgtcgcctccagatacgtgcctccggcggaaaatcggtatcgagctcgctttgttcgaatcttctgtatagccagcaaggaggcctctccatctcctccgggaaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactaccggaaatcgactcctgcactcgagttgccccctgtcatctcctgtagcaaaccgcccgctgtcgccccaccttcctctgaagaagccacagttcagcgcgactttctcattctcgcatcgatattcggtgccccgttgggagtttgccatcgtttctgtccccctccccccccaagtccacctatatttttggggcccaaaaaccattttcttcgcccctagaaaaaaacatccttttg

SEQ ID NO: 46613 - protein, 132 aa, Zea mays
  misc_feature: Ceres CLONE 1452273-F
MEKYNSKTQLAPLRDTPFALRGALGSSSSYLEQARGYTSSPLAALRPKMSSTTGNRLLHSSCPLSSPVANRPLSPHLPLKKPQFSATFSFSHRYSVPRWEFAIVSVPLPPQVHLYFWGPKTIFFAPRKKHPF

SEQ ID NO: 46614 - DNA, 838 bp, Zea mays
  misc_feature: Ceres CLONE 1452275-F
  misc_feature (7)..(7): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
tgggtgnccccgcnggggnncccccnccncnnnnngggtttnnnnnnnaaaactggagctccccgcggtggcggccgctctagactagtggatcccccgggctgcaggaattcgcacgagaccattacctagaacatcctaatcgaaaaaatgtccaatccccgtccccttctccttctacctccccagccaagcgctccgtctgaaagcgccatccgcctcattcgtccagagcttgccgccgctggtcgctgctcccctgacgcgtgggctgccactggccgagggaggcccccgccctggtggatgaggtccgcatgccggagcaagacgctaacgagccggcgtcggccgcaaaccaaatcttgaccccggaaaaaccggaggcgccaagagcgcgcggctgtctttttggggcctctccgctaagggggggggggccaaccccccttgggtttcgccactccccccccgtgtggggggaccaacccaaaatacccgaaacctctgccccgtctgtgttagcgcgaaccccctagatttatcacgtcccgggggtctgcgcgggaatacccaatctccccaccatcttcgccataagggccgaaggccacaaacttcgtgtaacccggcgaggccccgcccttgattcaccctttcccgcagacttccctcttcgtctctcgcccggggccccaccgcgatgtgcctagtggggccccgccaccgaaaccttcaccggtaggtggttccaccagtctcctccgacggatatcgttcgtttctgaacaactcccctccacacacacccgttaaccgcgcccccccctaccgcctg

SEQ ID NO: 46615 - DNA, 752 bp, Zea mays
  misc_feature: Ceres CLONE 1452281-F
  misc_feature: Encodes the peptide sequence at SEQ ID NO. 46616
aagctggagctccccgcggtggcggccgctctagaactagtggatcccccgggctgcaggaattcgcacgagaccattacctagaacatcctaatcgaaaaatcgtccgtccaatccatccattcatctacacacgcagttgcagcagcacatacagctagctcgttactgtttttgcagctgatctgatcgaccgacgcgacccaccgatcatgagctaccaagcgggctacccaccgccgggccaacaggcctacggcgcgcctccgccggcgtacgtcgcgccaccgccggcgtacccgcagacggcccaggaggacggcggcgcgccgtactacggccagcagcagacaaccaccaccaccaccaccagccgcggcggcgacggtttctggaaaggatgctgcgccgccatctgctgctgctgcgtcctcgacatgtgcttctgaggacatatcgtcgatcgacgacggccagggcatgctagctagctgatgaccggccggtacgtgcgtggttgatgatcaccatcatgtgctgctctactagctgctgtgtcattatatattacatcgtgtatacgtatacgtacgtactcgtacgtcttcgaattcattcctgtggttgttgtattatacatatgcagcacactttgtactcgtacccgtgtctgtgtcgtgtatttaattgtcgagacattcttttacgattctaatgtatgtagtattaattacatgctatatatattccgt

SEQ ID NO: 46616 - protein, 78 aa, Zea mays
  misc_feature: Ceres CLONE 1452281-F
MSYQAGYPPPGQQAYGAPPPAYVAPPPAYPQTAQEDGGAPYYGQQQTTTTTTTSRGGDGFWKGCCAAICCCCVLDMCF

SEQ ID NO: 46617 - DNA, 713 bp, Zea mays
  misc_feature: Ceres CLONE 1452290-F
  misc_feature: Encodes the peptide sequence at SEQ ID NO. 46618
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (575)..(575): n is a, c, t, g, unknown, or other
  misc_feature (583)..(583): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (608)..(608): n is a, c, t, g, unknown, or other
  misc_feature (609)..(609): n is a, c, t, g, unknown, or other
  misc_feature (617)..(617): n is a, c, t, g, unknown, or other
  misc_feature (621)..(621): n is a, c, t, g, unknown, or other
  misc_feature (646)..(646): n is a, c, t, g, unknown, or other
tggagctccccgcggtggcggccgctctagaactagtggatcccccgggctgcaggaattcgcacgagaccattacctagaacatcctaatcgaaaaaacacattgttagtattagacactttctagttcatcacccatggcaaagttcttcaactacaccatcatccaaggactcttgatgctttccatggtacttctggcatcgtgtgctattcatgcacacataataagtggggaaactgaagaggttagcatcacagggagcccgacagtgatggtcatgatgggggcaaaccgaaagataattgaagataataaaaatttattgtgctatctaagggctctagagtactgctgtgcgaggaccagacaatgctacgatgacataaagaagtgcttggagcattgccgtggttgaaaggtgtaataaaggatatgctttctttggatcttagttggtgatcagaaaaatgttctaccaattcatgcatgtaccaaaggataatataagctgctcaaaaaatcgtggttaattnnnnnnaaaaannnnaaaaaaaaaannnnnnnnaaaaanaaaaaaanaaaaaaaaaaaaaannnnnnaaaannaaaaaaanaaanaaaaatttttaaaaaaaaaaaaaantgttttttctttcccccccccccccggggggggggcccggaaccacaatttcccccaaaaaggaacc

SEQ ID NO: 46618 - protein, 93 aa, Zea mays
  misc_feature: Ceres CLONE 1452290-F
  misc_feature (18)..(91): Pfam Name: BAP Pfam Description: Basal layer antifungal peptide (BAP)
MAKFFNYTIIQGLLMLSMVLLASCAIHAHIISGETEEVSITGSPTVMVMMGANRKIIEDNKNLLCYLRALEYCCARTRQCYDDIKKCLEHCRG

SEQ ID NO: 46619 - DNA, 698 bp, Zea mays
  misc_feature: Ceres CLONE 1452291-F
  misc_feature: Encodes the peptide sequence at SEQ ID NO. 46620
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (698)..(698): n is a, c, t, g, unknown, or other
atagctggagctccccgcggtggcggccgctctagaactagtggatcccccgggctgcaggaattcgcacgagaccattacctagaacatcctaatcgaaaaaacacattgttagtattagacactttctagttcatcacccatggcaaagttcttcaactacaccatcatccaaggactcttgatgctttccatggtacttctggcatcgtgtgctattcatgcacacataataagtggggaaactgaagaggttagcatcacagggagcccgacagtgatggtcatgatgggggcaaaccgaaagataattgaagataataaaaatttattgtgctatctaagggctctagagtactgctgtgcgaggaccagacaatgctacgatgacataaagaagtgcttggagcattgccgtggttgaaaggtgtaataaaggatatgctttctttggatcttagttggtgatcaaaaaaatgttctaccaattcatgcatgtaccaaaggataatataagctgctcaaaaaatcgtggttaattnnnaacannnncacccattacaaacaactcaataaaaaataatgcaacaaaagtagcttttttcccccccccacaaacaacacaagctttgtgttaaaaaataaaaaaaattttttttatccccccccccccccgggggggggccccgtctcccatn

SEQ ID NO: 46620 - protein, 93 aa, Zea mays; identical to SEQ ID NO: 46618
  misc_feature: Ceres CLONE 1452291-F
  misc_feature (18)..(91): Pfam Name: BAP Pfam Description: Basal layer antifungal peptide (BAP)

SEQ ID NO: 46621 - DNA, 780 bp, Zea mays
  misc_feature: Ceres CLONE 1452294-F
  misc_feature: Encodes the peptide sequence at SEQ ID NO. 46622
  misc_feature (46)..(46): n is a, c, t, g, unknown, or other
  misc_feature (54)..(54): n is a, c, t, g, unknown, or other
cacgctggagctcaccgcggtggcggccgctctagactagtggatnccccgggnctgcaggaattcgcacgagaccattacctagaacatcctaatcgaaaaaggccaccacaccgctctcttcttcaccaccgcgaaagcgagagagggagagagagcaggcagcggcaatggctggcgctggggacaagtactactacggcgggccggggcaggggccgcgcggcgccccacacggcctgctgctggcggtggtggtgggcctcgtggtggcgggccccctgttcctcggcgacggcggggaggcgctcacggaggccgtggcggacctgctgagcccggccgggctgcttctcctctccgtgtccctgctgggcgggggggggcttcctcccccccaaccataaccccccccccgtttgaccccccccccccccccctccgccggaccccccgtacgccggcccaccggggaggtggaggcgcccccctcgcggcgggaggccggcattcggcccccccgcgtcgtcgctgccggggtggcccgcctcgcggtgtgcctccgcggccttccgagggggggttgccgagatcgccccgggctctggggcagtgggccgcgctgtcgtgcccggggcgtgggggcgcgccctcctggctcgtcgggccgtgccccggcgggtccccctcgcgccctcacgtgcccccgcgcggccgccgcccgtccctacctgatgtcgactctcgctcctatgtcgacgccggccttggtgtgctagg

SEQ ID NO: 46622 - protein, 78 aa, Zea mays
  misc_feature: Ceres CLONE 1452294-F
MAGAGDKYYYGGPGQGPRGAPHGLLLAVVVGLVVAGPLFLGDGGEALTEAVADLLSPAGLLLLSVSLLGGGGLPPPQP

SEQ ID NO: 46623 - DNA, 706 bp, Zea mays
  misc_feature: Ceres CLONE 1452296-F
  misc_feature: Encodes the peptide sequence at SEQ ID NO. 46624
tcaccgcggtggcggccgctctagaactagtggatcccccgggctgcaggaattcgcacgagaccattacctagaacatcctaatcgaaaaatcaccacaacacacaaatacagctcagagcaactcacacacaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaacgccggagggagtgccgcggcacggtggccgagtgcctcgccgaggagtcggatgaggagggccttgacctggctggatcccaccgccgcgcgctctacggcggcgggtacatcagctacggcgcgctgcggcgggacaacgtgccctgctcccgccgcggcgccagctactacaactgccgcccgggcggccaggccaacccctaccaccgcggctgctcccgcatcacccgctgccgcggctgaggcggcgcccgatccgccacgactgccgaggaaagggctggtccaggtccccggccctttcgccgacaaaaattttctttccccctttttcgttcagggggctaccgccccccgccaccgcttgtttactattaccaccaccacctaccggattgaaat

SEQ ID NO: 46624 - protein, 118 aa, Zea mays; identical to SEQ ID NO: 6758
  misc_feature: Ceres CLONE 1452296-F
  misc_feature (53)..(118): Pfam Name: RALF Pfam Description: Rapid ALkalinization Factor (RALF)

SEQ ID NO: 46625 - DNA, 682 bp, Zea mays
  misc_feature: Ceres CLONE 1452301-F
  misc_feature: Encodes the peptide sequence at SEQ ID NO. 46626
  misc_feature (682)..(682): n is a, c, t, g, unknown, or other
aaagctggagctccccgcggtggcggccgctctagaactagtggatcccccgggctgcaggaattcgcacgagaccattacctagaacatcctaatcaaaaaacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgagagcgcgcccacctcgcccacctcgaggagatggagaggaccggtgggaagcactagatccgctgcccccgtcctcgccggcagcgcgggaggaccgggtgactttcatggggtccattcaggctgatggctccggttttcttcctgccgttgagacaccggaagccatggttcctttgggcgtggggttttggaccccaaacaaaagaaactggccccgcttttttgtctttgtccccccgcgcctgggccaaaggaacctccaaaaaaaggggggccggcctttgggtttaaaaacacttn

SEQ ID NO: 46626 - protein, 72 aa, Zea mays
  misc_feature: Ceres CLONE 1452301-F
MALRALYNEIRSMKVRDVPAYLKPRLTWDNVKKSADQAVDRYIEKYIDTSSPDPLYHVCIGGMIFSYFVNLP

SEQ ID NO: 46627 - DNA, 672 bp, Zea mays
  misc_feature: Ceres CLONE 1452302-F
  misc_feature: Encodes the peptide sequence at SEQ ID NO. 46628
  misc_feature (534)..(534): n is a, c, t, g, unknown, or other
ggcggccgctctagaactagtggatcccccgggctgcaggaattcgcacgagaccattacctagaacatcctaatcgaaaatttgccatccctagctccacagcaccacttgctcctgcctcctgctgcttcttcccgagttcccgtgccgccgcgagcgctcccaaccaagcaacgagacaacaacaacaaccctgcaccgccgcagcacttgcgccgtccggtcctgtcctcccgcggtctcgacgccgccccctaccgtcctaccttatcgcgcaccgctccatggccgccaagtgggcccagaagaccgtcgttatcccggcgcatcggcggggctgccacctcatcacccccaagattctgagggagatcgagggcgacctggccgggttcaagtgcggtctcgcgcatttcttccttcagcacacaagcgcatcgctgaccatcaacgagaactatgactctgatgtgcaggctgacactgagacttttcttaacaaaatgtttccagagggccacaatgctccttgnaaaccccctatggaaagacctgatgaattgccccccaaaaataaaacctccaaggtttgggttgtccccaaaccaatcccaaaacggatggacgcccccaaaccgggccctttggaagggaaataaggttggccaaaa

SEQ ID NO: 46628 - protein, 124 aa, Zea mays
  misc_feature: Ceres CLONE 1452302-F
  misc_feature (19)..(107): Pfam Name: UPF0047 Pfam Description: Uncharacterised protein family UPF0047
  misc_feature (83)..(83): Xaa is any aa, unknown, or other
MAAKWAQKTVVIPAHRRGCHLITPKILREIEGDLAGFKCGLAHFFLQHTSASLTINENYDSDVQADTETFLNKMFPEGHNAPXKPPMERPDELPPKNKTSKVWVVPKPIPKRMDAPKPGPLEGK

SEQ ID NO: 46629 - DNA, 692 bp, Zea mays
  misc_feature: Ceres CLONE 1452321-F
  misc_feature: Encodes the peptide sequence at SEQ ID NO. 46630
aaagctggagctccccgcggtggcggccgctctagaactagtggatcccccgggctgcaggaattcgcacgagaccattacctagaacatcctaatcgaaaaaagattcgcccagggcaatattccccccggaccaaactagatcagcgaaacccactccgctctcccgagatcggacacatggcggcggcggcagtgacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcggccagccctcggcgtcgctggtgccttcggccgagcccgcggcgaccaggccgctaaaggtcggtgtcgtgctctctggtggacaggcgcccggcgggcacaatgtcatctgcggcatctttgattaccttcaggagcgtgcaaaaggtagcaccttgcttggattcaagggaggccctgctgggatcatgaagtgcaaatatgtggaactcacttcagactttgtgtatccctacagaaaccagggcggattcgatatgatctgcagtggaagggacaagattgaaac

SEQ ID NO: 46630 - protein, 170 aa, Zea mays
  misc_feature: Ceres CLONE 1452321-F
  misc_feature: SWISSPROT Homolog: EC 2.7.1.90 Diphosphate--fructose-6-phosphate 1-phosphotransferase
MAAAAVTSNGGAVAANGPAPGRLASVYSEVQTSRLLHTLPLPSVLRSNFSVVDGPASSAAGNPDEIAKLFPNLFGQPSASLVPSAEPAATRPLKVGVVLSGGQAPGGHNVICGIFDYLQERAKGSTLLGFKGGPAGIMKCKYVELTSDFVYPYRNQGGFDMICSGRDKIE

SEQ ID NO: 46631 - DNA, 822 bp, Zea mays
  misc_feature: Ceres CLONE 1452327-F
  misc_feature (32)..(32): n is a, c, t, g, unknown, or other
  misc_feature (33)..(33): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (47)..(47): n is a, c, t, g, unknown, or other
  misc_feature (48)..(48): n is a, c, t, g, unknown, or other
  misc_feature (477)..(477): n is a, c, t, g, unknown, or other
  misc_feature (515)..(515): n is a, c, t, g, unknown, or other
  misc_feature (550)..(550): n is a, c, t, g, unknown, or other
  misc_feature (708)..(708): n is a, c, t, g, unknown, or other
ttgtttccccggtcttgtcccccctctacctnngttatngtnnngcnntcaaactggagctccccgcggtggcggccgctcttttctagtggatcccccgggctgcaggtattggcacgagaccattacctagaacatcctaatcgaaaaaacaaggacagtggtggatgaggagacccaccgatggctcgcccgtgtgtcgattcccgctcctcacagtcagctgccgccatccatcgcgaccgcgccgttggtcggagtctctcctagcctagcgatcaagtaggtctaaggtctccgccgtcgcccgaaccaggggcgccgcttcccccatgacctcaagcggctccggcctcgccagcggcggggccagttccggctctctccgtgttggccgcactggactcaatccttcgggtgcgggaattggtatgactttttcaaactcccacgacggtggtccccctcccccgaagnggcttcggctcgccaacgtacagaggtctgcctccctnctgttatgtcggttcggaggcgacccctgaagagngttctgttccctttctttgacgcccccacttaaggaatgagcccggggatcccgcccccctacgtccctttacacctttagcgatttgggttccagtcgtgaatccaagcttacttagaggggggtaacacaagatcgccgcgcctttcccggagggnacgtcttcgccgccgccctgataggcgtttgcacctcctacgacacttgggggggggcccccccgcccgcggtgggttgtaacgttccggtcaaccgggttctccctccctgtt

SEQ ID NO: 46632 - DNA, 704 bp, Zea mays
  misc_feature: Ceres CLONE 1452328-F
  misc_feature: Translation starting site: 156
  misc_feature: Pfam Name: DUF588 Pfam Description: Domain of unknown function (DUF588)
  misc_feature (390)..(390): n is a, c, t, g, unknown, or other
  misc_feature (396)..(396): n is a, c, t, g, unknown, or other
  misc_feature (498)..(498): n is a, c, t, g, unknown, or other
aagctggagctccccgcggtggcggccgctctagaactagtggatcccccgggctgcaggaattcgcacgagaccattacctagaacatcctaatcgaaaaaacaagagagcgagatagagaaagaagagataaaataaaaattttaagaagataatggagaagagcgatgatcatcacaagactagccacggtggtgctgcggcggagaagtgggaggaggttagtactgcaatccgaactgcagagacaatgctccggttagctccggtggggctttgtcttgcggcgcttgttatcatgcttaaagactctcagaataatgagttcggttcagtttcttattccaatctctcagctttctggtacttggtgcacgcaaatggaattngtgcangctactctctcctgtcagcagctattgcagccatggcctggttctttctctacaatgcctcgtgtttggactttcctctgtctggaccaggtcctaactacntggttcttgcggctggagctggtctaacggagttctggacctacccaaaaaggaaaaaggcctttcggggagcgagccgggccctcctttgggagttccggcaaaaacccctgctttcggtaaaataacatcccccggggttggctaaagggccttcgggccccattcccccaaaaaaccttttaccccctttgaccccccccccg

SEQ ID NO: 46633 - DNA, 688 bp, Zea mays
  misc_feature: Ceres CLONE 1452333-F
  misc_feature: Translation starting site: 163
  misc_feature (417)..(417): n is a, c, t, g, unknown, or other
aagctggagctccccgcggtggcggccgctctagaactagtggatcccccgggctgcaggaattcgcacgagaccattacctagaacatcctaatcgaaaactaccgctgacagacgattcaaccgtccgccaaatccaaacgcaccgatccattccagaccatggcgacgaccaaggaccccgcgaccaccggcggcgagcccgccatcggcattccctaccacccggcggcggaggcccaggggcactattactacgcgccgccgccgaacccctacgcggcggggatgccgccgcccaacgcgatctacgccggcgcgcccaagggggtgccgctccagcagaccatgttccgcgacacgcccgcgcccttccccagccaggcctgcggtaaaacccccttctcctccgcccgncaaagccaagccttgcatcctccggggcttgcatgaagcccttcaagccagccaccctccttccttatgcccttcgatggactgcctctgggacaaaaacccatattggcccccacctcggggggaaaaaggtgggtgagttcccggaactcgggacccctgccccccggcggggaaacccaccccgggtggtcccaagccccatcttcgttttgggcttggccaaacgccgcttgtgggcctctatcggggcccctctcgcttgacacgc

SEQ ID NO: 46634 - DNA, 753 bp, Zea mays
  misc_feature: Ceres CLONE 1452334-F
  misc_feature: Encodes the peptide sequence at SEQ ID NO. 46635
  misc_feature (456)..(456): n is a, c, t, g, unknown, or other
tccccgcggtggcggccgctctagaactagtggatcccccgggctgcaggaattcgcacgagaccattacctagaacatcctaatcgaaaagccagtttcgttctcatctccgttctctggattgtcccccgctcccctcttccggtcttccactcttccccatgtcggacgcgtataggaaagccaagcccggccgcctcgtcttcaagggcggcgaagccgcctccatccacaagccaaagaagcacaagaagaataagaagcccgcgtcggacgccctcgccgacggcgacatcgaggccgcagccgcggccgcggagggtgctgaaggcggcggaggtgccggcagcggccttgggaataaccaccccattcgcgcgggcgaaagaaaaaggaagtaccagggaacccctccccgggggaagtcaaaaaaaggttccggggattgacccccnaagtaagggcgcgccggcgtcttgcccgccccggaaatcctaccccggagaaaggaaaacccccttaaccaaactgtttggccccgatgaggggggctgaacccgcccgctgcccaatcgagaggttccttccctttggcgcccgtgggttgtgggtttccaccctgagttttgctttccctcctcctggacaagaggtgttcgctcggggagaaattgtatgccctccgtggggttggggtgtctgcattagcacgagacgtgattccgttcgcttcccggccagagtagggtgcg

SEQ ID NO: 46635 - protein, 95 aa, Zea mays
  misc_feature: Ceres CLONE 1452334-F
MSDAYRKAKPGRLVFKGGEAASIHKPKKHKKNKKPASDALADGDIEAAAAAAEGAEGGGGAGSGLGNNHPIRAGERKRKYQGTPPRGKSKKGSGD

SEQ ID NO: 46636 - DNA, 873 bp, Zea mays
  misc_feature: Ceres CLONE 1452335-F
  misc_feature: Encodes the peptide sequence at SEQ ID NO. 46637
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (668)..(668): n is a, c, t, g, unknown, or other
ncggttgctttcgggggcnncccctcctaccggtggaggcgcncttggcnnngcgcacannnccaaagctggagctccccgcggtggcggccgctctagaatagtggatcccccgggctgcaggaattcgcacgagaccattacctagaacatcctaatcgaaaaaaaaatctggcagaagccgaaccgtagagcccgagcctcgcggtcgaggatccgtcctgcaaatctcctctcatacttctccaccggatccctgtaagattcccggagatgtcggacgaggagcaccagttcgagtccaaggccgacgccggcgcctccaagacctacccgcagcaggccggcaccatccgcaagaacggcttacatcgttcatcaagggaccgtcccctgcaaggtttgttgaaggtctcccactttcccaagaactggggaaaggcattgggcatggcccaaacggcccccttttggttggggcatctggacttttttgtgccctgggaaaaacaacaccctgggagagaatattgggtttcctctcctttttaagccaaagagtgggggaagggtgtgcccccacaggtgtggaacctgcccccccgtaaaacaatattctagtggtggatgggggcgaggccacccccacaacaaaagggggttgtttngtggggacggtctttgcgaagccaaaggagagccccccccccccccccaggggagaccacccccccgcgtttgttgccccccaatgggaataaaaatttttcggagggaggcggcgccgccacctcaacgaggcgagcacttatctatttatatgtgtggcaaaataggtgataattttctccctacctcacgggcccccccccc

SEQ ID NO: 46637 - protein, 92 aa, Zea mays
  misc_feature: Ceres CLONE 1452335-F
MSDEEHQFESKADAGASKTYPQQAGTIRKNGLHRSSRDRPLQGLLKVSHFPKNWGKALGMAQTAPFWLGHLDFFVPWEKQHPGREYWVSSPF

SEQ ID NO: 46638 - DNA, 741 bp, Zea mays
  misc_feature: Ceres CLONE 1452338-F
  misc_feature: Encodes the peptide sequence at SEQ ID NO. 46639
  misc_feature (372)..(372): n is a, c, t, g, unknown, or other
tggagctccccgcggtggcggccgctctagaactagtggatcccccgggctgcaggaattcgcacgagaccattacctagaacatcctaatcgaaaaactgcaactctgcgagtgccagaaaaaaaatactgccacccaccaccgcgccgccgcgccatggcttccccatccccttcctcgcccctccacccgcaccagcacccacctcctccgaatgttcaccaccaattccaatccctaccgccttcgatgccgccaccgccgccgtcaacggcgctgccaaaggcgctcgaccttgaggttaccgtcgtctgcgggaagcacctgaagaatgtcaactggcgccgtggcgacctccgtgcctacgtcgnggtgtaccttgacccctcccgccgcgccgctacccgccccgacgacggcggcgggtgcaaaccaacctggaacgagcgcctcgtcctcccgcttccgccccacctctccccgtacgacccctccatcctcctgtccctcgacgttttccactctaagccctccgattcgcccaagccgctcgtcggatccgcccgctctcctctccgcgacctcctctttcccgcaaaccctaacctagccacgatcccccagcctccgctctcgtcagcctgccactcctccgcctttcggccgcccacaggggaagacccggatcgcgtcgccatccgcgagcgctcgcgccgccctcggagccccaataccctccg

SEQ ID NO: 46639 - protein, 194 aa, Zea mays
  misc_feature: Ceres CLONE 1452338-F
  misc_feature (47)..(137): Pfam Name: C2 Pfam Description: C2 domain
  misc_feature (72)..(72): Xaa is any aa, unknown, or other
MASPSPSSPLHPHQHPPPPNVHHQFQSLPPSMPPPPPSTALPKALDLEVTVVCGKHLKNVNWRRGDLRAYVXVYLDPSRRAATRPDDGGGCKPTWNERLVLPLPPHLSPYDPSILLSLDVFHSKPSDSPKPLVGSARSPLRDLLFPANPNLATIPQPPLSSACHSSAFRPPTGEDPDRVAIRERSRRPRSPNTL

SEQ ID NO: 46640 - DNA, 771 bp, Zea mays
  misc_feature: Ceres CLONE 1452343-F
  misc_feature: Encodes the peptide sequence at SEQ ID NO. 46641
  misc_feature (327)..(327): n is a, c, t, g, unknown, or other
tggagctccccgcggtggcggccgctctagaactagtggatcccccgggctgcaggaattcgcacgagaccattacctagaacatcctaatcgaaaaattaaaaaagggattatcttcattttgtagctttgaatcgcctctcagaaccgagatcctcaaaacccttctcccccctcccggatcgagtgcttgagctccgaccaaatctcgcagcggctgcaattccgagcccgaagagcggatcaggcgaggacgacgccttcgattctgatctgcggtcggcgcgacctagagagaaccggagatgcagcagggcgacggcacgnaggcgcaggtgacgtgggaggaccagcagaacatcaccggtttcggtcgcctcacaaccggcctcccgagctccaggaacccaacaagctcccgaaggaaacgaatggaaacctttgatgatgctgggaatggaatctttcttgtccgaagaaaaactttgacacctttccaaatgggggaaggtgtttgttcccctccaaggggattacattcaaaccagggtgggaaaaaaaaaaaaagggtgcggctaaaaaacttggaaggttttaaaggagaaaaaagaactcttctcgggcccaagggggcaaattaaaaaaaaaaccggtcggggaaatctaaggggcccctcccctcgggggaaagaaaaaccaagcggggggggggggggaaataaccccctcttttagagggggggggttttttttctccggcgccgcgcgccc

SEQ ID NO: 46641 - protein, 111 aa, Zea mays
  misc_feature: Ceres CLONE 1452343-F
  misc_feature (8)..(8): Xaa is any aa, unknown, or other
MQQGDGTXAQVTWEDQQNITGFGRLTTGLPSSRNPTSSRRKRMETFDDAGNGIFLVRRKTLTPFQMGEGVCSPPRGLHSNQGGKKKKRVRLKNLEGFKGEKRTLLGPKGAN

SEQ ID NO: 46642 - DNA, 897 bp, Zea mays
  misc_feature: Ceres CLONE 1452349-F
  misc_feature: Encodes the peptide sequence at SEQ ID NO. 46643
  misc_feature (35)..(35): n is a, c, t, g, unknown, or other
  misc_feature (461)..(461): n is a, c, t, g, unknown, or other
  misc_feature (530)..(530): n is a, c, t, g, unknown, or other
  misc_feature (897)..(897): n is a, c, t, g, unknown, or other
aggccccgaccccacacgacgaccacaaaaaaaanaaacacaaaaaaactggcgctccccgcggtggcggccgctctatactagtggatcccccgggctgcaggaattcgcacgagaccattacctagaacatcctaatcgaaaaaaaacaaatcctcatcgctccgtctatggcgactctaaccatgcaaccaatcggtcccacccctgctccggctgcgcagcaagacccaagcaagggagagaatcctcctaccgtggatggtaccgatctgggtgacatcgactcgggctgggtgatgctcaacaacgcggatgtcacttccgcgtatttggcagccgccgccgtctgtggcgggcatcgtctacgctcgcctacgatcccatagctaggtacgtggggtttttgtgtggggtgtctcacacgaatctgggtgttactacgagtgtagttaaaccanccttgtcccccaaacaaaagggtatttgtgtgtagaatgctgtgtcaggctcgcccacccttctacccnaaaagtaaccagaacaaattttacttgcgaaatgtggctacgtgcgtctttccttggtatatggtgtttcttggcccagtggcacgggctagtagtgcttgaactacctttgccttcaggctacgggatggaagtacacggtcacaaatgtttggagcgatgccttagggaaagcatccgatctaaggtcatctctattcaggatttgcatgccgttctggtggaagccctggctctttctcttattgctcgtcaggcgggtatgttctattccgaaattaccaaactgtcggtacagatggggttgtggaaccgcgagcatagcggcttttgtgttgcttgggtaggagcgggtcgttccttcttn

SEQ ID NO: 46643 - protein, 72 aa, Zea mays
  misc_feature: Ceres CLONE 1452349-F
MATLTMQPIGPTPAPAAQQDPSKGENPPTVDGTDLGDIDSGWVMLNNADVTSAYLAAAAVCGGHRLRSPTIP

SEQ ID NO: 46644 - DNA, 750 bp, Zea mays
  misc_feature: Ceres CLONE 1452350-F
  misc_feature (48)..(48): n is a, c, t, g, unknown, or other
  misc_feature (747)..(747): n is a, c, t, g, unknown, or other
ctggagctccccgcggtggcggccgctctagaactagtggatcccccngggctgcaggaattcgcacgagaccattacctagaacatcctaatcgaaaatagagagtgtatgttgcattagaaagtctgcaaatctctgtatgttcttgcatggcactgaagctgcatgcttcagtttcttcacatgaggctgcttttgagcaccttatgtgccggaaagttccagaggtagaatatatactcaagggacagcatcaaagaagtcaactgttaagttttctttttgggttgggagaagattcattttgggatgaaaataattcctttgcagagtttacatacaatttggactggaaaatttagcagtctaaccagatacatctggatagatactgtaaaagagatacagttggatcaatggacattcttttttttagatttaggaaatgcaaattgtgagctcaactgtgcagggccagtggtgttggattcttttagtaatatcttgttttataccggcgaagaaggctctgcctccctcgtataagtagctcctttgtgcttattcgtacactatgaattcagttggatttcatacactatggcatccttcttttcagaggaaaatgcatgtaggtagatccagatctggtcggcaggttttcatgtgtttcgtttttcatgtgccgtctgcaatgcatgcgtgcttcatcatgatctacacatatattacgtgtgaatggaagnaga

SEQ ID NO: 46645 - DNA, 716 bp, Zea mays
  misc_feature: Ceres CLONE 1452357-F
  misc_feature: Encodes the peptide sequence at SEQ ID NO. 46646
  misc_feature (367)..(367): n is a, c, t, g, unknown, or other
  misc_feature (368)..(368): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (384)..(384): n is a, c, t, g, unknown, or other
  misc_feature (385)..(385): n is a, c, t, g, unknown, or other
  misc_feature (388)..(388): n is a, c, t, g, unknown, or other
ggatcccccgggctgcaggaattcgcacgagaccattacctagaacatcctaatcgaaaagtttacggactgccaaaagaaagatggcttctggattaaacttaatgtcaaccagactagcttctatagggtgagctatgatgaggaacttgcagcccgacttcgatatgcaattgaaaccaacaaactgggtgcagcagacagatatggcgtacttgatgatgcctatgccctctgtatggctggcaaacaaaagctagtctccttgctgcatttgatttctgtgcacaaggatgagactgagtatactgtgcttgcactcttaattagaacaagtctgcacattgccgagatgatggttattgcnnccctgtctcannnggnncanctgaagaagttcctaattgatttcctggacccatttgccctgaaacttggctgggatgctaaaagtgacgagggccatctgaacgctttgttaagaagtacactcttaaccgctcttgcacaacttgtccatgaggctaccataaaatgaagctgttcgccgatttaatggtctttcctggaagaacgagagacaccacctcctccctccctatggtccaaaaggcgacctaatgttggttttgatgtagactggggaggcaaatccaacaaaactgggctatgaattccctccctgaagaatttttttgggcaaaccctatttttta

SEQ ID NO: 46646 - protein, 99 aa, Zea mays
  misc_feature: Ceres CLONE 1452357-F
  misc_feature (44)..(44): Xaa is any aa, unknown, or other
  misc_feature (47)..(47): Xaa is any aa, unknown, or other
  misc_feature (48)..(48): Xaa is any aa, unknown, or other
  misc_feature (49)..(49): Xaa is any aa, unknown, or other
  misc_feature (50)..(50): Xaa is any aa, unknown, or other
MAGKQKLVSLLHLISVHKDETEYTVLALLIRTSLHIAEMMVIAXLSXXXXLKKFLIDFLDPFALKLGWDAKSDEGHLNALLRSTLLTALAQLVHEATIK

SEQ ID NO: 46647 - DNA, 757 bp, Zea mays
  misc_feature: Ceres CLONE 1452358-F
  misc_feature: Encodes the peptide sequence at SEQ ID NO. 46648
ctggagctccccgcggtggcggccgctctagaactagtggatcccccgggctgcaggaattcgcacgagaccattacctagaacatcctaatcgaaaaagttctaatgacagctgtgacgtgacgtgagtgacttgagcagatccgactccgagcgagaggcgggtaccaaccgcatccctagtacagatcgagtgtcccgtagccactccacgtctccacgctccacggtcacactcggaacctcagctcagaggatcggaagaacggacggcgagatggcaagcggggaagaaggcaagggcgagacggtgctggtcaccggggccagcggcttcatcggctcgaccctcgtccgcggcctcctcggccgcggctacaaagtccgcgccggcgtcatcgaccccgacgacagggcggagacggaccacctccacgcgctcgccgccggcgccggccgcctcagcttcttccgctgcgacctcctggacggcgccgcgctgctcgacgcagcaagggggtgctcgggcgtcttccacctcgcgtcaccctgcaccgtcgaccccgtcaaggacccccagaatcagctgatggtgcctgcggtggaagggacgctgaacgtggtgcgcgcggccaaggacgccggcggagtgcggcgggtggtcgtgacctcctccatctcggccgtcgtgcccaaccccgggtggcccgccggcgaggtcgtcgacgagcgttgctggaccgacatcgactactgc

SEQ ID NO: 46648 - protein, 160 aa, Zea mays
  misc_feature: Ceres CLONE 1452358-F
  misc_feature (10)..(149): Pfam Name: adh_short Pfam Description: short chain dehydrogenase
  misc_feature: SWISSPROT Homolog: EC 1.1.1.219 Dihydrokaempferol 4-reductase
MASGEEGKGETVLVTGASGFIGSTLVRGLLGRGYKVRAGVIDPDDRAETDHLHALAAGAGRLSFFRCDLLDGAALLDAARGCSGVFHLASPCTVDPVKDPQNQLMVPAVEGTLNVVRAAKDAGGVRRVVVTSSISAVVPNPGWPAGEVVDERCWTDIDYC

SEQ ID NO: 46649 - DNA, 759 bp, Zea mays
  misc_feature: Ceres CLONE 1452359-F
  misc_feature: Encodes the peptide sequence at SEQ ID NO. 46650
tggagctccccgcggtggcggccgctctagaactagtggatcccccgggctgcaggaattcgcacgagaccattacctagaacatcctaatcgaaaaactaaaaacatcatgggcctcgaactgtccgtctcggaaagggctctcagccatgggaagcccaacgagaactcgggcctaatccgctcacgcacctttctccgtcttcacgaacgaatcacgatcacgggtgccacaactccctgccgatccagtcccccggcaaattcccaaccgccgcacagcaacaccagcggtcggatcgggggagaaacggaagggcaacagcagagcgcgaattcctcagacaaatccaaggtttcgagcacagacacaggcgaaactcgatggcggaggggtccaagccggacgtgccgctgttccagctcctcagcgatcttctccagcaggtggagtcaatgagcaatcaggaagaagtagagctgcgcgctaagattgaagcattaggattagaagtcactaaggtaccagagcagcccgctaatcatctcagcgagctagaaatagctgcagagttggacaagctgtcatcgcggcttgataacgtcgacaagatgatatcatctgccatggcctcagatccagaggtgaagtctcttctgagcagcacatctgatatctggatgccggtcataacagcgtctgccaatgagaagcgggggtttgttgggacgagcagcgaaggcagccaggaagagcag

SEQ ID NO: 46650 - protein, 125 aa, Zea mays
  misc_feature: Ceres CLONE 1452359-F
MAEGSKPDVPLFQLLSDLLQQVESMSNQEEVELRAKIEALGLEVTKVPEQPANHLSELEIAAELDKLSSRLDNVDKMISSAMASDPEVKSLLSSTSDIWMPVITASANEKRGFVGTSSEGSQEEQ

SEQ ID NO: 46651 - DNA, 761 bp, Zea mays
  misc_feature: Ceres CLONE 1452363-F
  misc_feature: Encodes the peptide sequence at SEQ ID NO. 46652
  misc_feature (365)..(365): n is a, c, t, g, unknown, or other
  misc_feature (366)..(366): n is a, c, t, g, unknown, or other
  misc_feature (429)..(429): n is a, c, t, g, unknown, or other
  misc_feature (438)..(438): n is a, c, t, g, unknown, or other
  misc_feature (472)..(472): n is a, c, t, g, unknown, or other
  misc_feature (475)..(475): n is a, c, t, g, unknown, or other
  misc_feature (544)..(544): n is a, c, t, g, unknown, or other
  misc_feature (547)..(547): n is a, c, t, g, unknown, or other
ccccgcggtggcggccgctctagaactagtggatcccccgggctgcaggaattcgcacgagaccattacctagaacatcctaatcgaaaaaccaccacaaccagtcctcacataatcatcttcattcactcactctcttcgatcactgtactgaagataccatggccaagtcgaccgcgatgtttgtagccgccctggccctggtggtggtgatggcgacgacgagcacaggcggtggcagggcggcagcggcgtgcgatcccaagccgctggtggtgtgcgatccggcgttcatggacggagcgaaacccgcggcagcatgctgctccaccctgcgtgcgcaggaggcatgcttgtgcgtgtannccaaagaccccaagtttgcaaaatacatcaacaacccgaacattcccaaaacctttacctcgngcggcatanccatccccaaatgctaagcaagcgctctgcgtcntcncttcgcttgctcttgctcttgtgtgtaacatatccagcttatgaataaattatgtggatcagttaaccncgnaccggacaaaaaaaaaaaaaaaagctttatcaataccgtctacctccgagggggggccccggaacccatttcgcccctatagggagtccctattacgcgcggctcactggccgacgttttataaaacatcctgaactggaaaaaaccctgtgggttaccacaacttaataccgccttgcacacccatcccccctttcgcccaggttggcataaa

SEQ ID NO: 46652 - protein, 97 aa, Zea mays
  misc_feature: Ceres CLONE 1452363-F
  misc_feature (68)..(68): Xaa is any aa, unknown, or other
  misc_feature (69)..(69): Xaa is any aa, unknown, or other
  misc_feature (90)..(90): Xaa is any aa, unknown, or other
  misc_feature (93)..(93): Xaa is any aa, unknown, or other
MAKSTAMFVAALALVVVMATTSTGGGRAAAACDPKPLVVCDPAFMDGAKPAAACCSTLRAQEACLCVXXKDPKFAKYINNPNIPKTFTSXGIXIPKC

SEQ ID NO: 46653 - DNA, 798 bp, Zea mays
  misc_feature: Ceres CLONE 1452366-F
  misc_feature: Encodes the peptide sequence at SEQ ID NO. 46654
aagctggagctccccgcggtggcggccgctctagaactagtggatcccccgggctgcaggaattcgcacgagaccattacctagaacatcctaatcgaaaaccttacagatcaagaagcatttcaaggacatcggtgttcccgctgatctaaaatacattgatccaacatatatggttcgggcctgccgggcaaatgcatctgatgctattctctgcaccgtacttgggcaaaatgctgtccatggagcatttgctgggttcagtggcatcacgtcaggtgtttgcaacacacattatgtctaccttcccatcacagaggtcattacaacaccaaagcacgtcaaccccaacagcagaatgtggcaccgctgcctcacatccactggccagctagacttccattgactacttcactaacacctgagagcaaggcgcccagagaataatttaggcctgtttggtttgatgcctaacttgcacactttgccctactttttgggctaagggtagttatccaatccgaacgactacctttaaggcaagggaaggcaatttagctacaaaccaaaaagccccttatccccaaagggactgctaacaggaacactgaaaaaacccgggcttacccaaattttggtaagggtggagaactcctaaaggaaattgccaggacccccccctgggctcccaaaagtttgaaacgggcaccccccttttctttgggttgcccccccccggggaaaaaaaaggttaaagtttttttgtgcggccaaaccttcccccaaaataaaaaaaaa

SEQ ID NO: 46654 - protein, 77 aa, Zea mays
  misc_feature: Ceres CLONE 1452366-F
MVRACRANASDAILCTVLGQNAVHGAFAGFSGITSGVCNTHYVYLPITEVITTPKHVNPNSRMWHRCLTSTGQLDFH

SEQ ID NO: 46655 - DNA, 554 bp, Zea mays
  misc_feature: Ceres CLONE 1452369-F
ctggagctccccgcggtggcggccgctctagaactagtggatcccccgggctgcaggaattcgcacgagaccattacctagaacatcctaatcgaaaagcggattttgctagggtttgcggtttctgcttcacactgcctcctcagtcctcaccaccacagccgtcgcgcgcaggagggtagggaggatgccacgtaagaatcactttgggtcagggaggggggaaccgccaacccgggtgggaccccttgccccaggggggaaccccccttccgggacccggggggacccaagggcccgtttttaacgaagggggagggggggaaaaaatttccccccggggccctctgggggccccccccttttttaaaaaaaaaaaaaaatttttttcccccccctttcccccgggggggggggaaaaaaaaaaccccccccccaatttttttcttccccccccacaaaaaaaaaaaaaaggggggcccccccccccccccccccccccctttccccctttttctttcctccaaaaaaaaagagaggaagcccgccccccc

SEQ ID NO: 46656 - DNA, 762 bp, Zea mays
  misc_feature: Ceres CLONE 1452373-F
ctccccgcggtggcggccgctctagaactagtggatcccccgggctgcaggaattcgcacgagaccattacctagaacatcctaatcgaaaattgtttcgagctctcctcccctcttcctaccattagcagtagccacaggcagaacaccagcagacagcagcatcactagggaggaacacgatgagcggcgccggggcggatctgcaactgccaccgggggtccggttctaccctacggacaaggagctggtgatgtagtacctctgccgccgctgcgccggcctgcacatcgccgtccccatcatcgctaagattgacctatacatatacaacccatggcagctcctgaagatggttttgtaacgccacaaggagtgtacttcttctgccagcgggaccacaagtctcgagcggggcaagacacaacccctcccccaggcctagctactgcaaggactgcggggtctacacgcctaggggatcctccaagggcgtagctcttaagacgcccctcctttatatcacccccaggcacccaatggaaattaaaccctttgaatattgctctaaaacagcttgggccacaatgattcgatccgacgcaaaaaaaaactactccccccctgaaggattgatgttggttgccgcaatttaaaaaatgtaccttcatttagcaaaaagaagagccgtaggacctcccttgatcgcggtgtacaaactaccttctatttctgcggggagggggggagaacccgctccc

SEQ ID NO: 46657 - DNA, 799 bp, Zea mays
  misc_feature: Ceres CLONE 1452378-F
  misc_feature (799)..(799): n is a, c, t, g, unknown, or other
aaactggagctccccgcggtggcggccgctctagaactagtggatcccccgggctgcaggaattcgcacgagaccattacctagaacatcctaatcgaaaaacttcacaccgacgtcaccctctcctccagaactcatcaccggagccaccctcacctcgtcacgccctcctccgctaagtgcagcaagtgttgatcagtccagttagcacactctccttcaaatctagagtcacttcttcaaagtgggtgggagggagatggtgctgaggcgggcggcaaccgaatgtcctaagaaggttgtggggctgaaggatttggtgaacctgccgacccagctgtgagagttcaccggaggccggtccaaaatgtcacatatctccttcctccgtgtctgctcgtacatcaaggacaaacaacttcaggacccaacaaataataacattctgaagtgtgatgagaagctgacgaccatattattgggcaggtccaaagggacaccgtctgaactcccaatgattggtcattggcttggcggtttgcccattgttttcccccctttggggccagcttcccaaaaaaaccttcaacttttggatctcattcttccgcgaagaaatccggcctcttgccccacaaaattttttttttcccttatccttggcgaaattccacatggttggtggggcatggtgttttggcacaggagaaacccctcaaggaatggtccacttggcctcgcagaaatttcccaaactccctttttggagctctagaggacaaacacaaaaaaaagcttn

SEQ ID NO: 46658 - DNA, 735 bp, Zea mays
  misc_feature: Ceres CLONE 1452379-F
  misc_feature: Encodes the peptide sequence at SEQ ID NO. 46659
gccggaattcgcacgagaccattacctacaacatcctaatcgaaaaacagttccacgccgccactccccccaacccgaccacgctgcgcctccgcttgacccccagccgagggaggaatgggtaagggtacgggcagcttcggcaagcgccggaacaagacgcacacgctctgcatccgctgcggccgccgcagcttccacctccagaagagtacctgctcctcctgcggttaccccgccgcccgcatccgcaagtataactggagtgtgaaggccatcaggcgcaagacaaccggtaccggaaggatgaggtacatgcgccacgtgcctcgccgtttcaagagcaacttgagagaagccactcaggctgctcccaaaaagagggctcccgctgccaactaagtccgcatgctgctatcaagaacctgaaaagctacaacatcggaaacttttggctgaagttgtacttcctcaacttttttaccccaaacactctggaaagacctgcccctccggcgtctttgaattgaaagcaccaccccccggggggtttgaagttttcacaaaaaacaaaaaaaacaagcttatccaaaccctctcaactcaaaggggggggccggggaccccttatttcggccttacagggaggtccctattaccctcctcctagggcgccctcgatttataaactgtctggcgagctggcacaaccccccggggagccggacttttttg

SEQ ID NO: 46659 - protein, 94 aa, Zea mays
  misc_feature: Ceres CLONE 1452379-F
  misc_feature (2)..(55): Pfam Name: Ribosomal_L37e Pfam Description: Ribosomal protein L37e
MGKGTGSFGKRRNKTHTLCIRCGRRSFHLQKSTCSSCGYPAARIRKYNWSVKAIRRKTTGTGRMRYMRHVPRRFKSNLREATQAAPKKRAPAAN

SEQ ID NO: 46660 - DNA, 761 bp, Zea mays
  misc_feature: Ceres CLONE 1452381-F
  misc_feature: Translation starting site: 379
  misc_feature: Pfam Name: LigB Pfam Description: Catalytic LigB subunit of aromatic ring-opening dioxygenase
  misc_feature (646)..(646): n is a, c, t, g, unknown, or other
  misc_feature (659)..(659): n is a, c, t, g, unknown, or other
  misc_feature (683)..(683): n is a, c, t, g, unknown, or other
ctggagctccccgcggtggcggccgctctagaactagtggatcccccgggctgcaggaattcgcacgagaccattacctagaacatcctaatcgaaaaaatgtttttgaggcgcccatccaagcatcccatccattctctttctctctcgctgctctgctccccacggaccacggggcaccaccacaaaccagacgcgacgcacgcgcgcaaaatcatccggcggagccagggcggaggcaaaccagagacgcggcacgcgacgcgtgaggacgaggagcagcggcagcgcgggcgcggcgacaccgcgaggacagagcgagacgcaacggccgccgaggaggggcagaggcgagcgccgcctagagtccctgctaccatggacactttcttcctgtcgcacggctcgcccacgctctccatcgacgacaacatcccggcgcggcacttcttcaagtcatgggtgccggcgaaggtcgcgggcgaccagcccccgcgcgccatcctcgtcgtgtcgggacactgggacacggccacgccggaggtcaacgtcatccgcggcagcaacgacaccatttacgacttctatggctttcccagcccatgtacaagctcaagtaccccgctccggggcgcccggacctggncctggcgacaaanggctcctggaagcagccgggttcngccccgtgaaagaggacacagccgcgggctggaccacgccgctgggtgccgctgatgctcatgtacccggacgccgac

SEQ ID NO: 46661 - DNA, 744 bp, Zea mays
  misc_feature: Ceres CLONE 1452382-F
  misc_feature: Encodes the peptide sequence at SEQ ID NO. 46662
  misc_feature (565)..(565): n is a, c, t, g, unknown, or other
  misc_feature (744)..(744): n is a, c, t, g, unknown, or other
ggagctccccgcggtggcggccgctctagaactagtggatcccccgggctgcaggaattcgcacgagaccattacctagaacatcctaatcgaaaaaggctcccctcctcgcccgcccccgtacgtgtccatctctccactcctttcctttccttgttggtaagagcaaggcgagacgtaacgtaatccggccatggcgttcttccggggcctcaccgcggtctcgagactgcgatcccgcatggcgcaggaggccaccacgctgggtggtgtgagatggctgcagatgcagagcgcgtccgacctcgatcttaagtcccagctgcgggaactgattccggaacagcaggaccgcttaaagaagcttaaatcagagcatgggaaggttcagcttggaaacataactgtggatatggtccttggtggaatgagagggatcattggaatgctttgggagacatccctagtcgacccagaggagggtattcgttttaggggcctctcaattccagagtgccgaaaagtgctgccaacagcagttgagggtggtgaacttttgcctganggtctcctctggcttcttttgacaggaaggtccccaacaaagatcagttgatgctctatcaaaaaaatgcttgcgcgctcaactggtccagttcatggctataagggaatagaagctctcccaggtacttgccattctatgacccaatttaccggaggaatatggctctttcaggtgan

SEQ ID NO: 46662 - protein, 140 aa, Zea mays
  misc_feature: Ceres CLONE 1452382-F
  misc_feature: SWISSPROT Homolog: EC 2.3.3.1 Citrate (Si)-synthase
  misc_feature (124)..(124): Xaa is any aa, unknown, or other
MAFFRGLTAVSRLRSRMAQEATTLGGVRWLQMQSASDLDLKSQLRELIPEQQDRLKKLKSEHGKVQLGNITVDMVLGGMRGIIGMLWETSLVDPEEGIRFRGLSIPECRKVLPTAVEGGELLPXGLLWLLLTGRSPTKIS

SEQ ID NO: 46663 - DNA, 755 bp, Zea mays
  misc_feature: Ceres CLONE 1452389-F
  misc_feature: Encodes the peptide sequence at SEQ ID NO. 46664
  misc_feature (301)..(301): n is a, c, t, g, unknown, or other
  misc_feature (382)..(382): n is a, c, t, g, unknown, or other
  misc_feature (385)..(385): n is a, c, t, g, unknown, or other
aagctggagctccccgcggtggcggccgctctagatctagtggatcccccgggctgcaggaattcgcacgagaccattacctagaacatcctaatcgaaaagagaagcgggttgtgtcggtgccgctggccgagtgcggggaccggcccagaggggccagcggggaggggccgccgccgtcggactcgtgggcgtggcgcaagtatgggcagaagcccatcaagggctccccctacccacggggttactaccgctgcagcagctccaaggcgtgcccagcgaggaagcaggtggagcgcanccacgcggaccctaccgcgctgctcgtcacctacaccttcgagcacaatcacgaggcggcgcagcccaagactagtggtgncanctgctcgcaccagcaaaggaagccgtccgcgccgccgccggcgccgaaacctgaaccgtccgtggtcctggtccagcgggatgagctcggcccggagcacgagctggtagaaacgaggtgccggagcaggaacaggagacggatccagaaaaggaccccgacctggggaagagaggcctcccctgtcctgtccggtccggaaaggggcaccacctttaacgggggcccccgccgcccgaggaagaccaaaagcttccaacttgggttggtccaaccaagaaccaaaagtgggacccgggcgggccctttaaccccctctttgctgcccccgggagagaatgggaacccggaacttttctgggggaagacc

SEQ ID NO: 46664 - protein, 251 aa, Zea mays
  misc_feature: Ceres CLONE 1452389-F
  misc_feature (59)..(119): Pfam Name: WRKY Pfam Description: WRKY DNA -binding domain
  misc_feature (100)..(100): Xaa is any aa, unknown, or other
  misc_feature (127)..(127): Xaa is any aa, unknown, or other
  misc_feature (128)..(128): Xaa is any aa, unknown, or other
AGAPRGGGRSRSSGSPGLQEFARDHYLEHPNRKEKRVVSVPLAECGDRPRGASGEGPPPSDSWAWRKYGQKPIKGSPYPRGYYRCSSSKACPARKQVERXHADPTALLVTYTFEHNHEAAQPKTSGXXCSHQQRKPSAPPPAPKPEPSVVLVQRDELGPEHELVETRCRSRNRRRIQKRTPTWGREASPVLSGPERGTTFNGGPRRPRKTKSFQLGLVQPRTKSGTRAGPLTPSLLPPGENGNPELFWGKT

SEQ ID NO: 46665 - DNA, 739 bp, Zea mays
  misc_feature: Ceres CLONE 1452393-F
  misc_feature: Translation starting site: 138
  misc_feature (368)..(368): n is a, c, t, g, unknown, or other
  misc_feature (417)..(417): n is a, c, t, g, unknown, or other
ccccgcggtggcggccgctctataactagtggatcccccgggctgcaggaattcgcacgagaccattacctagaacatcctaatcgaaaagagaagggtcttcacgacttgttttttgggcggacgctgttgcagatatgcagaggctgggggatttcaggctcgctcccttcttcaaagaccctccttacttcactttgcagcctatgcgtgaaacacgggaaaagcgattacggctatggagaaataagatactcgattactgtaaaacccaaaagatacataccatatccctggaagaagatttccccatgttctccaatccaaagattgagagatctcttacctatgacggaaaggagaggggncccagcagctctcgccagagaatgtcgtgctgagcccacccaccaacgncacaagaagtgcctagttttttggctaaggatacaggattgggccaatctcatattaaactttgtaaaggataaggggtcggaagtattgtgtattgaataaatcccctctggaattgaaacacgggaaactgaactgaaggaaactatcggggggtttccttgcgggagatgcgctcctcaaacccaaaggtaaagcaggttagcttgaagggacctccgccgatgaggagggcgtaaaaatttcgtatcgatccttttggaacccccgaactgggaggccaaaaatcttggagcaggcggagcactttaaaaggggtggg

SEQ ID NO: 46666 - DNA, 793 bp, Zea mays
  misc_feature: Ceres CLONE 1452394-F
  misc_feature: Encodes the peptide sequence at SEQ ID NO. 46667
  misc_feature (408)..(408): n is a, c, t, g, unknown, or other
  misc_feature (410)..(410): n is a, c, t, g, unknown, or other
  misc_feature (411)..(411): n is a, c, t, g, unknown, or other
  misc_feature (427)..(427): n is a, c, t, g, unknown, or other
  misc_feature (481)..(481): n is a, c, t, g, unknown, or other
  misc_feature (498)..(498): n is a, c, t, g, unknown, or other
  misc_feature (591)..(591): n is a, c, t, g, unknown, or other
ggagctccccgcggtggcggccgctctagaactagtggatcccccgggctgcaggaattcgcacgagaccattacctagaacatcctaatcgaaaaaattttctaggatgaatagattcaaaagaagggctctaagggtcattgctgatcatttgtctgctgaggaagttgaggatataaaggatatgttcaagactatggatactgacaatgatggaattgtatcttatgaagaactgaagactggaatagcaaaacttggttctcatcttgcggaatcagaagtacagatgctcattgaagctgtggacacaaacgggaggggggcactagactacggggaatttctggccgtctcgctccacctgcagaagatggcgaacgacgagcatctccggcgggcttccntnngtctcgacaggacggncacgggttcatcgagcccgaaggagcttccaaaagctctggtgaaccaacgggncgccccaccgcatgganggaaggggtgaacgaacttctgcaagaattccaacccgaacaggacggccagatcacctccaaggaatttgggggccaaaaaaaaaaacccgncccgactggaaaaaagggtcccccggccctccccagaggggagaggtcacagccccccccttaaaatttaaaaaggaacgggccgaaaaactgggggttcaagagaaaccccccccaccccctggaagtgtgggggggggggggggccccaaatttttttacccccggggcccaaaaaaaaaaacccgcccccttttttttt

SEQ ID NO: 46667 - protein, 133 aa, Zea mays
  misc_feature: Ceres CLONE 1452394-F
  misc_feature (23)..(51): Pfam Name: efhand Pfam Description: EF hand
  misc_feature: SWISSPROT Homolog: EC 2.7.11.1 Non-specific serine/threonine protein kinase
  misc_feature (101)..(101): Xaa is any aa, unknown, or other
  misc_feature (102)..(102): Xaa is any aa, unknown, or other
  misc_feature (107)..(107): Xaa is any aa, unknown, or other
  misc_feature (125)..(125): Xaa is any aa, unknown, or other
  misc_feature (131)..(131): Xaa is any aa, unknown, or other
MNRFKRRALRVIADHLSAEEVEDIKDMFKTMDTDNDGIVSYEELKTGIAKLGSHLAESEVQMLIEAVDTNGRGALDYGEFLAVSLHLQKMANDEHLRRASXXLDRTXTGSSSPKELPKALVNQRXAPPHGXKG

SEQ ID NO: 46668 - DNA, 751 bp, Zea mays
  misc_feature: Ceres CLONE 1452395-F
  misc_feature: Encodes the peptide sequence at SEQ ID NO. 46669
  misc_feature (415)..(415): n is a, c, t, g, unknown, or other
ggagctccccgcggtggcggccgctctagaactagtggatcccccgggctgcaggaattcgcacgagaccattacctagaacatcctaatcgaaaaaggagaccttgcagaggagcgaagcaagcaaggtgggaaagaggcagcagcaagggcggcgggctgccggaaggggaacatgctccctcctcatctcacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagtataataatgaccattcaggcaaccttgatgggtactcgaacacccacnaaaacaaaatgatgtcagcgttatccctgggcaatccggaaacagcttacgcacataatccgaagcctgaccgtactcagtccttcgccatatcatacccatatgccgaaccatactaccgtggcgcgggggaaacaagtttatggcccgcatgatatcatgccccctcagctgggttggaatggttccgtcctctcaagggccactggcgaccaagccccccgcttgaaaaacccatcttatgtccacgcgagagacaaaccccccttattcccccgagaggagaaacagctccgggcaaaacgtaaagggggaaaaaacaaccctcgtgaaaaa

SEQ ID NO: 46669 - protein, 111 aa, Zea mays
  misc_feature: Ceres CLONE 1452395-F
  misc_feature (61)..(61): Xaa is any aa, unknown, or other
MRQNGAVMIQFGHQMPDYDSPATQSTSETSHQEASGMSEGSLNEYNNDHSGNLDGYSNTHXNKMMSALSLGNPETAYAHNPKPDRTQSFAISYPYAEPYYRGAGETSLWPA

SEQ ID NO: 46670 - DNA, 744 bp, Zea mays
  misc_feature: Ceres CLONE 1452402-F
  misc_feature: Encodes the peptide sequence at SEQ ID NO. 46671
  misc_feature (301)..(301): n is a, c, t, g, unknown, or other
  misc_feature (326)..(326): n is a, c, t, g, unknown, or other
  misc_feature (345)..(345): n is a, c, t, g, unknown, or other
  misc_feature (347)..(347): n is a, c, t, g, unknown, or other
tggagctccccgcggtggcggccgctctagaactagtggatcccccgggctgcaggaattcgcacgagaccattacctagaacatcctaatcgaaaagtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcngaagaagaaagatgaagaaaaagcnctgaaggagcttaaggccnangcacagaagggcgcgattgggggctcgggtctgaagaaaagtggaaagaaatgagactggccacccgtctccaatacctagaggatgataaggcagctgtctatctgggttgcccttccctaagggggattgaaacagggtaccttcttgggttctgggttccccaattttccatttggtggcttaaccaaaaaattttcaacctccccttgggtaattataaacaaagggcccccggaaaaaaagaaaaaatttcttggaaaaaaaaaaaaaaaaaattttttcttcccccccccccgggggggggggcccgcacccattccccccttaaggagattaaatccccgcccccggggcgcttttttaaccggggggagggaaaacccgtgggtccccc

SEQ ID NO: 46671 - protein, 62 aa, Zea mays
  misc_feature: Ceres CLONE 1452402-F
  misc_feature (1)..(62): Pfam Name: TMA7 Pfam Description: Translation machinery associated TMA7
  misc_feature (30)..(30): Xaa is any aa, unknown, or other
  misc_feature (45)..(45): Xaa is any aa, unknown, or other
MSKQGGKAKPLKAPKADKKEYDETDLAYLXKKKDEEKALKELKAXAQKGAIGGSGLKKSGKK

SEQ ID NO: 46672 - DNA, 762 bp, Zea mays
  misc_feature: Ceres CLONE 1452405-F
  misc_feature: Encodes the peptide sequence at SEQ ID NO. 46673
  misc_feature (379)..(379): n is a, c, t, g, unknown, or other
  misc_feature (380)..(380): n is a, c, t, g, unknown, or other
  misc_feature (395)..(395): n is a, c, t, g, unknown, or other
  misc_feature (398)..(398): n is a, c, t, g, unknown, or other
  misc_feature (403)..(403): n is a, c, t, g, unknown, or other
ctggagctcaccgcggtggcggccgctctagaactagtggatcccccgggctgcaggaattcgcacgagaccattacctagaacatcctaatcgaaaaatctccggtttcctcgtttcctttcctcttcgtcccagtgacgtcagtacgtcacccatcggcacccgcgccgctgacccccgccaccgtgtcacgatcccgtccccgctcgcacgcctagcgcgatggcgcacccgatgtacggctccggaccgctccgatccaggaacgcggcgagctcggacgaaatccagctgcggatcgacccggtgcacggggacctcgacgaagagatcgacgggctgcactccagggtccgtatgctcaaaggggtggcccanngagataattctgaangcnagttncagattgattttcttcatgaactgcaaatgaccctttgcaaagctacagctggagtgaaaaaacaactgcggaaaattgacaagaggctccttccgcgcgggttcaaaccagggttccttaggtgggcccctttggccggtttttgtctcttttttgccaaccccttggcaaaatttccttaaaaaaatattcctcttttttgggggcaaattcgagaacaccggggtttgtgtgggctcaaaaaaaaaaaaaaaaattttggtcctcttgccgggcctttaacccccccttttttgcaaaaaaaagaaaaaaaacaaaaaaaccccttaaagagaaaaaaaaaaaaaaaaattttttt

SEQ ID NO: 46673 - protein, 120 aa, Zea mays
  misc_feature: Ceres CLONE 1452405-F
  misc_feature (52)..(52): Xaa is any aa, unknown, or other
  misc_feature (53)..(53): Xaa is any aa, unknown, or other
  misc_feature (58)..(58): Xaa is any aa, unknown, or other
  misc_feature (59)..(59): Xaa is any aa, unknown, or other
  misc_feature (60)..(60): Xaa is any aa, unknown, or other
MAHPMYGSGPLRSRNAASSDEIQLRIDPVHGDLDEEIDGLHSRVRMLKGVAXXDNSEXXXQIDFLHELQMTLCKATAGVKKQLRKIDKRLLPRGFKPGFLRWAPLAGFCLFFANPLAKFP

SEQ ID NO: 46674 - DNA, 796 bp, Zea mays
  misc_feature: Ceres CLONE 1452421-F
  misc_feature: Encodes the peptide sequence at SEQ ID NO. 46675
tccccgcggtggcggccgctctagaactagtggatcccccgggctgcaggaattcgcacgagaccattacctagaacatcctaatcgaaaacttcccccacgcagtcaatcccggggcgtcgccgccgccgcctccgcgaaaaaccctagtaggcttctccgctatctctcctaggggcgcgaccgtggtgtccactaagaagacgacgagatccacggactacttcattaacaagctgcagcttggtatgaagagtggaaagtacactctcggctacaagaccgtcctcatgactctcagggactctgagtcgaagctaggtgatctcgctaacaactgcccggccccttggttagtttgaaatttaaaactaagcgtggcgggcaaaggccctgtccccccctttcttggaaacattgccacccttggaaactgccgggggaaaaatttttccgggtcggccgcctccaccttttttgaacctggtgttttttggatagcaaaaaaccccccccggtttggcccataaaacacccccgcctggggggggaatttttggggcgtttttccctttgggttgggtaaaaacctttttccccccgggaaaaaaggggtttattccgcaaacttcttcaaaatatttttttgtggggcgaggggtcacatactataaacacctttcttaatagagcgcgggtgagaaaaaaaaacaaaaaaaaaatatttttttttttttctacaccccgcgggggggcggccggttatttttttttttttgtagggaaaactattccc

SEQ ID NO: 46675 - protein, 37 aa, Zea mays
  misc_feature: Ceres CLONE 1452421-F
MKSGKYTLGYKTVLMTLRDSESKLGDLANNCPAPWLV

SEQ ID NO: 46676 - DNA, 751 bp, Zea mays
  misc_feature: Ceres CLONE 1452430-F
  misc_feature: Encodes the peptide sequence at SEQ ID NO. 46677
ggagctccccgcggtggcggccgctctagaactagtggatcccccgggctgcaggaattcgcacgagaccattacctagaacatcctaatccaaaagaagttagccatcagtacgcggacacgctccatcagcgtcaggccacagccaccatggtgaagctggcgacggcgcgcgagtgccgcgcatacagcctcggcgccggcgcgggatccggcacggggttgcgcaaccggtgagagtacatcaacgccggggagtacatcttcgcggcgaacctcctggtcggcggattcctggcgcagctcctgccgtggggcgggcccagcagcccggggctcgtggtcgccgcgatagggttcgtcggattgctggccctcaacacgcaagacctcctcgcgcacgccgccggcgtcaattaccgcctcgggatggtggtcgggcttgacgcgcaaatggggctcgtcgagctcggggtccccgccgtgcagatcgttggcaccgcgctcatgctcgtcgctgccgccttctttgggattcaaatggaaagagtttaccggcccaccctagccctggacgggcttgaacctggtccaaacccgggcccgcactggggtgcccgggggtctgtgaaaaaaatctgccaggttctaaaagcgttggcaggcgggaacatccagctcctggaaaaaaagagagccaaaccccgctgcatgcggggaaaaaaccacttttcctttatggcgggaatcc

SEQ ID NO: 46677 - protein, 107 aa, Zea mays
  misc_feature: Ceres CLONE 1452430-F
MVVGLDAQMGLVELGVPAVQIVGTALMLVAAAFFGIQMERVYRPTLALDGLEPGPNPGPHWGARGSVKKICQVLKALAGGNIQLLEKKRAKPRCMRGKNHFSFMAGI

SEQ ID NO: 46678 - DNA, 728 bp, Zea mays
  misc_feature: Ceres CLONE 1452431-F
  misc_feature: Encodes the peptide sequence at SEQ ID NO. 46679
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (369)..(369): n is a, c, t, g, unknown, or other
  misc_feature (370)..(370): n is a, c, t, g, unknown, or other
  misc_feature (375)..(375): n is a, c, t, g, unknown, or other
  misc_feature (377)..(377): n is a, c, t, g, unknown, or other
gggctgcaggaattcgcacgagaccattacctagaacatcctaatcgaaaaagaccacgccacgttcgcaattacagatatctacacagagagagagagagagggcagatctacgctagagcgacagagccacaactaaccgagagggacagtccagtatggtggtggcgctcgggcccggccggttctacggcagcggcctgccgaggccgcgcttcttcccgggcgaccgcgtggacccgccggcgtccgtcaccgacccgctgctcgagtgggcgcgcgaagcgcactgatccatgggcggtatcagcgtgaagnnnaaccacctgcagggccacatctaggggttccgtcaacacccccctgccnnccagngnacacgagaatgcagggtccaaggccaaggccaagggcccgcgcccgatggacaaatggccggcttcccttcggccgcgccttgggacccgaaaaacgaacccctccagcggggaacttccgaagaacaacccggaaggttggctggtttggtaaaaagtgcccttaaaacgtgaaccttttttcacccaccgacaaattaactccctacctgttcccgtgaagtccctaaggaggaaataagcccccttcgcggcttttttttcccccgcccccccaaagaaaaagcgcggcgcggaagaaattctttcctatataatatttttacccgccctttgtcgcgataagacctc

SEQ ID NO: 46679 - protein, 44 aa, Zea mays
  misc_feature: Ceres CLONE 1452431-F
MVVALGPGRFYGSGLPRPRFFPGDRVDPPASVTDPLLEWAREAH

SEQ ID NO: 46680 - DNA, 798 bp, Zea mays
  misc_feature: Ceres CLONE 1452433-F
  misc_feature: Encodes the peptide sequence at SEQ ID NO. 46681
acccgcggtggcggccgctctagaactagtggatcccccgggctgcaggaattcgcacgagaccattacctagaacatcctaacgaaaaaaaagccagatcggcacgacgagcagaggccccccccggagcggcgcggagcaatggcggcgggataccgggcggaggacgactacgactacctcttcaaggttgtactgatcggcgactccggcgtcggcaagtccaatctgctctcacgcttcacgcgcaacgagttcagccttgagtccaagtccaccatcggcgtcgagttcgccacccgctctctccaagtcgacggcaaggttgtcaaggcccaaatttgggaccctgccgggcaagaaacaaaatccgtgctattacaaagcgcgaataatcgaggggccaccgggggcgtttgcctggaaattgacgtcacactctcacttcaacctttgaaaaacccttaaccttttgccttaaagggttttgaaggcacccccccaaatcccccataatgttttttatgggggggttggccaaaaaatctaaatctccccccttcctttggaacgtttttaaatgggaaaagagaaaaactttctcccaaaggggggctcttttttttttttggggaaacctctgtggcctccgggcacaaaaaggttgaaaatggtctcctcgaagaggggtaactcccccccccccccttttgagcacaaacaccctttcacccgcgggaaaattcccctcccggcccggcgggggggggaaaattatatccaagagaaggtttttc

SEQ ID NO: 46681 - protein, 108 aa, Zea mays
  misc_feature: Ceres CLONE 1452433-F
  misc_feature (16)..(103): Pfam Name: Ras Pfam Description: Ras family
MAAGYRAEDDYDYLFKVVLIGDSGVGKSNLLSRFTRNEFSLESKSTIGVEFATRSLQVDGKVVKAQIWDPAGQETKSVLLQSANNRGATGGVCLEIDVTLSLQPLKNP

SEQ ID NO: 46682 - DNA, 742 bp, Zea mays
  misc_feature: Ceres CLONE 1452437-F
  misc_feature (363)..(363): n is a, c, t, g, unknown, or other
  misc_feature (367)..(367): n is a, c, t, g, unknown, or other
tccccgcggtggcggccgctctagaactagtggatcccccgggctgcaggaattcgcacgagaccattacctagaacatcctaatcgaaaaatacctttctcggccttttggctaagatcaagtgtagtatctgttcttatcagtttaatatctgatatgtggaccatgtgttcactttgatattaaatttattttttgtgggggagggctcgctacagtggcttgctactggggccctcaagcgtcgctcggccgttgcactataggctgagcctggcgcgccccaaccaatgcaatttcagctttaagtatgtctttagactatacgaaatgtatggttccatatcaataaatttggtcgnaagnaatgaagaagctaatatcgcccatatttagtcatcaagcaccatgccggtctagcagcatgtccctgtgctgccccggacctggtggaagccgctctcggcacgagcaggagagaccccgccggttcaggtacagggcaacgaacaaccccttggacgcctatgaccggttcgggaagaaacccataacatctgaaacctttcctctactgtaaaataaacccttatcagctaaaattcctttgaatcgcctaataaagtactggtggaaaaatccctaccaataaaaatccttgaagttataatgggggaggcccaactgtcccggccaaataaaacaacagctaaattgcaccaagtttttctccaaaccctt

SEQ ID NO: 46683 - DNA, 750 bp, Zea mays
  misc_feature: Ceres CLONE 1452440-F
  misc_feature (395)..(395): n is a, c, t, g, unknown, or other
  misc_feature (396)..(396): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (409)..(409): n is a, c, t, g, unknown, or other
  misc_feature (410)..(410): n is a, c, t, g, unknown, or other
  misc_feature (426)..(426): n is a, c, t, g, unknown, or other
  misc_feature (473)..(473): n is a, c, t, g, unknown, or other
  misc_feature (478)..(478): n is a, c, t, g, unknown, or other
aaagctggagctcaccgcggtggcggccgctctagaactagtggatcccccgggctgcaggaattcgcacgagaccattacctagaacatcctaatcgaaaactctagcttcccactccgctcggccaccagctttgaccgcctcccctcccctccgctccgctcctgttcctccataccccactcccccgcaggagcggcgcggcggcggcaaaggcaaaggcaagatgttcgggcgcgcgcccaaaaaagcgacaacaccaagtactacgagatcctcggggtgcccaagtcggcgtcccaggacgacctcaagaaggcctaccgcagggccgctatcaagaaccaccccgacaagggcggtgattttgagaccgccaaggaggggggggganncctataannnttnnaacctttcccccccanccggggatttattgatcagtaggggcgaacacccccttcgggaaagnaatgnttgttggagaatcccatgtttgatctgttagacattttcctcatctttctttgggacccccttttttgaggatgcggtggaaatacatatgggaaaaaaggtaattgagcgctcttaacactccccctccctctcttacgggtcctcgccacaacctttacacggaacattctaagatatctctctttttgccccatgggcatctacttcaggggaatggagaagtccaccactgttggcgctcagtccacgagccccgtgatgcccggctc

SEQ ID NO: 46684 - DNA, 642 bp, Zea mays
  misc_feature: Ceres CLONE 1452506-F
  misc_feature: Encodes the peptide sequence at SEQ ID NO. 46685
  misc_feature (463)..(463): n is a, c, t, g, unknown, or other
  misc_feature (464)..(464): n is a, c, t, g, unknown, or other
  misc_feature (474)..(474): n is a, c, t, g, unknown, or other
gggagtccccgcggtggcggccgctctagaactagtggatcccccgggctgcaggaattcgcacgagaccattacctagaacatcctaatcgaaaagaccgatctgtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctcagctggaaccttctcggccnngctcaagaancttcgcccacgcacgcagaccctcactaaacttcgctttacaggaatgattttactgaggatgataaagcggcgttcaaaaagtgcttcaggaagatgcttttatacctttaggctgccatctaatggggtggaacctacaaaaaaactcatgtggtccttccatcaa

SEQ ID NO: 46685 - protein, 159 aa, Zea mays
  misc_feature: Ceres CLONE 1452506-F
  misc_feature (100)..(100): Xaa is any aa, unknown, or other
  misc_feature (103)..(103): Xaa is any aa, unknown, or other
MAPPRRALLVLAALLLSLSLGAASFHSDELLLNDDEEFEGVVARPSAPSPPAAPVVSSSRRRSADAPLPGSGESNAVQFTLEHDLGDGKGFVSAGTFSAXLKXLRPRTQTLTKLRFTGMILLRMIKRRSKSASGRCFYTFRLPSNGVEPTKKLMWSFHQ

SEQ ID NO: 46686 - DNA, 634 bp, Zea mays
  misc_feature: Ceres CLONE 1452510-F
  misc_feature: Encodes the peptide sequence at SEQ ID NO. 46687
aaagctggagctccccgcggtggcggccgctctagaactagtggatcccccgggctgcaggaattcgcacgagaccattacctagaacatcctaatcgaaaagtaggtcggtaggtatacgtgcacgtctcaccaacgcaacacaccgttgcctgtgaagcagcgcagcgcggagcggaagggtccagcgaccgcgactgatggggaggagcggcggcgagacggcggggaagaggcagcagttcgggagcatggaggagttctggggcttctacctgagccagcactccaagccgggcacgcggcggtggcacttcctcggcacgctggcctcgctcgcctgcgcggtgctcgcggccgccactggccgcgccgcggtcctcctcgcgggccccgttctcgggtacggcatggcgtggtacagccacttcttcgtggagggcaaccgccccgccacgttcggccaccccgtgtggtccttcctctgcgacctccgcatgttcctgctcatcctcaccggccgtatcgacgccgagctcgcacgcctccgcgtccggccgacggccgagtccaccgacgccgcggcggcctctgcgcaccatgactgatccgtatcctccatgctcgtctgtct

SEQ ID NO: 46687 - protein, 135 aa, Zea mays; identical to SEQ ID NO: 43398
  misc_feature: Ceres CLONE 1452510-F

SEQ ID NO: 46688 - DNA, 654 bp, Zea mays
  misc_feature: Ceres CLONE 1452516-F
  misc_feature: Encodes the peptide sequence at SEQ ID NO. 46689
tggagctccccgcggtggcggccgctctagaactagtggatcccccgggctgcaggaattcgcacgagaccattacctagaacatcctaatcgaaaactctatctgtcctcactcactcactcactcggtcactccacagcttaattgctcccatttctcctccgcggtttggagcctgcttcctctctcgctgctcctttggaagccccaagcccgccagggcgcctgcaaggagagacgacgacagcaatgccggtggtggacaagggaggcgaggccgccaagttgcccccggacatccgtgggctcggcgtcggcggggagaccagcaggccgtcgcaactccacggtggctctggctcgccaccgatgtagtccaatccaaggcgtccaccaccgccaagcgccgccgcgagacttggggctccaagtcggtgcgcgcgtcgtggaggtggtgtggatgcggcggtgcgtggaggtggaaggacaaggatgccatggtcagtcgcaagcgaagcgagcagggagggaatgaagccgtacggtccgggagctgctgtcgtcgtatacatgcatgcataaatacatatatatattttttcgtgtaccagtaattgggtaactggttaattgttagcaacggtccatttgag

SEQ ID NO: 46689 - protein, 38 aa, Zea mays
  misc_feature: Ceres CLONE 1452516-F
MVSRKRSEQGGNEAVRSGSCCRRIHACINTYIYFFVYQ

SEQ ID NO: 46690 - DNA, 678 bp, Zea mays
  misc_feature: Ceres CLONE 1452525-F
  misc_feature: Encodes the peptide sequence at SEQ ID NO. 46691
aaagctggagctccccgcggtggcggccgctctataactagtggatcccccgggctgcaggaattcgcacgagaccattacctagaacatcctaatcgaaaaatacaggccattttgccgtttccggtgcgcgcctctgaacaaacccgaaagcccccctcatcgccattcctcttcctgccatggcgatcctctttactcctcccctcccaccaccaccgcccctcccaactacaccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgacgtcttctccagcgccggcaagctttacgactactgctccccgaagacatcgctatcaaaaatcctggagaagtaccacaccaactctgtaaagatactgtgaggtgagaagcacaagagccttagtgcagagactgaccgtataaagaaagagcacgacaccttgcagatcgagctcaggcacctagaaggg

SEQ ID NO: 46691 - protein, 79 aa, Zea mays
  misc_feature: Ceres CLONE 1452525-F
  misc_feature (9)..(59): Pfam Name: SRF-TF Pfam Description: SRF-type transcription factor (DNA-binding and dimerisation domain)
  misc_feature: The sequence is a functional homolog of SEQ ID NO 2191 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 2 in US patent 7049489
  misc_feature: The sequence is a functional homolog of SEQ ID NO 28 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: The sequence is a functional homolog of SEQ ID NO 2197 in the 10/666,642 US patent application
  misc_feature: The sequence is a functional homolog of SEQ ID NO 1701 in the 10/412,699 US patent application
  misc_feature: The sequence is a functional homolog of SEQ ID NO 30 in the 10/666,642 US patent application
  misc_feature: The sequence is a functional homolog of SEQ ID NO 2199 in the 10/666,642 US patent application
  misc_feature: The sequence is a functional homolog of SEQ ID NO 731 in the 10/666,642 US patent application
  misc_feature: The sequence is a functional homolog of SEQ ID NO 4 in US patent 7057087
  misc_feature: The sequence is a functional homolog of SEQ ID NO 2195 in the 10/666,642 US patent application
  misc_feature: The sequence is a functional homolog of SEQ ID NO 707 in the 10/666,642 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 46 in the 10/666,642 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 2 in US patent 7273968
  misc_feature: The sequence is a functional homolog of SEQ ID NO 730 in the 10/666,642 US patent application
  misc_feature: The sequence is a functional homolog of SEQ ID NO 32 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 1973 in the 10/412,699 US patent application
  misc_feature: The sequence is a functional homolog of SEQ ID NO 1971 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1056 in the 10/225,066 US patent application
  misc_feature: The sequence is a functional homolog of SEQ ID NO 1882 in the 10/412,699 US patent application
  misc_feature: The sequence is a functional homolog of SEQ ID NO 350 in the 10/374,780 US patent application
  misc_feature: The sequence is a functional homolog of SEQ ID NO 944 in the 10/412,699 US patent application
  misc_feature: The sequence is a functional homolog of SEQ ID NO 1955 in the 10/412,699 US patent application
  misc_feature: The sequence is a functional homolog of SEQ ID NO 1953 in the 10/412,699 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 1453 in the 10/374,780 US patent application
  misc_feature: The sequence is a functional homolog of SEQ ID NO 1951 in the 10/412,699 US patent application
  misc_feature: The sequence is a functional homolog of SEQ ID NO 1961 in the 10/412,699 US patent application
  misc_feature: The sequence is a functional homolog of SEQ ID NO 1884 in the 10/412,699 US patent application
  misc_feature: The sequence is a functional homolog of SEQ ID NO 352 in the 10/374,780 US patent application
  misc_feature: The sequence is a functional homolog of SEQ ID NO 384 in the 10/225,066 US patent application
  misc_feature: The sequence is a functional homolog of SEQ ID NO 946 in the 10/412,699 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 1454 in the 10/374,780 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 1969 in the 10/412,699 US patent application
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
MGRGKIEIKRIENSTNRQVTFSKRRNGILKKAREISVLCDAEVGVDVFSSAGKLYDYCSPKTSLSKILEKYHTNSVKIL

SEQ ID NO: 46692 - DNA, 772 bp, Zea mays
  misc_feature: Ceres CLONE 1452540-F
  misc_feature (1)..(1): n is a, c, t, g, unknown, or other
  misc_feature (2)..(2): n is a, c, t, g, unknown, or other
  misc_feature (22)..(22): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
nnggggggggctccggcccccntccccnannaattatattnnnnnagannnnnnaaaaactggagctccccgcggtggcggccgctctataactagtggatcccccgggctgcaggaattcgcacgagaccattacctagaacatcctaatcgaaaagaccccgactcggcggctgcaccgcaatccgaccgaccgccgtccgtccctctccacgccgtctgccgccgcatcaatccagcaggcagcgacctaggggctgtccgtgtccggttggaaggcgccgggcgcactggggtgggcggctgcccgcctggccggccagccgtaagcgccgagcggcgtgccggcatctccgttgcggtgtggaaaaggctccagcggccaggaccgcacgagctcgggatcgggctcgtgctgagaattgtggggggaagtgttaaaaattataatttattcctaaaagcagggggggacaaccactcaataaatgagtgccggtggtgctccacacgaaaatagggggctgaggtttggtactcctgaaaaaggggttttcccgtcggcaggccttaccatgagagaaaacttggcaaaaaaaacgaataatctgtggctggcctggaaatcccacggggggtgtgcaagtccagaaaagagtggggaaacgggtgcctccacggacaagctctcttgtccaatgggtcgcaaatgcgaacgacgaacacctcgccatgtgggcccaaacctcttgtgctatggtgcgtccaactg

SEQ ID NO: 46693 - DNA, 713 bp, Zea mays
  misc_feature: Ceres CLONE 1452559-F
  misc_feature: Encodes the peptide sequence at SEQ ID NO. 46694
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (227)..(227): n is a, c, t, g, unknown, or other
  misc_feature (239)..(239): n is a, c, t, g, unknown, or other
  misc_feature (473)..(473): n is a, c, t, g, unknown, or other
  misc_feature (475)..(475): n is a, c, t, g, unknown, or other
  misc_feature (485)..(485): n is a, c, t, g, unknown, or other
  misc_feature (502)..(502): n is a, c, t, g, unknown, or other
  misc_feature (512)..(512): n is a, c, t, g, unknown, or other
  misc_feature (513)..(513): n is a, c, t, g, unknown, or other
  misc_feature (531)..(531): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagctgggactccccgcggtggcggccgctctagactagtggatccccncgggctgcaggnaattcgcacgagaccattacctagaacatcctaatcgaaaaaaaaccaagtagcgtctagggttttagcctctccaaccgcacgatggacaccgacgcgagaaggcagggggagagaaaatggcgtatttgtcctgcacagccgccgccgtcgccgtcgccgtgaggtcggcggtccgctccgcacctctcactggccgcgtcctcggagcgccactggcttccccttgctcgncnttcgctgccnggggtcgcccgaatccntcccaggacnngcggccgcggcgtcggcnggggctggaaaactctaatgcccctgcccaagcccggttggcgggccccccgggtttaagtcctgggatccccgtccaaaccctcggggttgaaacctccctccccccaagggaaagccctttgccctttttgaaaagggaaaaggggcgccccttaaaaaaaccccttgggaccttttggg

SEQ ID NO: 46694 - protein, 118 aa, Zea mays
  misc_feature: Ceres CLONE 1452559-F
  misc_feature (39)..(39): Xaa is any aa, unknown, or other
  misc_feature (43)..(43): Xaa is any aa, unknown, or other
  misc_feature (52)..(52): Xaa is any aa, unknown, or other
  misc_feature (58)..(58): Xaa is any aa, unknown, or other
MAYLSCTAAAVAVAVRSAVRSAPLTGRVLGAPLASPCSXFAAXGRPNPSQDXRPRRRXGLENSNAPAQARLAGPPGLSPGIPVQTLGVETSLPPRESPLPFLKREKGRPLKKPLGTFW

SEQ ID NO: 46695 - DNA, 688 bp, Zea mays
  misc_feature: Ceres CLONE 1452571-F
  misc_feature: Encodes the peptide sequence at SEQ ID NO. 46696
  misc_feature (495)..(495): n is a, c, t, g, unknown, or other
  misc_feature (496)..(496): n is a, c, t, g, unknown, or other
ggagctccccgcggtggcggccgctctatactagtggatcccccgggctgcaggaattcgcacgagaccattacctagaacatcctaatcgaaaaacaataaccaggagcgagctacctgcgaagccacatctctccttccacttcatcgatagtacgcatctccatattcagtgcagaggcacaagctaagccatgagcaacggtggtaaccgcagcaggggcggcgcgaggttcgagctgcagctgcacctgtcgccgccgccgccggctaggagggtggaggtggacggcggaggcgacggcagcgactcgtcgtcgtccccgagctcgtgcgtgtcgtcggacggcagcccagggagcaagtcgccgatgggtgatcgcgcctgcacccggtgcatgatgtactgcatggtgggcaaaaaggaactcccccactgcatcaactgcaagcagccctgcctcggggaactccttcccttgttctggccccggnngtaaggggggaaagggcaaatgaaaagaagggcaagggggtaaaaccaaaccccgggccccggtgcaattttatgcccctacgggggggtaaacccaaaccttaatcttggggggttttgggcccccctcccgggggggcgggggggaaaaacacccccctttgtaaccccccctggggggggcagggcccc

SEQ ID NO: 46696 - protein, 100 aa, Zea mays
  misc_feature: Ceres CLONE 1452571-F
MSNGGNRSRGGARFELQLHLSPPPPARRVEVDGGGDGSDSSSSPSSCVSSDGSPGSKSPMGDRACTRCMMYCMVGKKELPHCINCKQPCLGELLPLFWPR

SEQ ID NO: 46697 - DNA, 651 bp, Zea mays
  misc_feature: Ceres CLONE 1452612-F
  misc_feature: Encodes the peptide sequence at SEQ ID NO. 46698
tggcggccgctctagaactagtggatcccccgggctgcaggaattcgcacgagaccattacctagaacatcctaatcgaaaaacgaccacgagcgaaaggaggtcgccggaagagggggcgcggagatgagcgggagcgcgttcaacgcgttcaagtcgcgggtgtcggtggcgtggagtccccggctgtacatcacgctggtgcggggcctccccgggacgcggcgcctccaccgccgcacgctcgaggccatgcgcctccgccgctgccaccgcaccgtcgagcaccgcaccacgccgtcgctcctcgggatgctcacccaggtgaagcgcctcgtcgccgtcgagaccgaggagatgtacaacgcgcggaagcaggccgaggaggagaggcgcgcgcccagacccccgctcgtcgtctcccaccagccacagccgccggctccgaagctggcagccgccgccgcggtgggtgccgctaccactgcgcagtagcctctgggcatcagaagtctttcatcacagttcagtggcataataattgacttgcctgtgtatgggtctgctggttctcagacgatcgctttggatcttcttgctcaacgagatatatcaacggatttgatcgatctcaagataatcagttgcatg

SEQ ID NO: 46698 - protein, 122 aa, Zea mays
  misc_feature: Ceres CLONE 1452612-F
  misc_feature (20)..(71): Pfam Name: Ribosomal_L30 Pfam Description: Ribosomal protein L30p/L7e
MSGSAFNAFKSRVSVAWSPRLYITLVRGLPGTRRLHRRTLEAMRLRRCHRTVEHRTTPSLLGMLTQVKRLVAVETEEMYNARKQAEEERRAPRPPLVVSHQPQPPAPKLAAAAAVGAATTAQ

SEQ ID NO: 46699 - DNA, 662 bp, Zea mays
  misc_feature: Ceres CLONE 1452651-F
  misc_feature: Encodes the peptide sequence at SEQ ID NO. 46700
  misc_feature (619)..(619): n is a, c, t, g, unknown, or other
  misc_feature (620)..(620): n is a, c, t, g, unknown, or other
  misc_feature (622)..(622): n is a, c, t, g, unknown, or other
  misc_feature (625)..(625): n is a, c, t, g, unknown, or other
  misc_feature (626)..(626): n is a, c, t, g, unknown, or other
  misc_feature (630)..(630): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (636)..(636): n is a, c, t, g, unknown, or other
ccccgcggtggcggccgctctagatctagtggatcccccgggctgcaggaattcgcacgagaccattacctagaacatcctaatcgaaaaaagcatactattagacataccggtatatattattgttcttagtcatcgcacaagactcttgtcaacaagaccaacaacaggatgaggactgccgtgcatgctgcgctttgcattgtgcttgtgataatgtcttcaacactgtcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaaacaagatgcaacccttatcgccggcgacgttggcaacaaaaagggatattgatggcagacgtgtatttcttggttgaataatatatactgctagaattaatatgggcaccaacaacgaaatatctataatgttattcttcagtgtaatgcttccagcatgttctgttttagtataactaaatatctatctttccccccccatttaagttgttttttggttctcnncnganntccngnnncngctttcttgggtcatctgaatgaaaa

SEQ ID NO: 46700 - protein, 91 aa, Zea mays
  misc_feature: Ceres CLONE 1452651-F
MRTAVHAALCIVLVIMSSTLSSCEDDEKVSIACDTGCNAAISRLKCFLMAYSEGKVLVSSNCETPTRCGCVFRHKQDATLIAGDVGNKKGY

SEQ ID NO: 46701 - DNA, 666 bp, Zea mays
  misc_feature: Ceres CLONE 1452665-F
  misc_feature: Encodes the peptide sequence at SEQ ID NO. 46702
  misc_feature (457)..(457): n is a, c, t, g, unknown, or other
  misc_feature (492)..(492): n is a, c, t, g, unknown, or other
  misc_feature (627)..(627): n is a, c, t, g, unknown, or other
  misc_feature (666)..(666): n is a, c, t, g, unknown, or other
ctggagctccccgcggtggcggccgctctagaactagtggatcccccgggctgcaggaattcgcacgagaccattacctagaacatcctaatcgaaaaattctttccgtcctcatcccggccattccttgcctgcccgccgcgcggactctatataagccttgtgccccatctcatcagcatccatcaccaccatctccgatccatctcttcggctgcctgtgctacccttcccttcacctcacacaggaatactacaggataaagcagctccttcgatacatatatacttttttccagaaaaaaaaaggctgagccggtgcgagcgaggcttgaccgcttgagcaatggcgagcgcttttagctcgagggcatgcgcgctggtggcgctgctaatggggctctgcaccgccggcgcggcggcgggcaggatcgacgacgggctggaggtgacgtgnggcgacggccgcgggagcgtctcgtccgacggccnagtgctgacgctgtcgctcgaccgcacctccggctccgggttccgctccaaggacacgtacctcttcgcgcgcgccgacgtgcagatcaagctcgtccctgacaactccgccggcacggtcaccaccttctacgnaagctcccttctctttctctctttctcggcctttccagn

SEQ ID NO: 46702 - protein, 106 aa, Zea mays
  misc_feature: Ceres CLONE 1452665-F
  misc_feature: SWISSPROT Homolog: EC 2.4.1.207 Xyloglucan:xyloglucosyl transferase
  misc_feature (37)..(37): Xaa is any aa, unknown, or other
  misc_feature (49)..(49): Xaa is any aa, unknown, or other
  misc_feature (94)..(94): Xaa is any aa, unknown, or other
MASAFSSRACALVALLMGLCTAGAAAGRIDDGLEVTXGDGRGSVSSDGXVLTLSLDRTSGSGFRSKDTYLFARADVQIKLVPDNSAGTVTTFYXSSLLFLSFSAFP

SEQ ID NO: 46703 - DNA, 834 bp, Zea mays
  misc_feature: Ceres CLONE 1452671-F
  misc_feature (38)..(38): n is a, c, t, g, unknown, or other
ccctttttaaaacaggaaagtttctcgccccccaaagncgcgaggttgtgtgcgtcccaaagattggggctccccgcggtggcggccgctctattatagtggatcccccgggctgcaggaattcgcacgagaccattacctagaacatcctaatcgaaaaaaaatcagcaacgcttggcgctcgttcggctccgccctccgcccccctgctccgtccgatcgccgcaccccctcgccgccggtgatcgctggggagccgacgaggccggacgcccgaggttatcgctccctcctctgtgtctcccttcctcccgcgcgtcccacctgctcgtcgcgaggcctcttgctcggggctttcctctcgcccgcgcaatttgggatgccaggtgggtgcgaggcctacgacgcctagccggccggtggcgcacggcgtttattgtctcacccgggaggcgagaatcgtttttgccccggcctttgtgtctaacccccccccccgggctcccgggggtcctctcccccccccgggcccgcctggggggggggaagtttttccccctttccccgtcggttcctaccctccccgccccatgtctgccacatgccccccttcccccccctgtgcccccccggtgttttccctcgccgaatggacgtgcctcccccccccggtccctccccttaaccccacccctgtgccccctattgtccctccccacctatataattcccccggttacgggaaccccccaaccacggagaaagtgggtctcgggtgttgtataacgcgaaacgtgcccccccctgtaccccccccatcgttgccaccccccc

SEQ ID NO: 46704 - DNA, 649 bp, Zea mays
  misc_feature: Ceres CLONE 1452673-F
  misc_feature: Encodes the peptide sequence at SEQ ID NO. 46705
aagctggagctccccgcggtggcggccgctctagaactagtggatcccccgggctgcaggaattcgcacgagaccattacctagaacatcctaatcgaaaaatgtaagcgagccaatctcatccgctgctgctcgtatgcgcactctttgtctgtgacccgaccccgtcctcaccaaattgctctgagggaatcgattaatcgtccgcctacgccgagcgcggtggaggatcgggacaaggagccttctctcgtagaaatcattaacatcaagtttgtagagagtggagagaaggagaagctgacggagctcctccgcgagcggctcgtcgagtgcggctggatggatgagatgaaggcattctgcagggactatgtaaggaagaaaggaagaaataatgtgagggtagatgacctcattcatgttattgttccgaaaggaagagcatcagtgcctgcttcggtgaaggcagaactcctgcaacgtatccggtccttcatggctaccacacttcggtagtcatttatcgtgacggttggagctacatgtaccattgtacgaacactgggaggtcgatcttgttggggaccaagggtgcaggtactgagcatgaaaaggatcagtgtgatcttcatgatgctatcgacat

SEQ ID NO: 46705 - protein, 58 aa, Zea mays
  misc_feature: Ceres CLONE 1452673-F
MDEMKAFCRDYVRKKGRNNVRVDDLIHVIVPKGRASVPASVKAELLQRIRSFMATTLR

SEQ ID NO: 46706 - DNA, 759 bp, Zea mays
  misc_feature: Ceres CLONE 1452682-F
  misc_feature: Encodes the peptide sequence at SEQ ID NO. 46707
  misc_feature (12)..(12): n is a, c, t, g, unknown, or other
  misc_feature (20)..(20): n is a, c, t, g, unknown, or other
  misc_feature (44)..(44): n is a, c, t, g, unknown, or other
  misc_feature (58)..(58): n is a, c, t, g, unknown, or other
ctttatataacnggcaaatnccccgtgcatgtccatcttacccnccccccaataaatnttttttctccgccccccgcggcggcggccgctctagaatagtggatcccccgggctgcaggaattcgcacgagaccattacctagaacatcctaatcgaaaaatcagccatcgccaccacctccctccgcggctccgcctttcgccgcgaacacgccgctgtctcgaccccttgtcctcctccttcagcaagatggcggagattgagataaaaacagcacctgctgacttccgcttccctacaaccaaccaaacaaggcattgttttactcgctatgtcgagtaccacaggtgttttgaatgccaaagggggaataatgcctggggttttgcaaaaaaatttgccaaagtacaacagggcccttttggccctggaaaaatgggtttgaaaaatgggaaccaccaaaagggagcctggggacctttttctcggaaacccccccaaaaagttacccccccccaaaaaccccccccggtgggacccccataaaacaaaattgtggcccagggaaacccctaaagggttcccattgtggggaattccccttttttcaaaaaaaaaaaaaaaaccccttttgcccccctgggctttttaaaaccagtttctacaaaaaaaaggttggggggggggcccccccccgtggcggccccaaaaaaaaatttggggaaaaaggggcccccccacacccacatttttttttt

SEQ ID NO: 46707 - protein, 98 aa, Zea mays
  misc_feature: Ceres CLONE 1452682-F
  misc_feature (4)..(62): Pfam Name: COX6B Pfam Description: Cytochrome oxidase c subunit VIb
  misc_feature: SWISSPROT Homolog: EC 1.9.3.1 Cytochrome-c oxidase
MAEIEIKTAPADFRFPTTNQTRHCFTRYVEYHRCFECQRGNNAWGFAKKFAKVQQGPFGPGKMGLKNGNHQKGAWGPFSRKPPQKVTPPQKPPPVGPP

SEQ ID NO: 46708 - DNA, 779 bp, Zea mays
  misc_feature: Ceres CLONE 1452690-F
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (22)..(22): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (80)..(80): n is a, c, t, g, unknown, or other
  misc_feature (139)..(139): n is a, c, t, g, unknown, or other
  misc_feature (152)..(152): n is a, c, t, g, unknown, or other
  misc_feature (172)..(172): n is a, c, t, g, unknown, or other
  misc_feature (195)..(195): n is a, c, t, g, unknown, or other
  misc_feature (198)..(198): n is a, c, t, g, unknown, or other
  misc_feature (201)..(201): n is a, c, t, g, unknown, or other
  misc_feature (202)..(202): n is a, c, t, g, unknown, or other
  misc_feature (387)..(387): n is a, c, t, g, unknown, or other
  misc_feature (399)..(399): n is a, c, t, g, unknown, or other
  misc_feature (426)..(426): n is a, c, t, g, unknown, or other
  misc_feature (427)..(427): n is a, c, t, g, unknown, or other
  misc_feature (470)..(470): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (481)..(481): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (522)..(522): n is a, c, t, g, unknown, or other
  misc_feature (528)..(528): n is a, c, t, g, unknown, or other
  misc_feature (529)..(529): n is a, c, t, g, unknown, or other
  misc_feature (557)..(557): n is a, c, t, g, unknown, or other
  misc_feature (560)..(560): n is a, c, t, g, unknown, or other
  misc_feature (583)..(583): n is a, c, t, g, unknown, or other
  misc_feature (603)..(603): n is a, c, t, g, unknown, or other
  misc_feature (664)..(664): n is a, c, t, g, unknown, or other
  misc_feature (751)..(751): n is a, c, t, g, unknown, or other
nngggggttnnnnnnnnnananaaaaaannnnnnnaanaaaaaaaaaaaaaaannnnnnncnncccaacccccaaaaaancccctcaaaaactaaaaaatcccccgggctgcaggaattcgcacaaaaccattacctanaacatcctaatcnaaaaaacttaactcctcccntctaggccacaacaacaacaaancanccnngacgaacataaacaccgcccatcccaaaacatacaaaaaagttctcaactcatcctccccctcatgccacaaataccaacatacaccaccagccagacatgacccgctcctccacacaatcacaatccaacaatagatctggcaccagaacaagaacgccccaggccaacaacgagaagaaaaancaaaaacccaanaacctaccggaaataaaaaaacacccnnccaaaaaaaaagtgcggggggggggggtgggggggcccccccncgacggnnntnttgttttnnnnnnnnaaagagaaaaaaataaaaaataaaanttaaannaaaaaaaataaaaatataataaaatttntanaataaataaaaaaaaaaaaaaanaataaaataaattaaaaaanaaaaaaaaaaaaaaaaaataaaaaaaaaaaaaaatttttaataaaaaaaaaaaaaaaaaanagatatatattgtattaaaaaattaaaataaaaaaataaaaaaaaaaaaaaatgaatattgtataaattgtattggggagaggaaanaaataaaattgggtttgggcgtcaggcg

SEQ ID NO: 46709 - DNA, 626 bp, Zea mays
  misc_feature: Ceres CLONE 1452704-F
  misc_feature: Encodes the peptide sequence at SEQ ID NO. 46710
ggagctccccgcggtggcggccgctctagaactagtggatcccccgggctgcaggaattcgcacgagaccattacctagaacatcctaatcgaaaaacggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgatccgttcgatgaggacttcgagggaagatggatcgtctccaagaaggatgaataccaaggtgtatggaagcatgccaagagtgatgggcatgaggactatggtctccttgttagtgacaaagcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaaggttcatttcatccttaagcacaagaatcctaagactgga

SEQ ID NO: 46710 - protein, 156 aa, Zea mays
  misc_feature: Ceres CLONE 1452704-F
  misc_feature (24)..(156): Pfam Name: Calreticulin Pfam Description: Calreticulin family
MMGGRALLLLLVSALLVQIRASDPLLYDPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSTNKVHFILKHKNPKTG

SEQ ID NO: 46711 - DNA, 1216 bp, Zea mays
  misc_feature: Ceres CLONE 1452716-R
  misc_feature (20)..(20): n is a, c, t, g, unknown, or other
  misc_feature (786)..(786): n is a, c, t, g, unknown, or other
  misc_feature (1216)..(1216): n is a, c, t, g, unknown, or other
aaacgacactccacgacccnggaggcaggggggccttggtggggttttcgctacaacccctctttgtggtccaattgggtacgggccccccctcggagtcgacggtatcgataagcttttttttttttttctttagatcaaagtaaccagtatgtttctcaagtacatcagaacagatgcgcatacggatgaaaggcgaaaaaaagagagagagatagaaaagaggaaggaacaaatacaagaacgaggccgctagcattcgcgcgcacacggaacctccagagactctaccggtacttcctcgacgacgagttcatgaacctgatgcactcctacaccgcttcgctcttgtgcgagtcatcgatgacgacgaccgccctcagcgcggacgactgctgcttccggctgctagtacggcgcctcggcggcgctgcctcatttgggcggagtcgcgctggagcctggttgaactctcttgggtgccgtatgtctattggggccgaaacgccctgccgaaagatcaacccgggcgtcccttgtaaaaaacacgacggccctatctacccgtttttattctactatcaaggggaaggagccggggactgcgaaaatacgcaagttgtatgatgtgctcagagggtcgtcgagcctctcttttccggggcccccggatcccgcgcgcggccttaacatccctcctccgtgtgctcccggggcggaatctgtcttatagtaacctcgccgccggggttcgaaaatatatgaggggcgccccccctaaaaatnttattcatattgaatgagggtctagtcgatcgaacaccgcgagtgggttacccgtcccgcgcgtggtgcgcccgatattcccctgcccccgatgatgtgggccgcgtgtctcgaatctccggaggagatactcctggacgctaatatgcttataaatctcccccaccataatataagcgggtgcagataagacgggcgccgaatacgccaattattagttacggctccccccatatttgtggcagatgtgctcgcctacggtggaataatgtttgctctgggagtgaataataatacccgtgtggaacacacccggaagggggaaccacccgcagaacgtgtaacgaatggataggcacgtcgactttgtatgcctgacagcgccccccccaccaaatggagtatactgcacagtggggagggggggctn

SEQ ID NO: 46712 - DNA, 638 bp, Zea mays
  misc_feature: Ceres CLONE 1452761-F
  misc_feature: Encodes the peptide sequence at SEQ ID NO. 46713
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (464)..(464): n is a, c, t, g, unknown, or other
  misc_feature (483)..(483): n is a, c, t, g, unknown, or other
  misc_feature (486)..(486): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (508)..(508): n is a, c, t, g, unknown, or other
  misc_feature (527)..(527): n is a, c, t, g, unknown, or other
  misc_feature (618)..(618): n is a, c, t, g, unknown, or other
ccccgcggtggcggccgctctagaactagtggatcccccgggctgcaggaattcgcacgagaccattacctagaacatcctaatcgaaaagctggcctttggcaccttccagaagattcctctatctgcctccgttccgctcatggcgtccgcgccgagcaccacggcgcccaccctcgcgccctctctgcgcacagccgcttactgctttcagcacccccgcggggcccgccctttgcgggcccgcgcccacgcctgtcccgcgctcagcccgggcaggccggatgccgcgcggcgccaggtcagctcgctcgccctcgctcgcgcgttcgggtgcggcacgggcgaccccggtttcattggggcaagggccaattcccccagggagcgctggaaccaaacttccccgccttaaggaacccccccccccaccggccccccgnnnnncccaccccgggaccaanttcttcttaaaatagaggnggngaaaaacccnnnnnccgaggcncaagcgacacactttcgtnaaaaaatcccaggaggatagacggggcgaaaaaaaaatcccaaaggagggtttcccccccccccacccccgtagttttaaaataaaaaaanacaaggggctttttcggtcc

SEQ ID NO: 46713 - protein, 157 aa, Zea mays
  misc_feature: Ceres CLONE 1452761-F
  misc_feature (148)..(148): Xaa is any aa, unknown, or other
  misc_feature (149)..(149): Xaa is any aa, unknown, or other
  misc_feature (155)..(155): Xaa is any aa, unknown, or other
PRGGGRSRTSGSPGLQEFARDHYLEHPNRKAGLWHLPEDSSICLRSAHGVRAEHHGAHPRALSAHSRLLLSAPPRGPPFAGPRPRLSRAQPGQAGCRAAPGQLARPRSRVRVRHGRPRFHWGKGQFPQGALEPNFPALRNPPPHRPPXXPTPGPXSS

SEQ ID NO: 46714 - DNA, 661 bp, Zea mays
  misc_feature: Ceres CLONE 1452765-F
  misc_feature: Encodes the peptide sequence at SEQ ID NO. 46715
aagctggagctccccgcggtggcggccgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaatactatgactgcttctgcagctgctggtgtgcagatggtggctgcacgcccttgcatttcagcctcgccaggaattcttaccgcacgggtttctaggactgattgcatgctcattaccactgctacattccccaaaatcacctgctcctggcctctaaggtttaaccgcaatgatgttgttgtaagagcaatatccgacgagtgtggcccgcaggggcttcccattgatctcagaggtaaaagggcattcattgctggagttactgatgataatggctatggatggtcaattgcgaatgcacttgctgcggctggtgctgaaattcttgtgggtacatgcgtgccggcacttaacatatttgagatacgtctgaagcgtgcaaagtttgatgaatcacgtacgctgccagatggatctctcatggatattgtgaaagtctacccacttgatgctgtctacgattcccctgatgat

SEQ ID NO: 46715 - protein, 157 aa, Zea mays
  misc_feature: Ceres CLONE 1452765-F
  misc_feature: SWISSPROT Homolog: EC 1.3.1.9 Enoyl-[acyl-carrier-protein] reductase (NADH)
MTASAAAGVQMVAARPCISASPGILTARVSRTDCMLITTATFPKITCSWPLRFNRNDVVVRAISDECGPQGLPIDLRGKRAFIAGVTDDNGYGWSIANALAAAGAEILVGTCVPALNIFEIRLKRAKFDESRTLPDGSLMDIVKVYPLDAVYDSPDD

SEQ ID NO: 46716 - DNA, 653 bp, Zea mays
  misc_feature: Ceres CLONE 1452776-F
  misc_feature: Encodes the peptide sequence at SEQ ID NO. 46717
ggagctccccgcggtggcggccgctctagaactagtggatcccccgggctgcaggaattcgcacgagaccattacctagaacatcctaatcaaaaactatcgtagcacgctagcacgcatctgttcccgtctcctcagcctccgtttcaaactcgcccggtcatcccatctccaccaccacatccgtcctcttccgccgccgccgatggcccgcctcctcacacaaaccctcaccctagcccgtcccgccgcctcctcctcccccaccgccgcattcgcctccctccgttgcctcgctaccaaggtcgagatcgtcgagatcgacctcaccgaggaagacgctggctcctcggcccacggctcctccccctcgtccccatcgatcgaggtggttgggatccggcgcctgaagaaggccatccacggcgtcatggtgcgccgcgccactcccgattggctgcccttcgtgcatggagggtcctactgggtgcccccgctgcgcctcccgcacgaggtcaccgcgtttgtcggccggatcgcgacctcaggaggcgcatccggtgtcgccaagttcatggacggtgtcgcggcccctgggggcgccggtgccgttggcgcgctgttcaaatcgtgcaactctacgactacgagtc

SEQ ID NO: 46717 - protein, 149 aa, Zea mays
  misc_feature: Ceres CLONE 1452776-F
MARLLTQTLTLARPAASSSPTAAFASLRCLATKVEIVEIDLTEEDAGSSAHGSSPSSPSIEVVGIRRLKKAIHGVMVRRATPDWLPFVHGGSYWVPPLRLPHEVTAFVGRIATSGGASGVAKFMDGVAAPGGAGAVGALFKSCNSTTTS

SEQ ID NO: 46718 - DNA, 654 bp, Zea mays
  misc_feature: Ceres CLONE 1452781-F
  misc_feature: Encodes the peptide sequence at SEQ ID NO. 46719
  misc_feature (472)..(472): n is a, c, t, g, unknown, or other
  misc_feature (494)..(494): n is a, c, t, g, unknown, or other
  misc_feature (495)..(495): n is a, c, t, g, unknown, or other
  misc_feature (498)..(498): n is a, c, t, g, unknown, or other
  misc_feature (499)..(499): n is a, c, t, g, unknown, or other
  misc_feature (502)..(502): n is a, c, t, g, unknown, or other
  misc_feature (506)..(506): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (530)..(530): n is a, c, t, g, unknown, or other
  misc_feature (531)..(531): n is a, c, t, g, unknown, or other
  misc_feature (533)..(533): n is a, c, t, g, unknown, or other
  misc_feature (536)..(536): n is a, c, t, g, unknown, or other
  misc_feature (537)..(537): n is a, c, t, g, unknown, or other
  misc_feature (560)..(560): n is a, c, t, g, unknown, or other
aaagtggagctccccgcggtggcggccgctctagaatagtggatcccccgggctgcaggaattcgcacgagaccattacctagaacatcctaatcgaaaaagaattcctgtcactgctcgaaatcgatccgatctccgctcgcgctgaagcctgatctccaccgggttcgcagcaggggcgcaggacctcgatcacgaggaggcaggggagcagcatccacaaccacaagccatggcggggagggccaacatccccactaacaactccgccctcatcgcaatcatcgccgacgaggacaccgtcactggcttcttgatggccggcgttggcaatgttgatctgcgcaagaaaataacccacctggctcccccacacaagacgacagtttaacaaatcgaggacgccttcaaaagatttactacaagggaggatattgctattggggttctcagtcaattttttggcccacangaaaaaaagttctggggggaannttnnaanaagnccgtttctgtactgcccnnnnntnncnttnnaggaaaatttatatgatttaagngaaaggaattggtggttctttagagtgaaaaaatttgtttttctgaaaaaataggggggggtttgaattagggaatgaaggggttccttggcta

SEQ ID NO: 46719 - protein, 52 aa, Zea mays
  misc_feature: Ceres CLONE 1452781-F
  misc_feature: SWISSPROT Homolog: EC 3.6.3.14 H(+)-transporting two-sector ATPase
MAGRANIPTNNSALIAIIADEDTVTGFLMAGVGNVDLRKKITHLAPPHKTTV

SEQ ID NO: 46720 - DNA, 658 bp, Zea mays
  misc_feature: Ceres CLONE 1452786-F
  misc_feature: Encodes the peptide sequence at SEQ ID NO. 46721
  misc_feature (530)..(530): n is a, c, t, g, unknown, or other
  misc_feature (594)..(594): n is a, c, t, g, unknown, or other
  misc_feature (643)..(643): n is a, c, t, g, unknown, or other
aagctggagctccccgcggtggcggccgctctagaactagtggatcccccgggctgcaggaattcgcacgagaccattacctagaacatcctaatcgaaaactcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaaatattgctgacgctgggttttcagatgttacaaagaatttcttggctgtccctggcgacnatggcaggctgaaatatattgaacgcatttgcgagagatttgttgatttgactatggaacatangggggagatgaagggtgtggtcaggacagttatttccctcccccaggangaggagaaagactct

SEQ ID NO: 46721 - protein, 175 aa, Zea mays
  misc_feature: Ceres CLONE 1452786-F
  misc_feature (56)..(174): Pfam Name: OSCP Pfam Description: ATP synthase delta (OSCP) subunit
  misc_feature: SWISSPROT Homolog: EC 3.6.3.14 H(+)-transporting two-sector ATPase
  misc_feature (133)..(133): Xaa is any aa, unknown, or other
  misc_feature (154)..(154): Xaa is any aa, unknown, or other
  misc_feature (170)..(170): Xaa is any aa, unknown, or other
MAAARHLRSGLPLLRAHLASSESAAVAQVSRGFASQAAKPTGKEIKVPKALFGGTGNYASALFLTAAKSNALDKVESEIKAIVEASKKSPLFSQFIKDLSVPKATRVKAIAENIADAGFSDVTKNFLAVPGDXGRLKYIERICERFVDLTMEHXGEMKGVVRTVISLPQXEEKDS

SEQ ID NO: 46722 - DNA, 650 bp, Zea mays
  misc_feature: Ceres CLONE 1452789-F
  misc_feature (337)..(337): n is a, c, t, g, unknown, or other
  misc_feature (378)..(378): n is a, c, t, g, unknown, or other
agctccccgcggtggcggccgctctagaactagtggatcccccgggctgcaggaattcgcacgagaccattacctagaacatcctaatcgaaaaactctactagctaattacctccgtttcggcgccgtatccagccccggcccaccacatatgcccgcgcgcgaggcgcgaccacgcggcaggtctcgctccccgtctaccaactcggtcgcttcgcttcagcggctcgtcgttgctatcacttcgtcgccgcgggtcgatagcaaagcttggccgcttgcgcatcgcggctgccggagccggacgggcggcgcccgcgcgcggccgcctctcccnttcgcgtcgacgccctgagaggcgtataccgtggagcttgnagctgaactgaaccatctcaaggaggagaacgagcgcctcagagcagaggagaagacgattctgctgtcgaagaaaaagatgctggtggagaagatgatggacaggcaaaggagaatgtgagcgccaagaaagtcggtcgcgggctgcgccggtggggcagcgccatgtggtgaacttgtgacgactgagactcgcgttgtgcagttccagtccgattggcgcttgcttgcttgctcccatgaaagggctgtacctgtcggtacaagaacat

SEQ ID NO: 46723 - DNA, 1259 bp, Zea mays
  misc_feature: Ceres CLONE 1452794-R
  misc_feature (14)..(14): n is a, c, t, g, unknown, or other
  misc_feature (15)..(15): n is a, c, t, g, unknown, or other
  misc_feature (31)..(31): n is a, c, t, g, unknown, or other
  misc_feature (57)..(57): n is a, c, t, g, unknown, or other
  misc_feature (918)..(918): n is a, c, t, g, unknown, or other
  misc_feature (1235)..(1235): n is a, c, t, g, unknown, or other
  misc_feature (1236)..(1236): n is a, c, t, g, unknown, or other
acacgaatgccccnngctatcgccacaggcngcgggatataaaatttttttagcatntatgcctccctcttcaattgggtacgggccccccctcgagtcgacggtatcgataagcttttttttttttttttttaattgttataagcagaaaacaactttgttcaataccatatgttctttgtaaccacttcaaaaattcaaatatttaaagatttttttgtgttccttgagcatctacatacaaacaagttgaaactctggaaacttctctggatcaagtcattgtcggtctcttggctttagcttgaaggaaacagcttctctgcttggtcagggaagaacgttatgaacaatggagcacagacgagcactgttcctaagacagctgagatcttcccttgaattgtgataagccctgcctttccagcattctgaaactccgttgaaccaaatgatttaaatgtccctggtttaccaaattgtaagccctgatgttacaaatagctatgtcgtcaatcacctggcattttcgcaatcaacttagctgcaagctgacggatcctgaagaactattctttggggaaaactaatgagaaaagttcgggataaccctcgtggaaaaaattccgttttctaatacaggaaattaatattcaaattcccggggaattcgaggttaattgagagagaagggtcgtaaactccggagtgcgaaagaatgttatttttccacgaaacgcgcggagatgcgagaataacctggccgcccctccacttattataatataattatactcctactcaaaagcaagtacggcggtagggaggaccgtctattcgtttgggaaacacataattataaagtcacaaaaagccgccgaagcctttatatattatagacgaagaactaattgctgnagagtttttatttattaatgtatgctccgcccccataaataagtgccaaatatgttgtgggatctccccaaataatgaacagtaactataagaacaccccccccgtgtataaccatagttacggcacgccgtggctcaaagaaaacatatgttagggtgtgaacaacatccaaaacgcggagggttattctgttatgtataatcgcttagacgcgtccccgcgtgtatttataaaattatcttatctcccgctcttttttttatgggtgccgatagcggcgcatcaccaccacgataaaaatagatatatgctcctnntttaatcctatactgacacttag

SEQ ID NO: 46724 - DNA, 660 bp, Zea mays
  misc_feature: Ceres CLONE 1452805-F
  misc_feature: Encodes the peptide sequence at SEQ ID NO. 46725
aagctggagctccccgcggtggcggccgctctagaactagtggatcccccgggctgcaggaattcgcacgagaccattacctagaacatcctaatcgaaaactatcttcctatggtcgtcgtcgtcgtcgtcggagacgtcctcgagtccccctcccctcccctcccccccgccgaagaggagcagcgcagccgcgatggaccgcgtccagctcgtgctcctcggcctccccatcctcctcttctgctccgacgtcgtcaccctcttcgcgcctctcccaccgccgggccccgggcccgacagggacccccacgcttttcagcccggcggggaatcctccgccgccgacgcttccgcacatgtggagccacaggtggatggacctggctccggcaccaccgtcgacttcaagttctgcgcctcctgctcgtacaggggaactgcaatgaccatgaagcggatgctggaaacctcctttcctgggatccatgttgtcttggaaattatcctccgccgttccccaagcgcgctctcagtaaagctgtaccccttcttcagttcggcgcgatggcaacattaatggccggtgatcagatcttccccagatttggaatggtcccgcctccttggtactactcactccgcgctaatagatttgga

SEQ ID NO: 46725 - protein, 127 aa, Zea mays
  misc_feature: Ceres CLONE 1452805-F
MDRVQLVLLGLPILLFCSDVVTLFAPLPPPGPGPDRDPHAFQPGGESSAADASAHVEPQVDGPGSGTTVDFKFCASCSYRGTAMTMKRMLETSFPGIHVVLEIILRRSPSALSVKLYPFFSSARWQH

SEQ ID NO: 46726 - DNA, 643 bp, Zea mays
  misc_feature: Ceres CLONE 1452810-F
aaagctggagctccccgcggtggcggccgctctagaactagtggatcccccgggctgcaggaattcgcacgagaccattacctagaacatccaatcgaaaaatattatattcgcgcaccatcgcagcaacttgcacgggcgccgatgactagttgcgccagatgcactgcatctgctcggcgtggtgcctccaacgtccaacccctcttcctcttgtctctcgtctacctctcttctgcccctctgcgtccgtgtctccatcgtcgtcgctgcgtgaggttgacgacgaccagtcacaggatctgttcgttcctcatgcgacccagctagctaaaactggcatgcatggacatgctacgctgctgcgtcaatccatctcaccagtgctagctagctagatctggcctgattcgccgatcgagcggtggtgagacggagtgcttcagctcaaagactgctagtggtaggctggtagctagctgtgtgcctgtgtgcagtgtgcactgccactgcatgcgcggcgccttggacttaagacggcagcacacgcacgcgaggaggcgtcggctgaagcgagcgctccggcggctccgcttcgctcatcaggttcttgagccccggaaacgatgagcacgacccggcc

SEQ ID NO: 46727 - DNA, 667 bp, Zea mays
  misc_feature: Ceres CLONE 1452818-F
  misc_feature: Encodes the peptide sequence at SEQ ID NO. 46728
  misc_feature (478)..(478): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaaattccgcctccacccccgaactccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtacctccgcttcctccgcaagaggatgaacaccaagccctcccacggccccatccacttccgcgcccccgccaagatcctctggcgcaccatccgcggtatgattccgcacaagaccgcgaggggcgaggccgcgctcngcaggctcaaggcgtacgagggcgtgccgccgccgtacgacaggaccaagcgcatggtcatccccgacgcgctcaaggttctgangctgcagcctgggcacaggtactgcctcctcgggcagctctcccaggaggtcggatggaactacgccgacaccatcagggagctgggagaaaaagagaaggaga

SEQ ID NO: 46728 - protein, 167 aa, Zea mays
  misc_feature: Ceres CLONE 1452818-F
  misc_feature (11)..(127): Pfam Name: Ribosomal_L13 Pfam Description: Ribosomal protein L13
  misc_feature (105)..(105): Xaa is any aa, unknown, or other
  misc_feature (133)..(133): Xaa is any aa, unknown, or other
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALXRLKAYEGVPPPYDRTKRMVIPDALKVLXLQPGHRYCLLGQLSQEVGWNYADTIRELGEKEKE

SEQ ID NO: 46729 - DNA, 637 bp, Zea mays
  misc_feature: Ceres CLONE 1452820-F
  misc_feature (248)..(248): n is a, c, t, g, unknown, or other
acagctggagctcaccgcggtggcggccgctctagaactagtggatcccccgggctgcaggaattcgcacgagaccattacctagaacatcctaatcgaaaaggcatactctcactctctccctcggtccctcctcgtcgttctcccgtgtccgacatgaactatatgtctctgggtggcggcaactgggaggcctctgccgctgccctacgccaggatccaggatgcatattccgagaaagggctcncgcatgattggtggaaagagaaataaccgagggcggtctctgcaccgctagaattcttcatctggactgagcaaaagtcaggtaaggatggaggaaataatcttggaagcacccccagctttatgagaaaatgtgtccaaggagaaaactaaaaagcctgtcggtttcaacactgaaaaaatctccctttaaaaaaacgggcaatagaaatggggaaaatttatcaccctccgtaaagattaaaaaccataaaaattgcctggtttaaaagggaaaaaggaggtccccaggcccaagggagggccccttaatacctgttcggtctttttaaaaggggggggggaaattacaaaaaaggatattccccggaaccctctcccctaaaaaaa

SEQ ID NO: 46730 - DNA, 704 bp, Zea mays
  misc_feature: Ceres CLONE 1452834-F
  misc_feature: Encodes the peptide sequence at SEQ ID NO. 46731
  misc_feature (364)..(364): n is a, c, t, g, unknown, or other
aagctggagctccccgcggtggcggccgctctagaactagtggatcccccgggctgcaggaattcgcacgagaccattacctagaacatcctaatcgaaaaagtactctctccagtgtccacagaaacagaattccgctccctccccgtgtcctcctcccgcgcccgcgcatcgtgaggtggagttcccaccccgaggccgcaatggcgacggtggaggtggtggtggccaacggcttgggtggcgccgacaccaagaccgtgtttaaggaacatacagcaagctcaaggaggagatgctagacgaccccgcctttcgagtcaccgacgagtcgctacagtggatcgaccgcatgttgaactancatgtgctcggaagaaaagtgcatcggcggctctctgtcattgatagttaccgaaaatgaagggtggttatgtttctagcaaggagagaaatttcttgcttgcccccctggggggggcattgaaagggctcaaacttttttccttggggtggaggaatttggggaaactccccaaaacgggggggccaaactttttggtttaaaaggcccccaggggggccctttttggggaaaaaaagaaaaatttctccctcccaaaattttaaaaaaaaatttttcaccccctttgtggggggagaccacaatttgggggggagaaacacccccctcctcgggggga

SEQ ID NO: 46731 - protein, 42 aa, Zea mays
  misc_feature: Ceres CLONE 1452834-F
  misc_feature: SWISSPROT Homolog: EC 2.5.1.67 Chrysanthemyl diphosphate synthase
  misc_feature (23)..(23): Xaa is any aa, unknown, or other
MLDDPAFRVTDESLQWIDRMLNXHVLGRKVHRRLSVIDSYRK

SEQ ID NO: 46732 - DNA, 674 bp, Zea mays
  misc_feature: Ceres CLONE 1452836-F
  misc_feature: Encodes the peptide sequence at SEQ ID NO. 46733
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (341)..(341): n is a, c, t, g, unknown, or other
  misc_feature (415)..(415): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactgggactccccgcggtggcggccgctctagaatagtggatcccccgggctgcaggaattcgcacgagaccattacctagaacatcctaatcaaaagagatctcgcccgtgctgaatcccaccactctcgccgacccggccggccgcagcaagcgcagcgcatcgacaggagccgaagaaccgaaaagagatggcgtcggcgctgtcctccctgcgctacngcgacagcctctcggtggtgggcatctccgcccgcgacggcgtgctctgcgaagcccatgtctggctcctcatnctacgcaccgccaactaaaactccctccggggcctcatggagcggcaattccgcaagctaaaacccattgaagtccggtccaccctccgcctcctccgggccggttgtcctcctcccgcgaacccgaaatgtgcggggggtaaaaaaaaagggacccgttccaaaaccaacccctcaagggacccgggcggggaaacttcttcctcccaaaaattcaaattggggggcccccccccccccgtggtaaggggccttcttc

SEQ ID NO: 46733 - protein, 40 aa, Zea mays
  misc_feature: Ceres CLONE 1452836-F
  misc_feature (11)..(11): Xaa is any aa, unknown, or other
  misc_feature (35)..(35): Xaa is any aa, unknown, or other
MASALSSLRYXDSLSVVGISARDGVLCEAHVWLLXLRTAN

SEQ ID NO: 46734 - DNA, 541 bp, Zea mays
  misc_feature: Ceres CLONE 1452837-F
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
aagctggagctccccgcggtggcggccgctctagaactagtggatcccccgggctgcaggaattcgcacgagaccattacctagaacatcctaatcgaaaagccttcgacgccccaaaccctagaccgacccctcctcctccacctgcgcgaccgcccaccatgagctccgccgccgcgccagcttccgtcggcagcggcaaggtagcttgccaacccgaccagctgacgggatcaccgaccctccgctttgctccaaacaaaaggaaaagaaaccttcccgcggcccccccccaaggggaaaaaggaaaagggggagggtttttttaaaaaacccaaaaaaccaaaccgggtcccgggggggaattcttggcccccccccgaggggggggggnnncctttaaaagtggggggtttccaaaagaaaccccccgggggggtttttacccccccgaaaaaaaaaaaccccccccccccgggggnnngggggggggggtgggttttttttcccccccccccaaaaaaaaaaaaaattttggggg

SEQ ID NO: 46735 - DNA, 818 bp, Zea mays
  misc_feature: Ceres CLONE 1452838-F
  misc_feature: Encodes the peptide sequence at SEQ ID NO. 46736
  misc_feature (1)..(1): n is a, c, t, g, unknown, or other
  misc_feature (2)..(2): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (352)..(352): n is a, c, t, g, unknown, or other
  misc_feature (411)..(411): n is a, c, t, g, unknown, or other
  misc_feature (413)..(413): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (461)..(461): n is a, c, t, g, unknown, or other
  misc_feature (492)..(492): n is a, c, t, g, unknown, or other
  misc_feature (518)..(518): n is a, c, t, g, unknown, or other
  misc_feature (519)..(519): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (529)..(529): n is a, c, t, g, unknown, or other
  misc_feature (543)..(543): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (555)..(555): n is a, c, t, g, unknown, or other
  misc_feature (559)..(559): n is a, c, t, g, unknown, or other
  misc_feature (561)..(561): n is a, c, t, g, unknown, or other
  misc_feature (562)..(562): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (575)..(575): n is a, c, t, g, unknown, or other
  misc_feature (576)..(576): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (583)..(583): n is a, c, t, g, unknown, or other
  misc_feature (586)..(586): n is a, c, t, g, unknown, or other
  misc_feature (589)..(589): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (600)..(600): n is a, c, t, g, unknown, or other
  misc_feature (603)..(603): n is a, c, t, g, unknown, or other
  misc_feature (606)..(606): n is a, c, t, g, unknown, or other
  misc_feature (607)..(607): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (617)..(617): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (634)..(634): n is a, c, t, g, unknown, or other
  misc_feature (635)..(635): n is a, c, t, g, unknown, or other
  misc_feature (637)..(637): n is a, c, t, g, unknown, or other
  misc_feature (639)..(639): n is a, c, t, g, unknown, or other
  misc_feature (644)..(644): n is a, c, t, g, unknown, or other
  misc_feature (645)..(645): n is a, c, t, g, unknown, or other
  misc_feature (649)..(649): n is a, c, t, g, unknown, or other
  misc_feature (662)..(662): n is a, c, t, g, unknown, or other
  misc_feature (672)..(672): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (702)..(702): n is a, c, t, g, unknown, or other
  misc_feature (705)..(705): n is a, c, t, g, unknown, or other
  misc_feature (706)..(706): n is a, c, t, g, unknown, or other
  misc_feature (709)..(709): n is a, c, t, g, unknown, or other
  misc_feature (733)..(733): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (751)..(751): n is a, c, t, g, unknown, or other
nnttgggttttttttttttttccccccctgtttnnnnnnnnttgtttnnnccaaactggagctccaccgcggtggcggccgctctagactagtggatcccccgggctgcaggaattcgcacgagaccattacctagaacatcctaatcgaaactctccatttcccttgctccctaccgtcgcggaggaagacaagacgcgcgcgcagaagcacacctgctcgggctagattaggaggacagcttcttcggtcggcgacatggcggaggaaaaggccgcgttccagtcggcgacggagtgggtggtcgacaacaggcttcgggccgccgggaccgctgtggctcagccggatngtcgggctcgttccctccaagtggcccagggcgggggatgaaaaccaagcgccaaaatnanacacgggccgggcctgccttgctnnnagggtctcaagggggggggggnttgggttggggttgttgtttttggggccccnccctggggggtgtgggggttgggggnnagggannngngggcggggcgccgngggggggnnnangccncnncccccnnncnncnntgnnnanccnatnaccnnnnnagngcngcnnggnnnnnngnccatcaaagnnnacccnngngnaaaanngccnccgttgggggccncgggggcccntagtnnnnnntgccccggatataaccctcncgnntgntggcccccccctctacgccccagnggttttaaccgggnnncnatagcccgtcgggtggtgtgtgcgccccctccctcacaaaaacacccccgaacgagaggccatgcgc

SEQ ID NO: 46736 - protein, 44 aa, Zea mays
  misc_feature: Ceres CLONE 1452838-F
  misc_feature (32)..(32): Xaa is any aa, unknown, or other
MAEEKAAFQSATEWVVDNRLRAAGTAVAQPDXRARSLQVAQGGG

SEQ ID NO: 46737 - DNA, 743 bp, Zea mays
  misc_feature: Ceres CLONE 1452850-F
  misc_feature (1)..(1): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
nttttcgtcgattcgtccctccttttttcccgccgggcatgcccttataacaaaaannnnnnnnnnatnnnaccgaattgggtaccgggccccccctcgagccactgcagtggtaaaggatagtataagagaaacggaagaggcacagcttatacccatccactgaccgcgaagtgcacagagggggggaaggaaggagacaccacccagatcgagttaccgtctgcgaggaggaaggagaagaggctgattcgatcgagcagcatggcgcggcggccacggccgtgtgcccacctgacggccacgctccttctgctcgccgtcgccgcggcggtcgccagagccgccgacggcgacgagaagtgcggcagcccgtgcgggaacccctgcggcaagccgtgcgtgaacacgagcccgccgccgccgccggtcctactacccggccgccgccccccgccccgtgtacttcgccacccgccgccccccggaaaaataaattcgcccgacaaaccccgaccccccaaccaacggcccttaatggccccgcccccccccccttcggggggggggggctaaacaagcccttttccccccggaaaaccccggccggggggaaccccaccccaaaccccccgcccgttccggggatccccgggtggggaacacccgccgcctctcgaacacaattcccccccggccggggggacaccgccctctaaccccggccggaggaaccccccccg

SEQ ID NO: 46738 - DNA, 727 bp, Zea mays
  misc_feature: Ceres CLONE 1452861-F2
cgattgggtccgggccccccctcgagccctgcagtggtaaaggaggcacaggcacccgagaagatggccggcgggtacctctccgacgggctcgtggacagggcgcaggcggataaggaagaagggcgttccgtggacggaggacgagcaccggcggttcctggcgggcctggacaaactcgggaagggcgactggcgaggcatctcccggcacttcgtcacgacgtggacgccgacgcaggtggtcagccacgcccagaagtacttcctccggcaaagcagcctggcgcacaagatgcgcaggtccagcctcttccacgtggtgaagaacgctgctgagagggcgacgacgactagctccagggagcgcccgaggctcagggtcacggatgcgataatcgccgaccgcctctgctgaagcaccccgaaacaacggcaaccactccccggccccggtcgctcggccatcccgacgggccagcggaggccctggacccccccgttttaaggtcgccgcttgcccttcaaaccaacccgggcccatggcagctgcccgcgggggcccccggcggccaatgggttaagggcgtgcgggcttacccccttccgcccaaaccctggggccattggcactttgggggggggcccaaaaaaaaaaaggaccccctttcgccctttctctcccctgaagaggcggggccaaaaggctttagtacaaaaccgggcc

SEQ ID NO: 46739 - DNA, 727 bp, Zea mays; identical to SEQ ID NO: 46738
  misc_feature: Ceres CLONE 1452861-F
  misc_feature: Encodes the peptide sequence at SEQ ID NO. 46740

SEQ ID NO: 46740 - protein, 112 aa, Zea mays
  misc_feature: Ceres CLONE 1452861-F
RLGPGPPSSPAVVKEAQAPEKMAGGYLSDGLVDRAQADKEEGRSVDGGRAPAVPGGPGQTREGRLARHLPALRHDVDADAGGQPRPEVLPPAKQPGAQDAQVQPLPRGEERC

SEQ ID NO: 46741 - DNA, 694 bp, Zea mays
  misc_feature: Ceres CLONE 1452866-F
  misc_feature: Encodes the peptide sequence at SEQ ID NO. 46742
  misc_feature (297)..(297): n is a, c, t, g, unknown, or other
  misc_feature (345)..(345): n is a, c, t, g, unknown, or other
  misc_feature (357)..(357): n is a, c, t, g, unknown, or other
  misc_feature (468)..(468): n is a, c, t, g, unknown, or other
  misc_feature (479)..(479): n is a, c, t, g, unknown, or other
cgattgggtacgggcccccctcgagcactgcagtggtaaagggtgtgggtgcgctttgctcctctccccgcgtgctctccctctctctcgcgcgcgcggcgacgactcggctagtcggctaccgccgccgccccctacgccagcttcccagctcttcgtcaggcccttctccgtcaacgagcacccagcacatatcctgagcccctccacacctcaacgatggcgggattcagaagccttgcacccaagaccaggaacctggtggtggctgggggcctgtcggccttcgtgctcggngtctactactacgccatgagagccgtgggaggcacggacgagctgcangtggcgatcgancagtttgacgagatgaagaagaaggacgctgccagaaactccagcacaggaggatcgtaaacgcggcgcccttctcgtctctgtactggaccctggatctgcaggctgacntgatacggtantctaagtcgctcaataaggccagaacctgcctgccctcaacggggaaaaaaaaaggggggaaaccctttatcaaaaaaaagctgggccctttgggttttagggagaaagggccctccggggggtttggccaaagaaaaaaaaagggggcgggagggcaaatttccccgaaaaaaagtgggggaaaggagaattttttgggaaaaaattttggcgg

SEQ ID NO: 46742 - protein, 65 aa, Zea mays
  misc_feature: Ceres CLONE 1452866-F
  misc_feature (42)..(42): Xaa is any aa, unknown, or other
  misc_feature (46)..(46): Xaa is any aa, unknown, or other
MAGFRSLAPKTRNLVVAGGLSAFVLGVYYYAMRAVGGTDELXVAIXQFDEMKKKDAARNSSTGGS

SEQ ID NO: 46743 - DNA, 640 bp, Zea mays
  misc_feature: Ceres CLONE 1452881-F
  misc_feature: Encodes the peptide sequence at SEQ ID NO. 46744
  misc_feature (640)..(640): n is a, c, t, g, unknown, or other
caattgggaccgggccccccctcgagccctgcagtggtaaaggtcttccctcgccacaaaaaccatctgctctgctctgctctctccctctgtcttcccttcctccttcccaggaactccattgcactatttccaccccaagaacacagcacagagtcggatccgaatccacaggagaggcagaagcacaactcactccccactccctccacccatcagctagccatgggcaaggactgcggcaaacacggcgacgacgacctccggcgctcgtgcaggcgcctgctagccatcctcgtggtcctcgcgctgaccgttggcgtcgtcgcgctgatcgtctacctggtgctccgccccacgcacccgcgcttctacctgcaggacgcgtcgctccggcagctggacctctccaacgccaccaccagcaccggcaccagcaccctgctctccaccgcgatccaggtgacgctagcgtcgcgcaacccgaacgagcgcgtcggggtctactacgaccgcctcgacgtgtacgcgtcgtacaagtaccagcagctcacggtggcggcgtcgctgccgcccgcgtaccagggccacggggacgtcggcgtctggtcgccggtgctggcgggtcccacgtgccctn

SEQ ID NO: 46744 - protein, 138 aa, Zea mays
  misc_feature: Ceres CLONE 1452881-F
  misc_feature (39)..(137): Pfam Name: Hin1 Pfam Description: Harpin-induced protein 1 (Hin1)
MGKDCGKHGDDDLRRSCRRLLAILVVLALTVGVVALIVYLVLRPTHPRFYLQDASLRQLDLSNATTSTGTSTLLSTAIQVTLASRNPNERVGVYYDRLDVYASYKYQQLTVAASLPPAYQGHGDVGVWSPVLAGPTCP

SEQ ID NO: 46745 - DNA, 684 bp, Zea mays
  misc_feature: Ceres CLONE 1452882-F
  misc_feature: Encodes the peptide sequence at SEQ ID NO. 46746
  misc_feature (409)..(409): n is a, c, t, g, unknown, or other
  misc_feature (684)..(684): n is a, c, t, g, unknown, or other
cgattgggtccgggcccccctcgagccctgcagtggtaaagggagactctgccctgaccacagcaaacaacctcctctttcctttccatccatcggaccatcgatcacaattttcatggcggtcaaggactgcggcgggcacaagggctgcgagtgcgagcgggagcggctgtaccggcggtgctgcgcggcggtcgtggctctgatcctcctggtcctcttcatcgtgctcgtcgtgtggctggtgctgcacccccacaagccccggttctacctgcaggacctgtcggtgctgtgcctgaacgtgacgccgccggcgtccacgtacttgttcacgacgatgcaggcgacggtggcggcgcgcaacccgaacgagcgcgtgggcgtgtactacgaccaggggggaggngtacgggaagtacaagggcggggccgatcacggtgcccgacgcggttgccccgtggagtaccagggggccccgggacgcgtcccggggggccccggttccttggcgcccccggaagggcggggtgcatcttccccccgcaacttggcccgtgggctctgggcccaaggacaagaacgggggggctaagtgggttcgttcaaacgtccgccgtccaccggtttgggtccccctgggaagaggcgcgaccccagctgggattttcgggtcacttccn

SEQ ID NO: 46746 - protein, 189 aa, Zea mays
  misc_feature: Ceres CLONE 1452882-F
  misc_feature (42)..(173): Pfam Name: Hin1 Pfam Description: Harpin-induced protein 1 (Hin1)
MAVKDCGGHKGCECERERLYRRCCAAVVALILLVLFIVLVVWLVLHPHKPRFYLQDLSVLCLNVTPPASTYLFTTMQATVAARNPNERVGVYYDQGGGVREVQGRGRSRCPTRLPRGVPGGPGTRPGGPRFLGAPGRAGCIFPPQLGPWALGPRTRTGGLSGFVQTSAVHRFGSPWEEARPQLGFSGHF

SEQ ID NO: 46747 - DNA, 668 bp, Zea mays
  misc_feature: Ceres CLONE 1452891-F
caattgggtaccgggccccccctcgagcactgcagtggtaaaggaggggttctttgtgctttcgaaagattctgcaggaaaatcgactgcatttgttgttcttgggtacacaatgaaagatgggaaggcatattttcccccacatgacagtatctatacatattgcagttgaaatggaaataattgaaatacaaggtatgtgcaggtgcagtctattatattggagttaaaagagcgctagcttgcagtcacactcgatgaagtcctatagggctagattttaaaaatttagatggctactatcctttgcaattgatcaaaaatggtgagctattctaaggaggcttctgaacaaaatacctgttgtcctggaagtgtcacagatgggaaaaatttgcgcttagagaaaggaagaaaaacgccccgggctagagtcatctccaaaagttcttaactgatcagtttccactttcttctctgtagtctgggtgcaactgtttgagaaatttgaaggggtataaaatctttcaagcaaacttgttaaaaacatttgcccccgatcaagaagggatggctccttaatggcacccttggggggtaatctccggtaaaatcggtggctcacaccccccacctcaaaatcttaatcccttgggcccgggaaaaac

SEQ ID NO: 46748 - DNA, 673 bp, Zea mays
  misc_feature: Ceres CLONE 1452892-F
cgattgggtaccgggccccccctcgagccactgcagtggtaaaggaggtcatcagttacatctcgttctcctcccagatctccgcaacgtagtggaaacctgaggctcaggtggagaaattgcttcctccgctgctctctgacagggacacgatgatccttatggttggtctggatgcaactagtcaacactgcatcctctaatcgctcttgatcacagatagtcatgtcgacgttccctaccatctgattaatggtgaatactggtgaataatagaacgttaccatcactgcttcggagtgttgaagtctgaactagatcatgccatcgctgaggccatatttctatatgcccgaggactaatctatgccgactataggcatggaaaaagaatgggtttttattgccaggatgtactccccacgatgatcttccacgtatgaataattgattgcctcatgcacggtttctcaaccacttagatatacgttatgcgatcatggctgctgaaatccccgaaaaggttgtgtttcattttctggccccaaccctttaggatatccagaagcatttcttctaccaaaggactaaggttccacggatgttcttgatttgattttcgaaaaaattttttaagggggatttaagggccatttcctgcgggggggggtag

SEQ ID NO: 46749 - DNA, 708 bp, Zea mays
  misc_feature: Ceres CLONE 1452896-F
  misc_feature: Encodes the peptide sequence at SEQ ID NO. 46750
  misc_feature (405)..(405): n is a, c, t, g, unknown, or other
  misc_feature (439)..(439): n is a, c, t, g, unknown, or other
  misc_feature (445)..(445): n is a, c, t, g, unknown, or other
  misc_feature (446)..(446): n is a, c, t, g, unknown, or other
  misc_feature (525)..(525): n is a, c, t, g, unknown, or other
  misc_feature (571)..(571): n is a, c, t, g, unknown, or other
ccccgcggtggcggccgctctagaactagtggatcccccgggctgcaggaattcgcacgagaccattacctagaacatcctaatcgaaaatagcatagtcatcttcttcatcgacaagcaggggagttatgtctcacatgcatgctccatcacattgttgactgcataacgaaccacatcgtcatcggatcggagatgatgagttccgtcatcgtggatgctgctgctaccaccagcagccagaacaagacttcgtggccggaggtggtgggtatgtccatcacggaggcgacggaaactattctccgggatatgcccaacgcgtacatccaggtgctgcctgttgggtcgcctgtgagactaaatacttcgctcggaccgcttgcgtattttcggtgccacccncccactgactccgaaggtcggggtgatcctaccncatgtnncaatcaacccctaccttttcatttaatgtttccagtgaataataggccggaacttaacttcatgggggaccttccttgnctggtgttagcgtccaggcgatttctaccccttctattaaaagcanaaccacaggtatgctaatcccctggaacaaaggggatcccttatggaaatactttcctcttcaataagccaattttcacaccacacaaaaataaaaggttttttccaatccctttttaaccatgcgaggggaggggt

SEQ ID NO: 46750 - protein, 148 aa, Zea mays
  misc_feature: Ceres CLONE 1452896-F
  misc_feature (36)..(82): Pfam Name: potato_inhibit Pfam Description: Potato inhibitor I family
  misc_feature (100)..(100): Xaa is any aa, unknown, or other
  misc_feature (102)..(102): Xaa is any aa, unknown, or other
  misc_feature (128)..(128): Xaa is any aa, unknown, or other
  misc_feature (144)..(144): Xaa is any aa, unknown, or other
MLHHIVDCITNHIVIGSEMMSSVIVDAAATTSSQNKTSWPEVVGMSITEATETILRDMPNAYIQVLPVGSPVRLNTSLGPLAYFRCHPPTDSEGRGDPTXCXNQPLPFHLMFPVNNRPELNFMGDLPXLVLASRRFLPLLLKAXPQVC

SEQ ID NO: 46751 - DNA, 703 bp, Zea mays
  misc_feature: Ceres CLONE 1452907-F
  misc_feature: Encodes the peptide sequence at SEQ ID NO. 46752
  misc_feature (515)..(515): n is a, c, t, g, unknown, or other
ggagctccccgcggtggcggccgctctagaactagtggatcccccgggctgcaggaattcgcacgagaccattacctagaacatcctaatcgaaaaaaaaaatcccagacgccacgccacccaacacatacaaacacacgcacgcgcgcgcgcgcgcctcccgctgttccgcaaaacaaaggaaacgaaggagaggaggccatggcgccgagaacgtcaaagaaaaccatggcaccggcggcggccgctgccacggggctcgcgctcagcgtcggcggcagcggcggggccggcggcccgcactacagaggcgtgaggaagcggccgtggggccggtacgcggcggagatccgcgacccggcgaaaagaagcgggtgtggctcggcacctacgacacggccgaggacgccgcgcgggcctacgacgccgccgcgcgcgagtaccgcggcgccaagggcaagaccaacttccttacccctcgggcgtgcccctctccgcagccggttgccggacancaaaacagcaccgtcgagtctttaaaaagaaacccagggcccatggagccatgcccctcccccctccctcaatgggactggtcccccggggggggcccggccaagggaaggggcgcccccccaaacttcctttttgggaaccccctttaccccccaaaaatttttgggggggcccacccccccccgga

SEQ ID NO: 46752 - protein, 112 aa, Zea mays
  misc_feature: Ceres CLONE 1452907-F
  misc_feature (105)..(105): Xaa is any aa, unknown, or other
MAPRTSKKTMAPAAAAATGLALSVGGSGGAGGPHYRGVRKRPWGRYAAEIRDPAKRSGCGSAPTTRPRTPRGPTTPPRASTAAPRARPTSLPLGRAPLRSRLPDXKTAPSSL

SEQ ID NO: 46753 - DNA, 716 bp, Zea mays
  misc_feature: Ceres CLONE 1452909-F
  misc_feature: Encodes the peptide sequence at SEQ ID NO. 46754
  misc_feature (365)..(365): n is a, c, t, g, unknown, or other
  misc_feature (379)..(379): n is a, c, t, g, unknown, or other
  misc_feature (384)..(384): n is a, c, t, g, unknown, or other
  misc_feature (386)..(386): n is a, c, t, g, unknown, or other
  misc_feature (387)..(387): n is a, c, t, g, unknown, or other
aaagctggagctccccgcggtggcggccgctctagaactagtggatcccccgggctgcaggaattcgcacgagaccattacctagaacatcctaatcgaaaaatcagattgggagactcactcactcgggagtcgggtcctcctcgactcagctcctccacaaacaaagccaccaccatcccaacccaaacacatcggccgaccacgggcgccgccatgtccaccgctgacgcggcgagcccggccctggcgccggactgggacgcgccggcgggcgaaggcctggccctggcccagttcgccgcgggctgcttctggagcgtggagctggtgtaccagcgcctcccaggcgtggcgcgcacggnagtggggtactcgnagggncnnacgcacgcccccacttaacgggacgtctgcggcaacggcacggggcacgccaagtgggtcgggtggattaagacccccaggctgcccctagaagtctttctcgaggcttttggggccaagacaaccccccatttttaaaaaaagggcaacgacctcgggacccataccgatggggtttttccactaccccaaaaaaccgggaaacttgggcggcgaaacctttgggggaaaaaaaaaggggggggagggccccccttctcccagggctccggggggggggggtttttccccccgcaagagaaaccccccggcctcccccggagaggggg

SEQ ID NO: 46754 - protein, 62 aa, Zea mays
  misc_feature: Ceres CLONE 1452909-F
  misc_feature: SWISSPROT Homolog: EC 1.8.4.11 Peptide-methionine-(S)-S-oxide reductase
  misc_feature (50)..(50): Xaa is any aa, unknown, or other
  misc_feature (55)..(55): Xaa is any aa, unknown, or other
  misc_feature (57)..(57): Xaa is any aa, unknown, or other
MSTADAASPALAPDWDAPAGEGLALAQFAAGCFWSVELVYQRLPGVARTXVGYSXGXTHAPT

SEQ ID NO: 46755 - DNA, 685 bp, Zea mays
  misc_feature: Ceres CLONE 1452912-F
  misc_feature (389)..(389): n is a, c, t, g, unknown, or other
  misc_feature (390)..(390): n is a, c, t, g, unknown, or other
  misc_feature (441)..(441): n is a, c, t, g, unknown, or other
  misc_feature (452)..(452): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaatgcctaggcgtgaggcgtatcgtcttcgacccttcgccttcctcgtccctttctctctcccagattctgactccgtcgggctcccccgtgtctgtgtcttggtaaacatcggtctctccccatcccacctggcagttgccatctcgcaaagtcgcaataacttgtcttctcgaatcggctgcaaccccaccccagaccccaccgccgccgccgctagggttttggggtgaggatcgccgatgtcgacggctccccagcgtcccttccgagggcgcgcgcatgtccnntcggcacggctacgtccgccgcggccccgcccaggggctcgcgacgccgcnagcccctgcgncagccgtcttcacaccgtcgacagcttcgccccagacccacgtcaactctcaagcccggtattgcgtcgcacgtcctaaaagccgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 46756 - DNA, 690 bp, Zea mays
  misc_feature: Ceres CLONE 1452916-F
  misc_feature: Encodes the peptide sequence at SEQ ID NO. 46757
aaagctggagctccccgcggtggcggccgctctagaactagtggatcccccgggctgcaggaattcgcacgagaccattacctagaacatcctaatcgaaaaatttcatttaccacaccctgctctcgctcttgttgtgacggtcgattcgcttgtacaagtgaccacccttccgctcccttctcacctatagctagcaaccttgagatccagccaagatccagccatgagggagattctccacatccagggtggacagtgcggcaaccagatcggttccaagttctgggaggtcgtctgcgacgagcatggtatcgaccccaccggacgctatgtcggcacctccgacctccagctcgagcgcgtcaatgtctactacaacgaggcctcatgcggccgcttcgtgccgcgcgccgtgctcatggacctcgagcccggcaccatggacagcgtccgcaccgggccgtacggacagatcttccggcccgacaactttgtcttcggccagtctggcgcagggaacaactgggccaagggccactacacagagggcgctgagctcatcgactctgtgcttgacgtcgtgaggaaagaggcggagaactgcgactgccttcaaggattccaagtttgccattcccttggaggaggcacaggatctggaatgggcacccttctcatctcaagatt

SEQ ID NO: 46757 - protein, 154 aa, Zea mays
  misc_feature: Ceres CLONE 1452916-F
  misc_feature (45)..(154): Pfam Name: Tubulin Pfam Description: Tubulin/FtsZ family, GTPase domain
MREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISR

SEQ ID NO: 46758 - DNA, 889 bp, Zea mays
  misc_feature: Ceres CLONE 1452917-R
  misc_feature: Encodes the peptide sequence at SEQ ID NO. 46759
  misc_feature (889)..(889): n is a, c, t, g, unknown, or other
cgattgggtaccgggccccccctcgaggtcgacggtatcgataagcttttttttttttttttttgtgggaaaaatcgaccgacgtgtgtgcgaaaaaatatttcttttttttcattgaacaaatgaaagaatccaccagggtcccgggtcactacactactaaaatcgtcagccgggggaaacattttccacgcaaagcacccgcccccacaaaacactgattacaaccagcaaattctaaaccaagggggcgcacaacaacttgtccgggtcaacaagccccgggaccaggtacttcctcccgggggccccgttggctttaaacctggcccccctggcctggtctaccagaagcaagcccgcgtagccggggtacccccccttgccatacacgccggcccacaccggggcggcctccaggggcccgtcggccaacccctcctggaaaaaaaacccattgtcaaacgggttggtaaccgtgccaacaagtttggacccccccgagataaccatgccgtcaaccccaacttccccattgggcggggtgaggggcccccccggcgggccaaacacgggctggaggaacgaccacgcccactgcccggggcactgcaacaccgggttgccaacccacgcttacgctaaccggccggagggggaccgcgggaacgcggccgtgcgtgctccaccgggactcaaaaaacccgtccacggccaatttgggcggccgtagacaccaagttaatgcgcccgccttcggggctccccgggcgggaaactctaaacaggtccctttcccttcaggcccctgccaagggagaattttccgtccaaccggatgggaaaccaaaagctctatggccgggaaacgcacctttggaacttgccn

SEQ ID NO: 46759 - protein, 73 aa, Zea mays
  misc_feature: Ceres CLONE 1452917-R
MPSTPTSPLGGVRGPPGGPNTGWRNDHAHCPGHCNTGLPTHAYANRPEGDRGNAAVRAPPGLKKPVHGQFGRP

SEQ ID NO: 46760 - DNA, 694 bp, Zea mays
  misc_feature: Ceres CLONE 1452924-F
  misc_feature: Translation starting site: 154
tggagctccccgcggtggcggccgctctagaactagtggatcccccgggctgcaggaattcgcacgagaccattaccaaaacatcctaatccaaaaaacaccaccaaatcttttatcatcctttccataggggtcccccacgaactactaaacatggcaaaagtgttgagcctgttcttagccctctcctttgtaacagctatgtttgccataggctctcatgctgatggagactgtaaaaatgacctccaaagcctgataagagactgacaagacatacgtgatgttcccagctaatccaaaggtccctccatctgatgcatgctgtggtgtcatcaagaacgcaaacgtttcttgctagtgctccaatgtcaccacacacactgacaatgttgtgtgaatgcagaaggctgtgtatgttgctgaccagtgtaacaggccatttgaggttggctacgagtgcggacgctacaacgtttctaccaaatgatgatatcgcaagaaggctgcgccttgacaaaatctttagatttcaattgtagcagccgatcgacctctctaagtgttggataaaacgaagaccagggtgaaactaaatgtgagggggggaaaggcctatttgaggctcccaaaattttctggcctgttaatgaaagccttccccccagattttaaaaaaaaaaaaaaaaaaaaa

SEQ ID NO: 46761 - DNA, 717 bp, Zea mays
  misc_feature: Ceres CLONE 1452925-F
  misc_feature: Translation starting site: 113
  misc_feature: SWISSPROT Homolog: EC 3.1.3.16 Phosphoprotein phosphatase
  misc_feature (576)..(576): n is a, c, t, g, unknown, or other
  misc_feature (666)..(666): n is a, c, t, g, unknown, or other
acccgcggtggcggccgctctagaactagtggatcccccgggctgcaggaattcgcacgagaccattacctagaacatcctaatcgaaaaattttggggggtgaccgtctgtatgttgcaaatgttggtgattctcgagctgttatttcaaacgctggcacagctttggcactttcggaatatcacaaacctaacgggatctgatgagcgaaagagaatagaagaggctggtggtattgtcatttgcgctgggacttggagggtaggtggggtattggagatgtctcatgcatttggcactcgcttactgaagccatatgtggcggcggaacctggaaattcacgaagaacagttcagagatgagatggaatgcctcattttcgctactgacgggttttgggacccccccacaatgacgaagccgtttcccttggtaaatcaaaggacacgccacagtctgcaactcggaactgtgacgaaatcgcttattctcgtggcaactctcaccatatcacgtggatggtcggtcattttccccatgcccccaccggaggaaccccgcggcgcaccaattncaggatgaacccatgcttcaaggttattacttatccggcacccccgggggctgggggctttgtcttagatttcagccgtcccttgaaggnaattttcccaggaactcccccccacgtggttttcttttgggggcgcctgga

SEQ ID NO: 46762 - DNA, 691 bp, Zea mays
  misc_feature: Ceres CLONE 1452926-F
  misc_feature: Encodes the peptide sequence at SEQ ID NO. 46763
aagctggagctccccgcggtggcggccgctctagaactagtggatcccccgggctgcaggaattcgcacgagaccattacctagaacatcctaatcgaaaaatcaacacacacaggtctcagatcacgacccctcaaaaaacgaacaagcatcgccacagtttcttcgctaccgcgggttgattacctcaaccgacccagagattacaaatcaatatcttctctccagaaaattgggaacaagaaggggaggagatggctggtccacctaaggcttcatggatggtggcgatgggcgtgggctccatgtacgccctcaaggaccatgccgggctctgcccctggaactatgccctcagggctatccatcggacagccaagggaaaggttaacgtccgcggggggggcggcctccctcaaggcaacaaccaggttccgacctcggcggcggcagtgacggagaggcaggcgagcacacaaggcctaggaggggctgaggacggtcatgtacctcagctgctggggcccaaactaggagtacaatactagctagaggtgttgtgttcgtaggagcacagtatgcacccaagggctgaaagctgcctgattgccctttccccaccgtagtaagataccacggtgatgaggatggtgatgatgatgaaagtatcagcctcaatttacgactgtat

SEQ ID NO: 46763 - protein, 97 aa, Zea mays
  misc_feature: Ceres CLONE 1452926-F
MAGPPKASWMVAMGVGSMYALKDHAGLCPWNYALRAIHRTAKGKVNVRGGGGLPQGNNQVPTSAAAVTERQASTQGLGGAEDGHVPQLLGPKLGVQY

SEQ ID NO: 46764 - DNA, 720 bp, Zea mays
  misc_feature: Ceres CLONE 1452934-F
  misc_feature (173)..(173): n is a, c, t, g, unknown, or other
  misc_feature (176)..(176): n is a, c, t, g, unknown, or other
  misc_feature (181)..(181): n is a, c, t, g, unknown, or other
  misc_feature (378)..(378): n is a, c, t, g, unknown, or other
  misc_feature (487)..(487): n is a, c, t, g, unknown, or other
  misc_feature (532)..(532): n is a, c, t, g, unknown, or other
  misc_feature (545)..(545): n is a, c, t, g, unknown, or other
  misc_feature (560)..(560): n is a, c, t, g, unknown, or other
  misc_feature (576)..(576): n is a, c, t, g, unknown, or other
  misc_feature (633)..(633): n is a, c, t, g, unknown, or other
  misc_feature (654)..(654): n is a, c, t, g, unknown, or other
agagctggagctcaccgcggtggcggccgctctagaactagtggatcccccgggctgcaggaattcgcacgagaccattacctagaacatcctaatcgaaaaacaatgcgccgcgctgccgcgatcctcctgtccctcgccctcgcagccgccgcaaccaccacggcggcggntgncgtgncgaaggctcgggggccggcgcaagcgcggcggattggtttaagagtaggatgtggaagggaatggggtcgtgggaaggcctgcagcccgggggatcaactagttccagagcggccgacacgggggtggagcccaagcgtatgtacccttagcgggggcgctgaaaggcaagggaggtggtggtgatattgaggaacnagaacgggaacccggaactaggacagcttgatgaaaccccgaaaggcccccttcatgacctcgggaagctcgccgaggggagccattacaaagagaagctgacagaggncacctccatggggaggaaggacgtggccgtccgagttcgaagggntgaaacgggggcnaagaagaaccggcgntagggcacgctggggnataacgaaggagactggggctgggctttcagtaagaaggcccggagagagggccccntggatggatcccctaggggangcaaacttataaatccaagcaagaggaaagggaaaaaaactcgggcttagcaagcaaaagaggaga

SEQ ID NO: 46765 - DNA, 757 bp, Zea mays
  misc_feature: Ceres CLONE 1452935-F
  misc_feature (324)..(324): n is a, c, t, g, unknown, or other
  misc_feature (347)..(347): n is a, c, t, g, unknown, or other
  misc_feature (403)..(403): n is a, c, t, g, unknown, or other
aaagctggagctccccgcggtggcggccgctctagaactagtggatcccccgggctgcaggaattcgcacgagaccattacctagaacatcctaatcgaaaaacagcccaacatttcaaggcccaggtccatcgaccgcctggcctcctctccctacccctacgggtccagtggccactgcctcttgccgcaggcagccctcttctctcttccgccgtctcgcctcctcacgccattaaaccccactcgcgcgcgcggcggccggcggcgagccctcacccatccgagcaagccgaggaagaagcgagcgcgcgaaagtatcanggagaagcatgggtaccctgggncgcgcgatcttcacggtgggcaagtgaatccggggcacggggcaggccatggaccngctccgaatcacaatccagggcgggctccggcgtcaggaaacagggttcaaggcttccaaacatcttgaatattttttgaaaaaaacccagggatccttaaaagaggtgttttgttgcccccagggcaaacacctttgggaaatttaaaaaagggccaggagaacccaaaccgggggacggccccctttgggggggggggggccccccctcttcttttgggggcgggggtcaaaaaaaaaaaaaaaatctcctttggtggttgttaaaaaaaaaaatttggggggggggcccccccccaatttttaagaaaaccccgcgagggggggcccacgtggtttttaaacaggtgttca

SEQ ID NO: 46766 - DNA, 699 bp, Zea mays
  misc_feature: Ceres CLONE 1452940-F
  misc_feature: Translation starting site: 164
  misc_feature: SWISSPROT Homolog: EC 3.1.27.1 Ribonuclease T(2)
tggagctccccgcggtggcggccgctctagaactagtggatcccccgggctgcaggaattcgcacgagaccattacctagaacatcctaatcgaaaaatagttggggtacagttgtactgctctgagctgccggaggctcaataggagaggcacgtgatgacgatggcgaccaacgcggcctgcgtgctggcggcgtgggtgctcgtcgcatcgggcctgtccgacctgggctcagcgcgcgcgcccctgggcagcaagccgcaccgagagttcaactacttcgcgctctccctccagtggcccggaaccatctgcgcctccacccgccactgctgcgccaccaacggatgctgccgctcggagcctctccagacgttcacgatcctcggcctatggtcggactacccccaccggacctggccgtcgagctgcgcgccgctccccgttccagatggccaagatatcgccactgacggatgtgcttgacaagtactggccgaccctctactgctcctagtctggaacatgcttcagcgacaagggactcttctggactcaccaggggtagaaacatggtacctgctctgccccagaggatcgggatgaattacaggatttcactcttgcccttgacctctacttccagtataccgctagggaaatgctgacgagtggatggatacccgtttcaaatggta

SEQ ID NO: 46767 - DNA, 584 bp, Zea mays
  misc_feature: Ceres CLONE 1452963-F
  misc_feature: Encodes the peptide sequence at SEQ ID NO. 46768
  misc_feature (158)..(158): n is a, c, t, g, unknown, or other
ctccccgcggtggcggccgctctagaactagtggatcccccgggctgcaggaattcgcacgagaccattacctagaacatcctaatcgaaaatgatattttagtcgtactcgtacagaagccacagccctctgctaacctagctcctgctagaatggnaagtgcagggagggaagctcgggcggtgctgccgccgccgccccccccgtgcaaagacttggcgggccaaccaacgacgggccctttccggacttccggggggcaggaaaaaaaccagggtcgggtaccgggcgggccccgttattaacccccttggcttggcccccggggggggggggccaaaaaacccaaaaccccggggggcccaaacccggggtttcttcggggaaaccacccgggggggggccctcttttgggacccttttggggcccccggggggttttttttggcccccccccaaaaaaaaaaaaaacccttgttttgggtgggggccccctccccccctcaagagaaaaaaaacgcgggggggggaaaaaaaaaaccggggggggggggggccccccctctctttttttggggggggg

SEQ ID NO: 46768 - protein, 50 aa, Zea mays
  misc_feature: Ceres CLONE 1452963-F
  misc_feature (2)..(2): Xaa is any aa, unknown, or other
MXSAGREARAVLPPPPPPCKDLAGQPTTGPFRTSGGQEKNQGRVPGGPRY

SEQ ID NO: 46769 - DNA, 678 bp, Zea mays
  misc_feature: Ceres CLONE 1452965-F
  misc_feature: Encodes the peptide sequence at SEQ ID NO. 46770
  misc_feature (655)..(655): n is a, c, t, g, unknown, or other
ctggagctccccgcggtggcggccgctctagaactagtggatcccccgggctgcaggaattcgcacgagaccattacctagaacatcctaatcgaaaaatacatactgcgcgttgcaagctcccacttcctgaggaacaggaactccatgagatccgcggcatccgccgtcccgttcatctgcacaaaaagaccgtaatccttctttttcctctcctccccatccgcggagtgtaaatcgtctctcgctagcgcgttcagtagaaaccctaaaccccgcctcctcccctcgccggggtaggggctacgggtgtcaacgcccgccatggacgcattccggaagcaactggatgtgctcatgggcgctaaccgcaacggcgacgtctaggaggtgagccgcaactactacgaccgcgacgtctgccggctcttcctcgccggtctttgcccccacgacctcttccagctcacgaaaatggatcttggaccttgttctaagattcactcgcttcagctgcggaaagattatgaagaaacgaaagcaaagggaacagagaattttgacagagaactcgaggatatgatagaaaggctcattgtggagtgcgactggaaaattcagagggccctgacacgacttgcggatgacgatgccnaggctgctattgcgatatccgtc

SEQ ID NO: 46770 - protein, 68 aa, Zea mays
  misc_feature: Ceres CLONE 1452965-F
  misc_feature (61)..(61): Xaa is any aa, unknown, or other
MDLGPCSKIHSLQLRKDYEETKAKGTENFDRELEDMIERLIVECDWKIQRALTRLADDDAXAAIAISV

SEQ ID NO: 46771 - DNA, 690 bp, Zea mays
  misc_feature: Ceres CLONE 1452971-F
  misc_feature: Encodes the peptide sequence at SEQ ID NO. 46772
  misc_feature (690)..(690): n is a, c, t, g, unknown, or other
aaagctggagctccccgcggtggcggccgctctagaactagtggatcccccgggctgcaggaattcgcacgagaccattacctagaacatcctaatcgaaaaaaccgtcgcccccctttctctctcgctcaaaagttgctgctggagccatctcccctctctccgacccccaacaatggatgaggcgcaagttgtggagtcaaaggatggaaccatctcggttgcttctgcatttgctggttttcaggaagctgtgcaagacaaggatcacaaattcttgacaaaagcagtggaagaagcatatcgaggagtcgattgcggtgacggaggtccatttggagcagttgtcgtccgtaatgacgaagtagtagttagctgccataacatggttctaaagcacactgaccctactgcgcatgctgaagtaactgcaattagagaggcttgcaaaaaacttgggaaaattgagctctctgactgcgaaatttacgcgtcttgcgagccatgcccaatgtgctttggtgcagttcatctctcccgaatcaagaggctggtttatggggccaaagcaaaagctgccctcgccattggatttgatgacttcatcgcagatgctctgagagggactgggttctaccaaaaagccaacttggagatcaagaaagctgacggcaatgttgcattgatccn

SEQ ID NO: 46772 - protein, 171 aa, Zea mays
  misc_feature: Ceres CLONE 1452971-F
  misc_feature (28)..(130): Pfam Name: dCMP_cyt_deam_1 Pfam Description: Cytidine and deoxycytidylate deaminase zinc-binding region
  misc_feature: SWISSPROT Homolog: EC 3.5.4.3 Guanine deaminase
MDEAQVVESKDGTISVASAFAGFQEAVQDKDHKFLTKAVEEAYRGVDCGDGGPFGAVVVRNDEVVVSCHNMVLKHTDPTAHAEVTAIREACKKLGKIELSDCEIYASCEPCPMCFGAVHLSRIKRLVYGAKAKAALAIGFDDFIADALRGTGFYQKANLEIKKADGNVALI

SEQ ID NO: 46773 - DNA, 659 bp, Zea mays
  misc_feature: Ceres CLONE 1452973-F
  misc_feature: Encodes the peptide sequence at SEQ ID NO. 46774
aagctggagctccccgcggtggcggccgctctagaactagtggatcccccgggctgcaggaattcgcacgagaccattacctagaacatcctaatcgaaaaaaaccctaaacccctctgatctccctctcgcgccgccgccaccatgtcgccgccgcagccaccacacccggtgccccgagagacggtggccagcgctgtcgcttccctgacaacgtggatgaagaagcgcgctgcggaggcgcgcccgaacctcctcgccgacgagcgcgacgacatcgtggtcctccagctctcgctacgccgcatccccgcctcgcgcagcaccaagccgcgcctcctcccgatgccacatcccgttgttgggcacgacggcgcctccgtctgcgtcatctcggacgaccgcaccaagtcgcggtccccttccgcctccgacctccacgcgtccatgtcgctccaccgtttccccgtctccgaggtcatcccgctctctacgctccgcacggattaccgcccgtacgagtctcggcgccgtctcgcagcctcccacgacctcttcgtcgccgaccgcgccatcctccccctgctgccgcgcgtcctcgggaaagcgttctactccaccaagaaggctccgattggagtcaatttccccgcatcggt

SEQ ID NO: 46774 - protein, 171 aa, Zea mays
  misc_feature: Ceres CLONE 1452973-F
MSPPQPPHPVPRETVASAVASLTTWMKKRAAEARPNLLADERDDIVVLQLSLRRIPASRSTKPRLLPMPHPVVGHDGASVCVISDDRTKSRSPSASDLHASMSLHRFPVSEVIPLSTLRTDYRPYESRRRLAASHDLFVADRAILPLLPRVLGKAFYSTKKAPIGVNFPAS

SEQ ID NO: 46775 - DNA, 652 bp, Zea mays
  misc_feature: Ceres CLONE 1452978-F
tccccgcggtggcggccgctctagaactagtggatcccccgggctgcaggaattcgcacgagaccattacctagaacatcctaatcgaaaaaagaacttcaatcgtccaacataagcaggagtcgcatcccagatccccccgcattagagacaggcagggagggaaccgagatccatccatccgagtcgatggagtcaacggtggagcgtataagctcgtcggtgcagtcctaggtgaagggcgacgagctcgcagccatcagttcacacaaagagacgcagtcacgcaagaaacaacttcatgacaggatgatcttgcatttgtcaaattcaactctcgtctcgaacagaggagggagaacaagataaagggaccatttaaaaaccaatcgctaatattcctgacccccacgaaatgaatggatcactggtattgtgcccaatgctttaccagaaaagcacccggagggtggtacaagttggagcaagagcatcctcgtcccagggagaagccatacaaaacagagggaagagaagtacccagcttaaaaagaagaaggatgttgattccttacgatgaagaaatgaattcaactgcttcctctcccgattcagaaaatgagggatcccctttttggacttgcatttacca

SEQ ID NO: 46776 - DNA, 650 bp, Zea mays
  misc_feature: Ceres CLONE 1452979-F
  misc_feature: Encodes the peptide sequence at SEQ ID NO. 46777
  misc_feature (612)..(612): n is a, c, t, g, unknown, or other
ggagctccccgcggtggcggccgctctagaactagtggatcccccgggctgcaggaattcgcacgagaccattacctagaacatcctaatcgaaaagataaaaaggcgtaaaagccatcgccactctttccccatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctctccgcgctccacatcgccgccgcgaatggccgcctcgaggtgctgtcaatggtcttggatcacggggtgccgccggacgtggtgaatcggcacaagcagacgccgctgatgctcgcggcgatgcacggcaagaccgactgcgtgctgaagctcctgcangccggcgccaatatcctcatgttcgactcccagcacgg

SEQ ID NO: 46777 - protein, 113 aa, Zea mays
  misc_feature: Ceres CLONE 1452979-F
  misc_feature (79)..(111): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.7.11.1 Non-specific serine/threonine protein kinase
  misc_feature (101)..(101): Xaa is any aa, unknown, or other
MGHGVSCARTGDEHDYFRAAQVGDLEALEALLDADPSLARRATLYDRLSALHIAAANGRLEVLSMVLDHGVPPDVVNRHKQTPLMLAAMHGKTDCVLKLLXAGANILMFDSQH

SEQ ID NO: 46778 - DNA, 628 bp, Zea mays
  misc_feature: Ceres CLONE 1452997-F
  misc_feature: Encodes the peptide sequence at SEQ ID NO. 46779
  misc_feature (372)..(372): n is a, c, t, g, unknown, or other
  misc_feature (428)..(428): n is a, c, t, g, unknown, or other
tggagctccccgcggtggcggccgctctagaactagtggatcccccgggctgcaggaattcgcacgagaccattacctagaacatcctaatcgaaaaatccactcccaagtcccaacacccgtcggcgtcgagcagcggcggcgatgacgacgagcctgaagaagaaccggaagaagcgcgggcacgtgtcggcggggcacggccgcatcggcaagcaccggaagcacccgggaggccgcggcaacgccggcggcatgcaccaccaccgcatcctcttcgacaagtaccacccgggctacttcggcaaggtgggcatgcgctacttccacaggctccgcaacaagttccactgcccgtcggtcaacctgaanaggctctggtcgatggttcccgcccggcaggccgcggaagcggtcggcgcggacangcccgctcgcgacgtgacgagttcgctacttcaggtgctcggcaggggatgcttgcgtccaggccatcgtcgtcaggccaagctcatctccaagtccgcaaaaaaaaatcaggctgccgggaagcgcctcctgctgaccgcttaggccctttggcatctggttcaactatctgcgcaaaaaaatttcctatctttttggg

SEQ ID NO: 46779 - protein, 142 aa, Zea mays
  misc_feature: Ceres CLONE 1452997-F
  misc_feature (76)..(76): Xaa is any aa, unknown, or other
  misc_feature (95)..(95): Xaa is any aa, unknown, or other
MTTSLKKNRKKRGHVSAGHGRIGKHRKHPGGRGNAGGMHHHRILFDKYHPGYFGKVGMRYFHRLRNKFHCPSVNLXRLWSMVPARQAAEAVGADXPARDVTSSLLQVLGRGCLRPGHRRQAKLISKSAKKNQAAGKRLLLTA

SEQ ID NO: 46780 - DNA, 676 bp, Zea mays
  misc_feature: Ceres CLONE 1453005-F
  misc_feature (367)..(367): n is a, c, t, g, unknown, or other
  misc_feature (400)..(400): n is a, c, t, g, unknown, or other
ctggagctccccgcggtggcggccgctctagaactagtggatcccccgggctgcaggaattcgcacgagaccattacctagaacatcctaatcgaaaaaccaaagaagctccataattaattattgccctttcagttcgccatcggcagccgagcaccatgagctccacaggcggcggcgacgatggcgccaagaagtcttggccggaagtggtcgggctcagcctggaagaagccagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatncgctgaagtttaaatctacaaaatgaatgactncgacatgccatgcgtacctgtccgtcgccgaataatggatgtgtgtgtgcttctttccaataaattgctagtaaaataatggcatcgtcggtatgcatgaataaaatgtatcagaatgttctcccttcacgattggaatatggaaaatgaataaaaaaaaaaaaaaaactttatcatacgtccacctcgagggggggcccggtaccatttcgcctataggagtcgtatacgcgcgctcctgccgtctttttaaacgtctgactgggaaaccctgcc

SEQ ID NO: 46781 - DNA, 690 bp, Zea mays
  misc_feature: Ceres CLONE 1453011-F
  misc_feature: Encodes the peptide sequence at SEQ ID NO. 46782
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcgaaaacttcttgtgcgccgccaacgcgccggcgccctccgcccctgcgcctcagcctggtaccgtgcctgtgccgccctgtgcctccggtcctccgccctccgcatctgcctggtaccgtgctagtgccgcctgcgcatccgtcttccgcctgggtctccgccctccgcggctccgccttgcgactttaccctgcacggcccgccgccggccggtcgcccgtctggagccactgacccgagtttccgtccagcactccagggaccagcgcctgttcgtccagagtaccaacagatctcgtcaagaggtctgaaggatgaggaagggactgcatcctcagatgcaatggatttcatatgtgacgcagagtggtaggctgatcaatatcatgatgaccaaggtgaaccatactggcaaagtgtaccacatgagggccaagcggcaaatggctcanagcctcggccagattgcgaagttcaaacgtcgatatgagcaggaagcagagaaaagcaaagacaagtaggatggtgtttgggaaggaggtgtagcctctgtggtcttagtcagttctgttgactgcgaagttttcagcta

SEQ ID NO: 46782 - protein, 68 aa, Zea mays
  misc_feature: Ceres CLONE 1453011-F
  misc_feature (46)..(46): Xaa is any aa, unknown, or other
MRKGLHPQMQWISYVTQSGRLINIMMTKVNHTGKVYHMRAKRQMAXSLGQIAKFKRRYEQEAEKSKDK

SEQ ID NO: 46783 - DNA, 719 bp, Zea mays
  misc_feature: Ceres CLONE 1453016-F
  misc_feature: Encodes the peptide sequence at SEQ ID NO. 46784
caaagctggagctccccgcggtggcggccgctctagaactagtggatcccccgggctgcaggaattcgcacgagaccattacctagaacatcctaatcgaaaactcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagacaaaggggtcgttcctcgacaagggcgaggtcgctgaccgtgtcgtctccgtcgtcaagaacttccagaaggttgaaccctcaaaggtgacacctagtgctcattttcagaaggaccttggacttgatagcttggacactgtggagatcgtgatggcgtttgaggaaaattttcctttgagattcctgacaccgatgcagagaagaatgactccatcaagacagcggttgatttccatgcttcccaccctcagcaaaataagagaattctttttttttcggaattccaaagtgggttttgcacttttgcatcaaaaactttatgcgacccggaattagttttatctagtctggcccaaaaaaaaggaaagcattttttttacctttcgaaaacccgggggaccaaacgaatgtgtggttccttgggacccccttgggcccccaaccccaaaacccctttgggg

SEQ ID NO: 46784 - protein, 152 aa, Zea mays
  misc_feature: Ceres CLONE 1453016-F
MAMAAARRALLAHLRVPVVHPAAAAATIPAAGRLLSSTTETKGSFLDKGEVADRVVSVVKNFQKVEPSKVTPSAHFQKDLGLDSLDTVEIVMAFEENFPLRFLTPMQRRMTPSRQRLISMLPTLSKIREFFFFRNSKVGFALLHQKLYATRN

SEQ ID NO: 46785 - DNA, 793 bp, Zea mays
  misc_feature: Ceres CLONE 1453034-F
  misc_feature: Encodes the peptide sequence at SEQ ID NO. 46786
ggcggccgctctataactattggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaagtatcccgctggtttccttgttcctttgcttcgatgtttgctcatcgcctcatgtttgcgtgttagctgttgtttgtcgttgttctgtgggtgacggaacacagatggcagtgtctcctgttgacaacaaagattctgaaaaaccggctcaagccatttttaaagccccacctttgatggtttttagtgtgtaaaaccaaaagcttggtccaggccataagggattttgaacccccccctctgtggaggaagttggaggggataccactctttaagccccaaaaattgtgtttaggtttttgaaaagattgaaagctggtccttctccttcccgaaaaaatttttaaaaaattttgggggtcccccccccttctttcacacaggggtttttttccttgaggggaaccaaaaagactccttgcgcgaataatatttttctaaacgtcttcccccaaataacccccgaggattttgtggggggtggttcgctactcctttttttttttcatcaaaaattttttttattcctcccaaccctaaaaaaaacaaatttttttttttctttttaaaaaacattttgggtgctttttctttttataaaacaaactctttgttggtcgccgtt

SEQ ID NO: 46786 - protein, 40 aa, Zea mays
  misc_feature: Ceres CLONE 1453034-F
GGRSITIGSPGLQEFARDHYLEHPNRKIPRRLAPPLASLL

SEQ ID NO: 46787 - DNA, 680 bp, Zea mays
  misc_feature: Ceres CLONE 1453036-F
  misc_feature: Encodes the peptide sequence at SEQ ID NO. 46788
ccccgcggtggcggccgctctagaactagtggatcccccgggctgcaggaattcgcacgagaccattacctagaacatcctaatcgaaaaatacgttccctttttacatatctcgacggctcgccacctctcttctctcctcggccctcgccactctcactccgccacgccggagcacgtcgctgcggcgcgcctgcgcccgccacacacgaggggactatggacacggtggctccccgcctgagtcgctcctcgacgcgatacgggcccatcagcagcagtgctgcctccttcagtgggcccgtccggaagtggcgcaaggcctgggtgcccctcaccggtaccggcaccggcaccgccgggtccgggggagggagctcacgaggagacaacaaggtggttctcgccacatggacgccggtgaatggttgctcaggaggagggggaggcaccgacgggggcatggagctcgctgctgcgggggcctccacctgcaggcggcgctacgtcccggctgcaggggaggcgcaaagcaccaccaaaaagggcaccagcagcgagctcaacttgaacctcgagctggaagacccagacgacgacactgatgccgacatgagcaccgacgagccacgcgatgtagaagataacagcgcccgtctagaaagccgcttgaagcggaa

SEQ ID NO: 46788 - protein, 153 aa, Zea mays
  misc_feature: Ceres CLONE 1453036-F
MDTVAPRLSRSSTRYGPISSSAASFSGPVRKWRKAWVPLTGTGTGTAGSGGGSSRGDNKVVLATWTPVNGCSGGGGGTDGGMELAAAGASTCRRRYVPAAGEAQSTTKKGTSSELNLNLELEDPDDDTDADMSTDEPRDVEDNSARLESRLKR

SEQ ID NO: 46789 - DNA, 752 bp, Zea mays
  misc_feature: Ceres CLONE 1453037-F
  misc_feature (425)..(425): n is a, c, t, g, unknown, or other
  misc_feature (468)..(468): n is a, c, t, g, unknown, or other
  misc_feature (628)..(628): n is a, c, t, g, unknown, or other
caaagctggagctccccgcggtggcggccgctctagaactagtggatcccccgggctgcaggaattcgcacgagaccattacctagaacatcctaatcgaaaaatccgcctcgtctaaccaccaccacgagggagagttaaagtcgccagtacagaagagtgaaggggagagggttgctgggtccgattcggtgggctcatcgccgtcgggtccacgaattggtgcctaggagtctcgcgtgcttcggggacataatcgatggtctcgctgcggtgggttggtggctggagacctcagaattcgtcgtcatagtgcgagctcctccgcgtgtgcaccgtgcgccgtggccaggggtgtctgcgctgcaattgcaggcatacaagatgacgatggtatgaagactatctcatttcaaaaagctttngtgcaaagcactagtgcaatggcaggggttgggggcttttggntgaaaaaactgctggatgcttttggtatttttgaaaaagcaagccgggctttccgtttgaactaaaaaagtggggggtcaaaatgaaaaaccgggaggggggcccttgtttttgggatggtgacgccaaaaaaagagggtggccccttcggcccccccanttttttcccccccctccttttttggccacacgggggcggggagggggtgggttttttaagaaaaaaaattttttgggggggggggggaaaaaaatttcctttttggggaaaatatttgtgggga

SEQ ID NO: 46790 - DNA, 698 bp, Zea mays
  misc_feature: Ceres CLONE 1453039-F
  misc_feature: Encodes the peptide sequence at SEQ ID NO. 46791
  misc_feature (537)..(537): n is a, c, t, g, unknown, or other
gcggtggcggccgctctagaactagtggatcccccgggctgcaggaattcgcacgagaccattacctagaacatcctaatcgaaaactgttcttccacctgctggctgctcctgcctcccctgcgccccaaacccacccgcctcgccgtccccgcaggccgcagcctgctctcggctcccgccgccgtctaccgcgtcctgcggctgcggtgttgcgtcacctcgggttcgccttaacttccacaatcctcgccgtcctggtgctccgccgcccctccctttgtactcgcgctggagctgcagatccaccgcgacctggcgaccaattcctcctcccgctgaagaattggcgaccttggcctccgcccccgcggcgcggaggagtcaactgtggtagcaaccaccgcggaggctgcaagccttcggtaagggaggaaagttgacttgttggaagccggtccagggccgcgatgacgtcgaccgccgccggcgcgtcgtcgtcggcggcgaagagcgagtcctacctgcgggccgacnagatcgacctcgagagcctggacattccactggagaaacacttgggccaaacctggggaaaaaaccaagggggtgttaaaacccggggccccgggagggaatggggaaataaccccccccaaacctgaaaatttcttccttttataaaggaaggggggccc

SEQ ID NO: 46791 - protein, 64 aa, Zea mays
  misc_feature: Ceres CLONE 1453039-F
  misc_feature (23)..(23): Xaa is any aa, unknown, or other
MTSTAAGASSSAAKSESYLRADXIDLESLDIPLEKHLGQTWGKNQGGVKTRGPGREWGNNPPQT

SEQ ID NO: 46792 - DNA, 821 bp, Zea mays
  misc_feature: Ceres CLONE 1453042-F
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (469)..(469): n is a, c, t, g, unknown, or other
  misc_feature (567)..(567): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (576)..(576): n is a, c, t, g, unknown, or other
  misc_feature (577)..(577): n is a, c, t, g, unknown, or other
  misc_feature (656)..(656): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaaaaccggtcacagggggggtaggacccccgccgataccgagccctcgtctgtcgcacttcgccggcgcggccgagtcatcttcctcgtccacgctgggcggggagatccccagtgtgaggggaacctccccgacgcgaggacttctctacttcctgtcacaaaaaaagatttgcaatcaagcatatttatggaagcctttgctccggataaaatttgcgggtcagggagatcaacggaaccaccccacaagagggagggctggaagcccacagtagaacttgnnntttcaaaagttgtgggacctaacctatggaatggcgatggcaccgtcaaaacttgggatttannnctgnnnncaagaacggganctgctgcttggtattgtcacgtgcactgtggatctggcatgccatttccacatataccttttggccccttgaagaaaggcttaatggtgttcagaggnaatnncncnncgatattttcctagcacctttcccattaagccggcccctattattgttggtggggggggggccctttgtatgggggggnaaaccccaaaatttttttggnnnggggaggagactttgtttggggtaagaaacaccccgccttctctttttttatttgtggaaggaaaaaaaggtttttggaggggggagcgcggccccctctttgttatgaagccccggaacctccaacaacccaaagatttta

SEQ ID NO: 46793 - DNA, 736 bp, Zea mays
  misc_feature: Ceres CLONE 1453045-F
  misc_feature: Encodes the peptide sequence at SEQ ID NO. 46794
  misc_feature (425)..(425): n is a, c, t, g, unknown, or other
  misc_feature (499)..(499): n is a, c, t, g, unknown, or other
ggagctccccgcggtggcggccgctctagaactagtggatcccccgggctgcaggaattcgcacgagaccattacctagaacatcctaatcgaaaactctattctcccgtttgcgacgactgggtgggctacgccgccgccgctgccgctgccgctgctctacggtgctgagtcctttgccgatttcttccccggcgaagagcgccaccagtagatccgcccctgctgaaaacgcactcgatggcgtccgcgacggggggctcctcctcggagatggcggtggaccacgcgacggggctgggcaccgtggagaagccgcggtttgatgctctgatgccgagtgagatgagcggcgggaggacccagttccggaaagtgaccgtgccgcagcaccggttcgcgcctgctcagcgatgctggatggnaatctacacacccgtttacgagcatatgaagatcgacttacgcatgaatctcagggcaaggaggttggactaangacaaggcaaaacccccgaagggtccccacctttcaaaaagtggcggactttgggcgggcttttttgcccgggttccaaaattgggaaccccccccccttttggggcctttggaatttggggggggtattcttttaaaaaaggggggagaactcttttggggggggaatcctctccccccttttttgcgcccttttttgggggagggggggggacccccctccccccccctttaaaa

SEQ ID NO: 46794 - protein, 85 aa, Zea mays
  misc_feature: Ceres CLONE 1453045-F
  misc_feature (62)..(62): Xaa is any aa, unknown, or other
MASATGGSSSEMAVDHATGLGTVEKPRFDALMPSEMSGGRTQFRKVTVPQHRFAPAQRCWMXIYTPVYEHMKIDLRMNLRARRLD

SEQ ID NO: 46795 - DNA, 737 bp, Zea mays
  misc_feature: Ceres CLONE 1453046-F
  misc_feature: Pfam Name: DNA_pol3_delta Pfam Description: DNA polymerase III, delta subunit
aaagctggagctccccgcggtggcggccgctctagaactagtggatcccccgggctgcaggaattcgcacgagaccattacctataacatcctaatctaaaatccattgagcttgttaggcaaaaagataactccttcacttgtccatgagttggttggtgttgtctcggaagagatattgcttgatcttctggagatagctatgtcaggagatacggtttgagacagtgaaaagatccatagagctgatggattctggcactgatccgcatggcatgaatgtctcagttagctgggctcatcatggacatcattgctcgctcctacaaattggctgatgttgcttgttgtactggctcatctgttggtggttgaagtttaacggaagcagatttagaaagattagaataagcatcgaaaattctttctgatgctgagaagcacataagcctttcaggcgaccgtcccacctggattactgctgccttactacaacttgggtgtggtcataattcatatgtaaacaaacaaagctgctgtactcaagacccccttatagtaaccaatgatgctctgtctgagatagcaagggaatcggcccgccagaactttttcctcatacatttacctgccctgtggctttctctaagaaaaacgtcttgttttccgaaaacaattagggggggcagctccaattctccccaagaacccttgtcctacaaaattgcggcccaggg

SEQ ID NO: 46796 - DNA, 734 bp, Zea mays
  misc_feature: Ceres CLONE 1453048-F
  misc_feature: Translation starting site: 209
  misc_feature (369)..(369): n is a, c, t, g, unknown, or other
aaagctggagctccccgcggtggcggccgctctagaactagtggatcccccgggctgcaggaattcgcacgagaccattacctagaacatcctaatcgaaaactctcgattcggaaaacctccaaggctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaggagatcttccctcgggagctcatttcccaactcttcgatgcgttggacaaaatcaggttcgagagcctcactgancagagcaagctcgatgcgcaaccggagcttgtcctccacattggaccagaacagggcttcgaacagcctctccatcatcgaaagggggatcgggttgacaagttccgacttggccaacaccctcggtccatccccaggtccgggaacaaggattctgggaccccttggttgctgggcctaaagggtctataaatggggaattccggggcgggttttcaaacccgccccaccctcccccaaaaaggttctctggaccccccccctttaatataaaaaagttatagggtgggaaaacccagggggggggggttttttgttttttcccaaaaaccctggggaaaacctttgggggggagaaaaaaaaa

SEQ ID NO: 46797 - DNA, 709 bp, Zea mays
  misc_feature: Ceres CLONE 1453051-F
  misc_feature: Translation starting site: 232
  misc_feature (361)..(361): n is a, c, t, g, unknown, or other
  misc_feature (362)..(362): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (411)..(411): n is a, c, t, g, unknown, or other
  misc_feature (412)..(412): n is a, c, t, g, unknown, or other
  misc_feature (443)..(443): n is a, c, t, g, unknown, or other
  misc_feature (444)..(444): n is a, c, t, g, unknown, or other
  misc_feature (493)..(493): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (517)..(517): n is a, c, t, g, unknown, or other
  misc_feature (533)..(533): n is a, c, t, g, unknown, or other
  misc_feature (549)..(549): n is a, c, t, g, unknown, or other
  misc_feature (550)..(550): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (580)..(580): n is a, c, t, g, unknown, or other
  misc_feature (583)..(583): n is a, c, t, g, unknown, or other
  misc_feature (590)..(590): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (614)..(614): n is a, c, t, g, unknown, or other
  misc_feature (616)..(616): n is a, c, t, g, unknown, or other
  misc_feature (619)..(619): n is a, c, t, g, unknown, or other
  misc_feature (623)..(623): n is a, c, t, g, unknown, or other
  misc_feature (625)..(625): n is a, c, t, g, unknown, or other
  misc_feature (627)..(627): n is a, c, t, g, unknown, or other
  misc_feature (645)..(645): n is a, c, t, g, unknown, or other
  misc_feature (650)..(650): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaaaaaccaaccaaggttgtagtcccaaaccccacccgggccgccgggcgcaagcggtcgagctcgagctcgagcccaatccatcggaaacccccaactctagccttagccgatcgaccccgatccgatctaatgttccccaccgtcgacgaaccctccgccgccggcgccatggtgtcggcctccttccctgacgccgacgcctacggcaacggcgactccgacgacctcgacttccccgtggaccaaaccctaaccccgnntgtctcctctccgccgcccccgggtnnnnnnnncgcccgcgcggggcgnncccccgggggccccccccggggggggggggnnggaaaagaaacgccgggggggggggggccccggccccccccccccccanctctggggtggtgtttttnnnncnccccccgacaaagcgnccccgcggtccgccgnncccgggtgtgtgggttggnnnncggcaaanccncgccggncggaggaannncccccccaagaananagngggngngnaccccccccccccccaanaaaanaaaatttnnnnnnnnnnnnnccccncgggcgggggggggagaaaaacctccccccccgg

SEQ ID NO: 46798 - DNA, 692 bp, Zea mays
  misc_feature: Ceres CLONE 1453052-F
  misc_feature: Encodes the peptide sequence at SEQ ID NO. 46799
tccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattattataagctaaataaagtatagcggcgtcgctgtgtgtgtttcgagtcagtcagtcagttagttgcgtgccatggctggcatgctctgagtctgagatgatgatgatgcctgatggcggcgccgggtcttgtagtcctcccctgccccctcgggcgcttctgggcgcaagccgtggtgtgtgtttgggttgggggggggcaccaccgtaaccagctaaccatgtgccctgctgtggtt

SEQ ID NO: 46799 - protein, 82 aa, Zea mays; identical to SEQ ID NO: 43085
  misc_feature: Ceres CLONE 1453052-F
  misc_feature (1)..(80): Pfam Name: Metallothio_2 Pfam Description: Metallothionein

SEQ ID NO: 46800 - DNA, 663 bp, Zea mays
  misc_feature: Ceres CLONE 1453055-F
  misc_feature: Encodes the peptide sequence at SEQ ID NO. 46801
ctccccgcggtggcggccgctctagaactagtggatcccccgggctgcaggaattcgcacgagaccattacctagaacatcctaatcgaaaaacgatccccaacttaacgccgatcggaggccggagagaccggctcagcctcgctccgccgccgccggcgaccatgtccctggcggctatcttcgtcttcctcatcgtgtccgcgctgcagctgctctaccgctacctcgacctcgccagaaagagcggaggacttagtgatgagcagatcaaagtgcggcttgaaatcaagcaacttctcaaggaggctgatcagttgtcaacgccgtccacatttgcacaagctgctaaactcaagcgcctggctgctgcccaggagaaggaactggcaaaaatgcaggaacatgacccttaagggaaagcatccttatacgacaaatacacaaaatttttggttggttactaaggtcataatttatgctgggctcgttctggtgctttgggagtactcctgtaactgcagttccacacatcttctacagcctttcggaaaaatgtttccttggagagttgtggatactgcacccgccaatggtggggttggaatactcccggggctgttttagacttcccggggtcaccaaaatgctttgccaaaactg

SEQ ID NO: 46801 - protein, 83 aa, Zea mays
  misc_feature: Ceres CLONE 1453055-F
MSLAAIFVFLIVSALQLLYRYLDLARKSGGLSDEQIKVRLEIKQLLKEADQLSTPSTFAQAAKLKRLAAAQEKELAKMQEHDP

SEQ ID NO: 46802 - DNA, 716 bp, Zea mays
  misc_feature: Ceres CLONE 1453056-F
  misc_feature: Encodes the peptide sequence at SEQ ID NO. 46803
  misc_feature (524)..(524): n is a, c, t, g, unknown, or other
  misc_feature (533)..(533): n is a, c, t, g, unknown, or other
  misc_feature (586)..(586): n is a, c, t, g, unknown, or other
  misc_feature (587)..(587): n is a, c, t, g, unknown, or other
  misc_feature (716)..(716): n is a, c, t, g, unknown, or other
aagctggagctccccgcggtggcggccgctctagaactagtggatcccccgggctgcaggaattcgcacgagaccattacctagaacatcctaatcgaaaaacggacgcttcgctctagtcggaaggtttcgaggaactcccgggttcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccnaggagtttngatatgagactccatacactattatgtttggtccagataaatgtgggtcaccnnacaggttcatttcatcccttagcacagatccctagactggaagtatgttgagcatcacttcaaattcccaccttctgtccatacggacagctctctcatgtctacacagctatcttgagccagacatgn

SEQ ID NO: 46803 - protein, 152 aa, Zea mays
  misc_feature: Ceres CLONE 1453056-F
  misc_feature (24)..(153): Pfam Name: Calreticulin Pfam Description: Calreticulin family
  misc_feature (121)..(121): Xaa is any aa, unknown, or other
  misc_feature (124)..(124): Xaa is any aa, unknown, or other
  misc_feature (142)..(142): Xaa is any aa, unknown, or other
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAXEFXYETPYTIMFGPDKCGSPXRFISSLSTDP

SEQ ID NO: 46804 - DNA, 705 bp, Zea mays
  misc_feature: Ceres CLONE 1453057-F
  misc_feature: Encodes the peptide sequence at SEQ ID NO. 46805
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcgaaaaagatcaccagccataccacacgaccgcagaggagtagcaagagcccgggggagaaatgagcgcggcggcgggcggactgcggcggctgctggcggcggcggcgacggcgggagccgcggaggtgcgggcgtccatcttcggccacgcgctgaaccctacggggaggcgcgcggcgacgaagctcctgcggaagaagatggtgggcgaccaggtggcgcagtggtacccctacgacatcaagcgcgacgacccgctcgtcatggcgcgcgaggagaaggagcgtctggctaaactggaaatgctgaagcgtcgtggcaagggcccgccgaagaagggtcagggaaggcgtgccgtcaagaggagcaagtagtcgagctgtgctaccctatcaatgctcatctctgtttctggagcttgccttgttcttacattgctgtaacgtactaccagtgatttgtcgggtgagtgggcgacgacagatgcaaaaaaaaacccaccttttctatcaggtttagcttacagatgttttttttttcatcnaattgcaatgaaaccgccttctatgttggatggctgatgtgcttaaaaaaaaaaaaaaaagct

SEQ ID NO: 46805 - protein, 104 aa, Zea mays
  misc_feature: Ceres CLONE 1453057-F
  misc_feature (14)..(93): Pfam Name: Mit_rib_S27 Pfam Description: Mitochondrial ribosomal subunit S27
MSAAAGGLRRLLAAAATAGAAEVRASIFGHALNPTGRRAATKLLRKKMVGDQVAQWYPYDIKRDDPLVMAREEKERLAKLEMLKRRGKGPPKKGQGRRAVKRSK

SEQ ID NO: 46806 - DNA, 747 bp, Zea mays
  misc_feature: Ceres CLONE 1453066-F
  misc_feature: Translation starting site: 401
  misc_feature (374)..(374): n is a, c, t, g, unknown, or other
aaagctggagctccccgcggtggcggccgctctagaactagtggatcccccgggctgcaggaattcgcacgagaccattacctagaacatcctaatcgaaaaaaactttcactctctcttgcgcttgcgcagcctcttcttctccgatcccgactccaactctccctctctccttcgcctggcacatcctcggcggcgcggcagcctgcttcttcaccggcgcggcggcctgcttcttcgacgacgcggaggcctacggcggcctaccgagcggacgggtccacggacgaacggatctccggcgcctggcagatcttcggcgcgcggcctaccggttgtggacggatctccgctgcctggtgccctggcaaacncggcaacttcttctccaggcgggtggatgtgccccccccctcaagctgggacaggcaggcgtgccggtctttcccaggcggggggatcttcaccgggcgcgggcggcctacgggggggaacggatccgggccaatctccagttggtccgtgcctctggctgttccgcggccttgagctccgggcggacgggacccgcggcccaacgaaccccgctggcctctggctgttctgtggctccaggcggatcccgggccctttggttgctccggcgttcctgagcttccgggccgccctcccgattttttggctggcgccctttgaattccccaacccccggtggaatgggggccagataaaatcttttttttgtgg

SEQ ID NO: 46807 - DNA, 742 bp, Zea mays
  misc_feature: Ceres CLONE 1453070-F
  misc_feature: Encodes the peptide sequence at SEQ ID NO. 46808
aaactggagctccccgcggtggcggccgctctagaactagtggatcccccgggctgcaggaattcgcacgagaccattacctaaaacatcctaatcgaaaaacccacccgcccacaggccacagcccacccccttctccaggtctctccccggcggcggcgggtgcggttctccggccatcaccgtgcgcaccaggaaaaactatgaggaggtacagccccccttatcgcagcccccccaggaggggatatggtggcagaggaagaagcccccctcctcccaggaggggatatggaggacgcaaggagggtagtggaagccttttggtccgcacatcccattaagtgtcagagcggaagatcttcgagtttccttttgaaaggtttggccctgttcgggatgtttacttcccaacccaccactactctgggggagcctcaaggatttgctttgaaaaatttggtgaaccttacaaagcctcctaaccccaatatcacattgaacccccaatttttttttggtccgaaaaaaactttttgttcttgctttcggaccccaaaaagggccaaaaaaaatcccccccaaaaacaaaaaaaaaaggtttctttggggcaagaagaggccccgggcctctaaaaagggggggggctcttttctccccccccctccttaagggggcccccccccgggcaaaaaaaaaatctcctctccccccaggggggggaataaaaatctttccccc

SEQ ID NO: 46808 - protein, 46 aa, Zea mays
  misc_feature: Ceres CLONE 1453070-F
MRRYSPPYRSPPRRGYGGRGRSPPPPRRGYGGRKEGSGSLLVRTSH

SEQ ID NO: 46809 - DNA, 688 bp, Zea mays
  misc_feature: Ceres CLONE 1453072-F
  misc_feature: Translation starting site: 421
  misc_feature (688)..(688): n is a, c, t, g, unknown, or other
ctggagctccccgcggtggcggccgctctagaactagtggatcccccgggctgcaggaattcgcacgagaccattacctagaacatcctaatcgaaaaaaaggcctgcctcagcccatcttcactccctcccgatgccctaacccatggttacgactccgacgacgcgaccccggcggcctgctgcccagctccctctgccttcgcgccgtgcctcctaccctcctgaatccgcgccgtgccacccgagtccaggcccccagggtgcgagggcggcaccggcgcaggcgaaccgcagtccgcgcctccgcactccgccccatccgaagctccgagcacagcaggagcagcaaagcaagcgagcgtcagtggcagactggctgaatcgagaggtggaggcagcaaccaacaaggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcattttggggtgtctgcaaccatgcttatcatcttcactgcatactgaagtgggtcaattctcaaacatccacaccccttttgccccatgtgccgtagaagagtgccaagttaaaggctaaggtactatgn

SEQ ID NO: 46810 - DNA, 760 bp, Zea mays
  misc_feature: Ceres CLONE 1453075-F
  misc_feature: Encodes the peptide sequence at SEQ ID NO. 46811
  misc_feature (79)..(79): n is a, c, t, g, unknown, or other
  misc_feature (266)..(266): n is a, c, t, g, unknown, or other
  misc_feature (289)..(289): n is a, c, t, g, unknown, or other
  misc_feature (415)..(415): n is a, c, t, g, unknown, or other
tggagctccccgcggtggcggccgctctagaactagtggatcccccgggctgcaggaattcgcacgagaccattacctnagaacatcctaatcggaaaaagcaaatagcagtccttgctcctccaacttccctcctggcttctgcccctttgtctgcgctcctcacgccgccccccgccccagcctcacacccgcattccccagatctccatggactcgacccctcccacggacccggcggcctcctgcttggcctccgcctctgncgcggtggcatcgggggacgtcnccgcgatgctgccggactcgccgccgcggcgtggggcgggccaccgccgcgcacagtcggagattctcctcggggggccggcgctccccgacgacttcactttcgagcgggacttggccccccccngaaggcctgcttggccggcaacaaggattagggggatccccccaccccccagaaggggtcggcgggccctggcccaccccgattttcaaaaatttccccgaaaaaaggggaaattccccaaaacccccagaaaccttgggccatcccaatttaaacccccccggggcccggggaccattaaaaggggtgtttgggaggggggcccccctttttttttggttccccccccccccgaaacccctggagacgggggccctctaacccaaaaaagttttttctcaaaaatatattccccaaaattcttcttttgtccccccccacccgccgaaaaaaatttttttcccc

SEQ ID NO: 46811 - protein, 183 aa, Zea mays
  misc_feature: Ceres CLONE 1453075-F
  misc_feature (19)..(19): Xaa is any aa, unknown, or other
  misc_feature (27)..(27): Xaa is any aa, unknown, or other
  misc_feature (69)..(69): Xaa is any aa, unknown, or other
MDSTPPTDPAASCLASASXAVASGDVXAMLPDSPPRRGAGHRRAQSEILLGGPALPDDFTFERDLAPPXRPAWPATRIRGIPPPPRRGRRALAHPDFQKFPRKKGKFPKTPRNLGPSQFKPPRGPGTIKRGVWEGGPPFFLVPPPPETPGDGGPLTQKSFFSKIYSPKFFFCPPPPAEKNFFP

SEQ ID NO: 46812 - DNA, 857 bp, Zea mays
  misc_feature: Ceres CLONE 1453077-R
  misc_feature: Translation starting site: 200
  misc_feature: Pfam Name: FTCD Pfam Description: Formiminotransferase domain
  misc_feature: Pfam Name: FTCD_N Pfam Description: Formiminotransferase domain, N-terminal subdomain
cgaattgggtaccgggccccccctcgaggtcgacggtatcgataagcttttttttttttttttttgaaactgaataaccgatgacgcatctgttttcttccctgaaaagagttcaaatccaaactcaagttttcagatgcaaaatcgaatttacacgggcaaaaaataatgctccagcagcagcatcagtgctacaaacatgagtttacatttcccccatgtttttatttctacaagctcatcagtcgtcagcgcaagcaatcttgagatacttatcgagcgctccccccttggttatgccagggtaaaatccctgctcaacctcaagtcccgggcctcctgcaatctgttccacgacggtctgaacttgataggccctggcatggtctggatccaccaagcacgcaatctcggggcagtcatccccatggaaaaacgccagaccctgcaccgcgggaagccctccgctgcgtccagcgacaccacgggtgatcctcctgacggtggcaacttccttacacagaacggggacattgtagttgtcgatccaaggcgtgacacccaccgtcgtaccgcctctcttgtgcgaaacgacttgggccggaccgacctcaggcttcaccggcaggacgtcgggaaagcatgctacctgaccactggttgcccctgtagtttgggcggtagtagccgagctcaccccggagcgcggccaccgacttccccgctgggggggctgctgccaacagaaaactgggactgctgcaatccaagcgatttcagatgctacctgcctacccggagacgcgcatccccgattgtcgtttggcccccggggggaaagaaattgtcgcccacca

SEQ ID NO: 46813 - DNA, 666 bp, Zea mays
  misc_feature: Ceres CLONE 1453079-F
  misc_feature: Encodes the peptide sequence at SEQ ID NO. 46814
  misc_feature (414)..(414): n is a, c, t, g, unknown, or other
ctggagctccccgcggtggcggccgctctagaactagtggatcccccgggctgcaggaattcgcacgagaccattacctagaacatcctaatcgaaaaaaggcaacaagggagaagtagatctgcatctgcgagaggaggcagcgggggtggtgatgatggagagccagccgctgcaggccccgacggccacggctccgccccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccatccaagacaatcccctatgtatggaccgttttcactgctgggtacatagagcacccccncccaggggccattggcagttctcttggtcttctcttttgtgaaaagacattgacccagcatggggccgcagggatttctgaggttcattattttgatcaactcctctgtggcatcctgccttttgctttgctattggactctactacgcccctggaaaggaaagctcccttgtccccccactttcgggttcccgggtgccttggtggctttcttggggccttgagagcgctctttccaaccttgaccttcta

SEQ ID NO: 46814 - protein, 170 aa, Zea mays
  misc_feature: Ceres CLONE 1453079-F
  misc_feature (87)..(87): Xaa is any aa, unknown, or other
MMESQPLQAPTATAPPPGSAEPAGAPPAVTPGKEFTRTCKGLVVVLIGGYVLLQLLPSSLNYLAIIPSKTIPYVWTVFTAGYIEHPXPGAIGSSLGLLFCEKTLTQHGAAGISEVHYFDQLLCGILPFALLLDSTTPLERKAPLSPHFRVPGCLGGFLGALRALFPTLTF

SEQ ID NO: 46815 - DNA, 656 bp, Zea mays
  misc_feature: Ceres CLONE 1453085-F
  misc_feature: Encodes the peptide sequence at SEQ ID NO. 46816
cggccgctcttcactagtggatcccccgggctgcaggttttcgcacgagaccattacctagaacatcctaatcgaaaaagagtggacccaattccaaagagggccgaaggccgggcaggcaggcagcacccgcggagacgcggagcctccactccccgtctcgcttcctcctctggatctagccgacgccgccctcaccctgtcacccaccgacgtcgccgtcgccacctatatcacccaccgcctctgaagaagaagacgcggatccgagggtagttaactgctgaagaagaagagccggtacggagaagacgcggagcagtacgtctccgatctgataacgagttcctgggaggaggaagctagacgatttctgttagaggaggaagaagaggatgatgaactcgtcttagtacttgtctctactattctctcggtcatgcaagaagagaaaagagccatagtagcatctgctgctgaaccggtgcaacatgtaccaagagagggcagcgagatcaatgttgctggaccaagtgtgggcagtgagactaatgttgatggactatatcgataccgtcgacctcgagggggggcccggtacccaattcgccctatagtgagtcgtattacgcgcgctcactggccgtcgttttaca

SEQ ID NO: 46816 - protein, 72 aa, Zea mays
  misc_feature: Ceres CLONE 1453085-F
MQEEKRAIVASAAEPVQHVPREGSEINVAGPSVGSETNVDGLYRYRRPRGGARYPIRPIVSRITRAHWPSFY

SEQ ID NO: 46817 - DNA, 702 bp, Zea mays
  misc_feature: Ceres CLONE 1453094-F
  misc_feature: Encodes the peptide sequence at SEQ ID NO. 46818
  misc_feature (619)..(619): n is a, c, t, g, unknown, or other
caaagctggagctccccgcggtggcggccgctctagaactagtggatcccccgggctgcaggaattcgcacgagaccattacctagaacatcctaatcgaaaaatgaagagcagcccacacctggtgctgatcctgtgcctccaggccgctctggtcatgggcgtcttcgccgctttggctaaagaaaatgccctgggcgagagcaaggccatcgacatcaacccggggcagctcaagtgctgcaccaactgcaacttctccttctcggggctctacacctgcgacgacgtcaaaaaggactgcgaccccgtctgcaagaagtgcgtcgtcgccgtgcacgcctcctactcgggcaacaacaagttcaggtgcaccgacaccttcctcggcatgtgcggccccaagtgctagatcagagaggaagaacgcgcgctgctagctgctagcttcgttcttccgccgccggccggccggcgtgcatggttcacgtactgtgtgttgtgcaactactgctggcttcttgtgtgttcggttcttgttctctctacagtgcaccttgcgcgccaacaataaaccgttgtttgccatgaataaatagtactatatgaagttatttgncaacaaaaaataaaaggtgacgctgaaaaaaaaaaaaaaaaagcttatcgataccgtcgacctcgaggggggggcccggtacc

SEQ ID NO: 46818 - protein, 102 aa, Zea mays
  misc_feature: Ceres CLONE 1453094-F
  misc_feature (70)..(99): Pfam Name: Bowman-Birk_leg Pfam Description: Bowman-Birk serine protease inhibitor family
MKSSPHLVLILCLQAALVMGVFAALAKENALGESKAIDINPGQLKCCTNCNFSFSGLYTCDDVKKDCDPVCKKCVVAVHASYSGNNKFRCTDTFLGMCGPKC

SEQ ID NO: 46819 - DNA, 630 bp, Zea mays
  misc_feature: Ceres CLONE 1453148-F
  misc_feature: Translation starting site: 183
  misc_feature (342)..(342): n is a, c, t, g, unknown, or other
  misc_feature (343)..(343): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (362)..(362): n is a, c, t, g, unknown, or other
  misc_feature (363)..(363): n is a, c, t, g, unknown, or other
aagctggactccccgcggtggcggccgctctagaactagtggatcccccgggctgcaggaattcgcacgagaccattaactagaacatcctaatcgaaaaacatcctcccctccccttcctcctcctcgcgccgtccctccaatctctcttcgtgcccccgcgccgccgaccaccgagcaccatggcgaatccagcaccggcgacgggagggaagtcgttcctgcaggccatgtcgacggtcaccgaagagcggcggtgcactcgcgtcgtcagatggaggactggctgtcctgagatcattagcactgtgaggagtttgcgcctgctctggttacaggccnnactgctggnnnttgatgtnngtagtgtctgaaagtgaccaactgttttccttttccctttggagaggatgaccagggaacccaatgccaatggggccaacttccaccttgaaaatattaagggcttggagggaaggttattgccaacatacccctgttggaggggatcagcccggctggcttggatcttttcaaaccctggggggggttgaaacttttttaaaactttcggggaaactcccgggagaggcggggggttccggtgaaccccccttggggttgttaagg

SEQ ID NO: 46820 - DNA, 718 bp, Zea mays
  misc_feature: Ceres CLONE 1453174-F
  misc_feature: Encodes the peptide sequence at SEQ ID NO. 46821
aagctggagctccccgcggtggcggccgctctagaactagtggatcccccgggctgcaggaattcgcacgagaccattacctagaacatcctaatcgaaaaaaccaagacaggggcctcagctcactcctctctctggaggtccaggaagcaagcaaccaacgctctcatctcacgtcggatggtccctgcaatgacaatagacgggggcgccgaggtcccggcccctgaggtggaggtggtcgccgaccccgacgtggagaccaactacgaggtcgtcgccggcaacgcgaagccgggcaacgacaccaaggccgacgtcgtcaacggcaagaactcctccgccccgaggaagccccaggcacagcactcccaccctatccacgtcgagatggtgccggaggccatcgctccccaaaacgagcggagactgctgagcctgtggctcatcgcagacttagtcgatgacaaacacgaggctcacctcccgaggcaacttccggaagactctggcggagcgcctcaagagggtaggtgcctctcgtgaccttactaagtcaagcgctcgaacaagctgtcggccgccacaacctagcccaactcggcaacgaataagaagcccacgacgaatagtaatgcgcctgccaggaacaccgccaccgagtacaaggccctggcgacctcagagaatgtcgcttcaaagccatgtcctaggcacc

SEQ ID NO: 46821 - protein, 117 aa, Zea mays
  misc_feature: Ceres CLONE 1453174-F
MTIDGGAEVPAPEVEVVADPDVETNYEVVAGNAKPGNDTKADVVNGKNSSAPRKPQAQHSHPIHVEMVPEAIAPQNERRLLSLWLIADLVDDKHEAHLPRQLPEDSGGAPQEGRCLS

SEQ ID NO: 46822 - DNA, 690 bp, Zea mays
  misc_feature: Ceres CLONE 1453175-F
  misc_feature (632)..(632): n is a, c, t, g, unknown, or other
ggagctccccgcggtggcggccgctctagaactagtggatcccccgggctgcaggaattcgcacgagaccattacctagaacatcctaatcgaaaaaaggaagatgagagagaatcatcatggcttccctagggccgtgccgccgcccttcgccgcgagatcggccctccgccgggtgcccctcgtcgccctcgtgctcctcttccgccgccggagtcctccattacgtcggctgcgggctctctggagacgcggatgcccctcctggcgcggcgcctgtgtgcgcctcgtatcctgcatcaccgagatggcaacaatgctctctcatggaacgtccaagctcatgctctgttaatatgagaaacatctgcctgcgatatctgaccactaaatggacactgcattgaaagatatgatggctgctatctgagatgaactctcagccctgctcgtggagaagcaacatagcagaatctatggctactgatagctacgctggtgcacatacttgcaaaatgactttcgtgcagctgatgatagataaccctttgtcggagtcgtactcaccctagaaatgactattggacatgtttggggcactaacgggccattacgttggcaccatgacctgnttactttataaaaactgtggaatcctgccattaccctatatatgaaccctttcgttat

SEQ ID NO: 46823 - DNA, 575 bp, Zea mays
  misc_feature: Ceres CLONE 1453180-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (533)..(533): n is a, c, t, g, unknown, or other
  misc_feature (570)..(570): n is a, c, t, g, unknown, or other
  misc_feature (571)..(571): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnccaaactggaactccccgcggtggcggccgctctagaatagtggatcccccgggctgcaggaattcgcacgagaccattacctagaacatcctaatcgaaaaaaagcgatcaacgaatagagaaagaaagaaagcgaaatctaattgttagagaaacgcgagttattctagaaatcaaaaaaagcgtttacttggacgttcgttttgaacatttaacaaccttttaaacccaaatggcaacaccgaaaatggggccccctggttttcaaaatccaaaaaccccggaaatgtccccccctttttatgtggggggggaaaaaaagaaaaaattgtttttttttttccctcaaaaagagggtgtagttttttttaccccggggccccccaaaaaaaaaaaaaattttttttttcccccccccccggggnggggaaaaaaaaaaaaaaaaaaaaaccccccccctcnnttgg

SEQ ID NO: 46824 - DNA, 714 bp, Zea mays
  misc_feature: Ceres CLONE 1453182-F
  misc_feature: Encodes the peptide sequence at SEQ ID NO. 46825
ggagctccccgcggtggcggccgctctagaactagtggatcccccgggctgcaggaattcgcacgagaccattacctagaacatcctaatcgaaaagcgagcgggggggttgatttccccgtggcgtccaagcagatggaggagatccagcggaagctggcggtgctggcctacacgagcgccagcgcgcctgcgcagtccctcctcttcaccggcgtctagcgctaccgcctcctcgagtggctctacttccggctgctgggcgacagatccccattcacgcaccataactgggagggggacagcctcgaccgcgacgaggagaacagcatgatccaacacttggcggatatcgcgaatttccttggtatcacgccttcagtcgacactgaggcgattcagggcagacgcacctactacgagcgggtggagctcctccggctaattgatgacttggcggaagctagctgctatgccgacaatccagagtggagtgttgatgagcaattggcaaaagacgtacaacttgtagattccattgcagagaaacacgcacaaatattttcagaggagtgcaagctttttcctgcagatgtccaaatacaatcaatttaccccctgtctgatacagcagaactagagctgaagctctctgagtataccaaaaagatgtcaaatctgcaacagatggtgcaagagctcagctcgtagtat

SEQ ID NO: 46825 - protein, 126 aa, Zea mays
  misc_feature: Ceres CLONE 1453182-F
  misc_feature (1)..(127): Pfam Name: Plant_NMP1 Pfam Description: Plant nuclear matrix protein 1 (NMP1)
MIQHLADIANFLGITPSVDTEAIQGRRTYYERVELLRLIDDLAEASCYADNPEWSVDEQLAKDVQLVDSIAEKHAQIFSEECKLFPADVQIQSIYPLSDTAELELKLSEYTKKMSNLQQMVQELSS

SEQ ID NO: 46826 - DNA, 640 bp, Zea mays
  misc_feature: Ceres CLONE 1453189-F
  misc_feature: SWISSPROT Homolog: EC 1.1.1.184 Carbonyl reductase (NADPH)
gagctccccgcggtggcggccgctctagaactagtggatcccccgggctgcaggaattcgcacgagaccattacctagaacatcctaatcgaaaaaataaccttaactgtcatagatacctttatgattttggtgtaaatattggatgaccggctgttcgacctctgcgacgacaagtgttgttttacttcgtgggggatgctcccctcatggaaggaggatcctcacccacgcatgccaaacacgatggtcgccgtcgacaccggacggaacaaggagatcggcttctaggtgtgccggcagcttgtcagcgtcggaattgtcgtcttcttgacggacctcgatgagatgaggggctgcgaggccatctagaggctcaatgcgctggggctctctcatgtcatcttacatcagctggagatcacggacgcttcgagcgcagctgcgctagctggttttctcaaggttccgctcggcaagcatgatattctgatgcataatgccgcacttggaggggttgagtacggcccatagttcgatacaacgagggaaagtgcggtcgcatggatcttctccagagaactcagtggatgctgataatgccccgtagcccatctacggctcgaagaaaaacttgcaa

SEQ ID NO: 46827 - DNA, 593 bp, Zea mays
  misc_feature: Ceres CLONE 1453254-F
  misc_feature (155)..(155): n is a, c, t, g, unknown, or other
  misc_feature (174)..(174): n is a, c, t, g, unknown, or other
  misc_feature (175)..(175): n is a, c, t, g, unknown, or other
  misc_feature (198)..(198): n is a, c, t, g, unknown, or other
aagctggagctccccgcggtggcggccgctctagaactagtggatcccccgggctgcaggaattcgcacgagaccattacctagaacatcctaatcgaaaaacacgccgatacctcctccttcacccgctccgtcgtcccccacagccggccacngccaccatggctgccaccnnggccgcgcgccttgcgggccggncgcctctcggctcgctccgcattgcgtcgaagcgccgggcgcggtagcttctctcgatcgctcgcaggtactccgcgcgcgtcaggggctcgtcttcagacaggccttctcacggtcttactaacacttgatccccggaacaacccgaattgaaatggagtcctccaggcaattttaaaaaggcaataaaattttgttccattcaagaaattaaagaaatgggatttttccgctccttgacttttcacaaaccccatggggaaggggcccctttccccaagggagtttttttaaaaaacccaaaattcccccaacgggggtttaaaaagggccccctttttaccctcttataaaaaaaaaagggggaaaaaaacccccctttggggggggaaaaa

SEQ ID NO: 46828 - DNA, 710 bp, Zea mays
  misc_feature: Ceres CLONE 1453259-F
  misc_feature: Encodes the peptide sequence at SEQ ID NO. 46829
  misc_feature (710)..(710): n is a, c, t, g, unknown, or other
aagctggagctccccgcggtggcggccgctctagaactagtggatcccccgggctgcaggaattcgcacgagaccattacctagaacatcctaatcgaaaaattctgaagtccggcggcggcggctgcggcgagggcgaggcctctgcgacttccagatctccccgacgaggaggaagtctctacagcggaggggagggagatgtcgtacgtgctgggtgacctgctgacgaggatgcggaagctggtgaagggcctcgccaggcccgagccccggtggctcaaggccttggaacgggctccgccagtgacatttcctcgcccagaggggaagatcccgaatctggtgcttcctgaggatgtgtatgtctggaagttcaacagaatacctccagattctctttaccttgatgcaatccagataagtggatttgatccaccgccagctcgagtgtttgcttggcgtgtcctggagttgaaagagctaggagtcgatgaatatgttgcgatggctgtagcacataacgagtaccggacggagaataatgcgaagaatagagcgtacaacgagctgacagaaatcgcccgcagcgagaggaggaagccacctccgaatccatactctagtgccatgaaggacatacacgcggagggacaagaagtatgtcatgcaccgtttgcgtaacccgtaggtgatcgagatagcgaacn

SEQ ID NO: 46829 - protein, 160 aa, Zea mays
  misc_feature: Ceres CLONE 1453259-F
MSYVLGDLLTRMRKLVKGLARPEPRWLKALERAPPVTFPRPEGKIPNLVLPEDVYVWKFNRIPPDSLYLDAIQISGFDPPPARVFAWRVLELKELGVDEYVAMAVAHNEYRTENNAKNRAYNELTEIARSERRKPPPNPYSSAMKDIHAEGQEVCHAPFA

SEQ ID NO: 46830 - DNA, 742 bp, Zea mays
  misc_feature: Ceres CLONE 1453263-F
  misc_feature: Encodes the peptide sequence at SEQ ID NO. 46831
ggagctccccgcggtggcggccgctctagaactagtggatcccccgggctgcaggaattcgcacgagaccattacctagaacatcctaatcgaaactctagagaggcacatcccagctccaagcttcgcgccttgttggatcgtggcgtccaagcaacggtggtagcggagcgcgaggcagtggccgcagaaggaagcgcgaagcatccatggaccaacgccaggtggttagcgagaattatgccaatcccataacatgcttcttccatgtgctatttcaggcgggggcgctagccttctacatcctattctcgctctttgtgaggagctcgtcatcatcttcgtgatcacggtgcctcctcccagcgcttgacttcttgggtggtgaaaacgtcaggtggcaggatacctaatccgggctgcggggggtggaaatgagatccatgaatgacgaaaaccggggggggaaaatttaaatgcccttgagggggacccccccccccggaaaaaaaaaaaaggttcggggggtttcggggggacccttttatttaagggccgggggggaaaacccttcgggatttttccccccccggggggggggggaaaaccccctcttttttgggaaattttttttaacaaaaaccgaaaaaaattgtgttgttcccccggggggccaaaaagggccaaaaaaacaccccctttttctccaaaaggaccccctcccgcgggaaaaaaaacgaaa

SEQ ID NO: 46831 - protein, 45 aa, Zea mays
  misc_feature: Ceres CLONE 1453263-F
MDQRQVVSENYANPITCFFHVLFQAGALAFYILFSLFVRSSSSSS

SEQ ID NO: 46832 - DNA, 718 bp, Zea mays
  misc_feature: Ceres CLONE 1453266-F
  misc_feature: Encodes the peptide sequence at SEQ ID NO. 46833
  misc_feature (410)..(410): n is a, c, t, g, unknown, or other
  misc_feature (436)..(436): n is a, c, t, g, unknown, or other
aaagctggactccccgcggtggcggccgctctaaatagtggatcccccgggctgcagaattcgcacgagaccattacctagaacatcctaatcgaaaattttcccccttcccactctccactctgagcactctcctccgctctgctcctttgctccccacggcaaaccgtaaaccctagcctgaggggcacccctgtcgcaccatgggcgcaagccggaagctgcagggcgagatcgaccgcgtcctgaagaagtccaggagggcgtcgatgtctttgacagcatctggaataggtctacgacactgagaatgccaacagaaggagaaagtcgagggcgaccctcagaaagagatcagaagctgcagcggtacagggaccagatcaagacgtggattcagtccagcgagnatcagggacagaaggtgaggattacngattacctcgagtcctgcccctccccctggcagcctctatttctgcccctggaagggcatggttgttgtggatgcaatgctgcggctgtttgccaaccttggggtggggaacaaggggcccccagggtttcccccctaaggaaattgggcggagaacaaaggccgctttgtggccccccttaaggaaacggggtggaaaacacaggcccccattggccccccttttagaaacccccccaaatgtggggggggaaaaagggggttttttttgttcccccttat

SEQ ID NO: 46833 - protein, 102 aa, Zea mays
  misc_feature: Ceres CLONE 1453266-F
  misc_feature (34)..(34): Xaa is any aa, unknown, or other
MPTEGESRGRPSERDQKLQRYRDQIKTWIQSSEXQGQKVRITDYLESCPSPWQPLFLPLEGHGCCGCNAAAVCQPWGGEQGAPRVSPLRKLGGEQRPLCGPP

SEQ ID NO: 46834 - DNA, 737 bp, Zea mays
  misc_feature: Ceres CLONE 1453271-F
  misc_feature: Encodes the peptide sequence at SEQ ID NO. 46835
tggagctcatcgcggtggcggccgctctagaactagtggatcccccgggctgcaggaattcgcacgagaccattacctagaacatcctaatcgaaaaaccatgctcctccccctcctcagatcccacccgctcctccaccacgccgctcggctgtcctccctgcgcactcgcttgatcctccgccgcgacgcgctcccgctcgcgcgctcccggcctatccgcatggcggcctattccggctccggcgccagctcccctgccccggcgccgcctgctgccgtggtgcaaaagtcaaagatcaaattttgccctgcttgtggaagtccaacgaaattgtccatacctgatggtgatgagaagatgagggctgtttgttcttcttgtggaggaagtcactacgaaaacccgaaaatggttgttggttgccttggtggagcacgataattaagttcctcctttgcagaaaaaaaattgaacccgctttagggcctttggaacacttcctgctgggttatttagaggggggggaagtctccctcttaaaggaccccctaagaaacccttaaaaaaaaccgtggcgcaaagggaaaaaaaaccccccccttttggcccagtgggaaattcccccggattggggaaaaaaggataacattttttttcccgaagaaaaaaagaaaaccccccctttttttccccctggggggagaaccccggaaagggcgcccttttgtccccc

SEQ ID NO: 46835 - protein, 114 aa, Zea mays
  misc_feature: Ceres CLONE 1453271-F
MLLPLLRSHPLLHHAARLSSLRTRLILRRDALPLARSRPIRMAAYSGSGASSPAPAPPAAVVQKSKIKFCPACGSPTKLSIPDGDEKMRAVCSSCGGSHYENPKMVVGCLGGAR

SEQ ID NO: 46836 - DNA, 713 bp, Zea mays
  misc_feature: Ceres CLONE 1453275-F
  misc_feature: Encodes the peptide sequence at SEQ ID NO. 46837
aaagctggagctccccgcggtggcggccgctctagaactagtggatcccccgggctgcaggaattcgcacgagaccattacctagaacatcctaatcgaaaaatcagaatcagaccaccacacgcccgaggcccgactgcaagcgcctgagcccaagacccatggccatggccgccgccaccgtcgcagcgtctctgcccgtggcgcaggggctcgggaagcccctctgcgccggcagcaacgcgccgtcgctccgggccgtcgcgggcgcgccccgttgtcggtcggccaggaccaggatggccgtcgtccgggcgtccgcgcaaaagcagcacccggccaaggagtgagcggccgcagctgccgtggcggcggcgctggtgctgccggaggtcgcggaggctgcgcctgggatctccccatcgctcaagaacttcctcctcagcatcgtctccggtggggtcgtgctcgtcgacatcgtcggcgccgtcgtcgccgtctctaacttcgatcccgtcaggcggggttgagctgcatgcgtccttgtgtgttgttgtaatgtacctatgtactgagatctcctcccccgttgtgcttcccaatgaaaacagtgtttaatgcgtgaatgtgtaaatttcatttcatgccatctgtatgtatgagacggattcaacagcgcaaaaaaaaaaaaaaaaaccttatcgataccggcg

SEQ ID NO: 46837 - protein, 60 aa, Zea mays
  misc_feature: Ceres CLONE 1453275-F
MAAATVAASLPVAQGLGKPLCAGSNAPSLRAVAGAPRCRSARTRMAVVRASAQKQHPAKE

SEQ ID NO: 46838 - DNA, 833 bp, Zea mays
  misc_feature: Ceres CLONE 1453280-F
  misc_feature: Encodes the peptide sequence at SEQ ID NO. 46839
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
gggggcgggcacttttcttcccgcgtcccccccctccttccnnnncaaaaactggagctccccgcggtggcggccgctctagactagtggatcccccgggctgcaggaattcgcacgagaccattacctagaacatcctaatcgaaaaacgcaacaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagctacgagctgctgcgccacaaccccgtccacaagaaggtgcccgtgctcgtccacggggggccgcgcgctcccggaagtgggtggtaaacctcccagtaccttgacgacgccttggggggaaaacccgcccgctgctcccccgccgaacgccctttcaacccgcgcgcctcccgccggtatccggggggccaccttccgccgcaccgacataccttccccgccccgaaaggtggggccgcgggtagtttcgccggtcccaaccggggggagggcgccaacgcaaggccgcgcggtggtcggcagcgttgccgcgtaaaaacccgggggtctggaatccagatcccaaaacctcccaacgaacggcccgcgttctcgggggctcgccgtttttctttcggccagcccaacaaaggtggtgcctcttggtgggacgatcggcctcgggggatggggggttccctattggccgccaccgtgggtccaaagggagggg

SEQ ID NO: 46839 - protein, 80 aa, Zea mays
  misc_feature: Ceres CLONE 1453280-F
  misc_feature (14)..(81): Pfam Name: GST_N Pfam Description: Glutathione S-transferase, N-terminal domain
  misc_feature: SWISSPROT Homolog: EC 2.5.1.18 Glutathione transferase
MEKTSENAIPPAASPLMLFGSWASSYTHRVQLALRLKGLEYDYVEEDLGNKSYELLRHNPVHKKVPVLVHGGPRAPGSGW

SEQ ID NO: 46840 - DNA, 714 bp, Zea mays
  misc_feature: Ceres CLONE 1453281-F
  misc_feature: Encodes the peptide sequence at SEQ ID NO. 46841
  misc_feature (514)..(514): n is a, c, t, g, unknown, or other
ctggagctccccgcggtggcggccgctctagaactagtggatcccccgggctgcaggaattcgcacgagaccattacctagaacatcctaatcgaaaaaaaaagaacggaaaggggagagcagttaccttgcgcgcgcgcgcgcgacagggtccaatactcgaaggggaatctccggaggatggaggtgggcaggactccgcggcgacgggcgtccccagcggcggctgtgccttcgctgcttctgttcgccttgctattcgtgtgccgggcggcggcagcgttgggcggcccggcgccggcgctatacaagcacgcgtcgttcttcgaccgcgacggcgacggcgtcgtctccttcgcggagacgtacggcgcgtttcgggccctcgggtttggactcggcctgtccagcgtcagcgccgccttcatcaatggcgcccttggcagcaagtgcagacctcaaaacgcgacgtcgtcgaagctggacatctacatagaggacatccggagagggnaagcacggagcgactccggctcgtacgacgcccaaggaagggtccgtcccccgagaagtcgaggaagataatcgccagggcacgcgaaggacagtcccccgaacgccctggactccggaagaaaatcgaaacagttgcttcaaggaaaaagaaagccccgggaactcccacgggtggccttggcccaaaaaccaaaatga

SEQ ID NO: 46841 - protein, 134 aa, Zea mays
  misc_feature: Ceres CLONE 1453281-F
  misc_feature (30)..(134): Pfam Name: Caleosin Pfam Description: Caleosin related protein
  misc_feature (112)..(112): Xaa is any aa, unknown, or other
MEVGRTPRRRASPAAAVPSLLLFALLFVCRAAAALGGPAPALYKHASFFDRDGDGVVSFAETYGAFRALGFGLGLSSVSAAFINGALGSKCRPQNATSSKLDIYIEDIRRGXARSDSGSYDAQGRVRPPRSRGR

SEQ ID NO: 46842 - DNA, 698 bp, Zea mays
  misc_feature: Ceres CLONE 1453283-F
  misc_feature: Encodes the peptide sequence at SEQ ID NO. 46843
  misc_feature (394)..(394): n is a, c, t, g, unknown, or other
atagctggagctccccgcggtggcggccgctctagaactagtggatcccccgggctgcaggaattcgcacgagaccattacctagaacatcctaatcgaaaaaaacagcctccaggtctagctagggtttcgtctccgccgcttgctctaatcctctcccggcacgcgacacgcgagggcgcagcgtttatggcggcgacaccggcggacgcgaagaccgaggccgccaagatggacctcctcgaggacgacgacgagttcgaagagttcgagatcgaccaagaatgggatgagaaggaagaaggcaatgaagctgtccagcagtgggaggatgattgggatgacgatgatgtgaatgatgatttctcgctgcagctgaagaaagactggaggnaaagcacgccagaagagctgaagtattatttctcagtttacaatgatccttctatgcagctacttctggaaatccgacctttaggggattgggctgctggaccaatcaaccctggataagaaagtacccatccctgttttcctaatttaaacggcggaattaacggaaatcccccggtttttaaaaaaacccatgtggggtaaaaagccccagtttttttttttttaaaaaaaaaaaaaaaatttttcttccccccccccggggggggcccggcccccctcccccaaagggagctttaaccccc

SEQ ID NO: 46843 - protein, 107 aa, Zea mays
  misc_feature: Ceres CLONE 1453283-F
  misc_feature (8)..(70): Pfam Name: DSS1_SEM1 Pfam Description: DSS1/SEM1 family
  misc_feature (69)..(69): Xaa is any aa, unknown, or other
MAATPADAKTEAAKMDLLEDDDEFEEFEIDQEWDEKEEGNEAVQQWEDDWDDDDVNDDFSLQLKKDWRXSTPEELKYYFSVYNDPSMQLLLEIRPLGDWAAGPINPG

SEQ ID NO: 46844 - DNA, 700 bp, Zea mays
  misc_feature: Ceres CLONE 1453289-F
  misc_feature: Encodes the peptide sequence at SEQ ID NO. 46845
  misc_feature (501)..(501): n is a, c, t, g, unknown, or other
  misc_feature (518)..(518): n is a, c, t, g, unknown, or other
aaagctggagctccccgcggtggcggccgctctagaactagtggatcccccgggctgcaggaattcgcacgagaccattacctagaacatcctaatcgaaaaacagactcccacagcccagccgcagctcctccgcctcctcctgctcctcggcccccttccgtccatccctcctgttattatcatggcagcaatgaatagtgatctgggtggcttaggtcctagacctgcaaatgcaccaccaaatccttttgaaagtgccatgtatggtgctggacctggactgatccgtactggacttggagcatatggagagaaatttcttggttcgagttctgagttcatgcagagcaatattactcaatatttgtccgaccctcaatactatttttcagtcaacagccagtatgtgaggaacaaactgaaggtcgtcttggtccctttcttcacaagggcccattggacaaaaataactgaacctggaggagggaaggcttatcntaaaaacctccaattcnggaattcaatggccccaacccggaaatcccctttaaagggtttgggccccaaattggaattgctgaaaaccctttgggagcccctgggaaggttccccctgagggcgggccccccaatttccaaaaaggcttttgtgggggttttctccaaaccccccccccacaaggggttggcggacccc

SEQ ID NO: 46845 - protein, 172 aa, Zea mays
  misc_feature: Ceres CLONE 1453289-F
  misc_feature (106)..(106): Xaa is any aa, unknown, or other
  misc_feature (112)..(112): Xaa is any aa, unknown, or other
MAAMNSDLGGLGPRPANAPPNPFESAMYGAGPGLIRTGLGAYGEKFLGSSSEFMQSNITQYLSDPQYYFSVNSQYVRNKLKVVLVPFFTRAHWTKITEPGGGKAYXKNLQFXNSMAPTRKSPLKGLGPKLELLKTLWEPLGRFPLRAGPPISKKAFVGVFSKPPPHKGLADP

SEQ ID NO: 46846 - DNA, 703 bp, Zea mays
  misc_feature: Ceres CLONE 1453292-F
  misc_feature: Encodes the peptide sequence at SEQ ID NO. 46847
  misc_feature (518)..(518): n is a, c, t, g, unknown, or other
ggagctccccgcggtggcggccgctctagaactagtggatcccccgggctgcaggaattcgcacgagaccattacctagaacatcctaatcgaaaatattacagaataaaactacaattgagtaccatgaaggagttagagcgatgtggttggcagaaaaaggtggagacctctatcatcatccatatgaccttggtgtctatgagaatcttatttcagttcttgggcctaacatattttgctggctctgccctgtattgaatactgttggaaatggccttcggtaccgtacatcctatgatattccggtatctacaccaccaaaaaaaatagcagcacattcacaataggtagtagttgctaatttgtgaaaggatttcccattaagctgctagaacgtgtttggtctgaacgattccgaaggcaggtcgtgtaactctgcaacatacaggagatgatgactaccacagcctctcgccaggtgtttgtcctgaatcgagacatgaactcctaacccntgttttttatttcattcctgacatacttgataatgcctccgctggaaatctggaagtaggctgtctttccaaaaagaaaaaaaaactgcaattcctggtgaaaagtaggttccaatggttgggggggcctggaaatgtaacccaaggcctttgaaaccaattttcccaaaaaaaaaaaaaaaaag

SEQ ID NO: 46847 - protein, 68 aa, Zea mays
  misc_feature: Ceres CLONE 1453292-F
MWLAEKGGDLYHHPYDLGVYENLISVLGPNIFCWLCPVLNTVGNGLRYRTSYDIPVSTPPKKIAAHSQ

SEQ ID NO: 46848 - DNA, 707 bp, Zea mays
  misc_feature: Ceres CLONE 1453296-F
  misc_feature: Encodes the peptide sequence at SEQ ID NO. 46849
  misc_feature (595)..(595): n is a, c, t, g, unknown, or other
ctggagctccccgcggtggcggccgctctagaactagtggatcccccgggctgcaggaattcgcacgagaccattacctagaacatcctaatcgaaaaacgaaccaggcaaccagctgccgagggaggaaccctagcggaacactgtgcaggtgacggcggcgcgctaccggtgacgggggatacggcggcatcgtccccctcggcccctcctccatccccggcgcggcggcgccagcagccggcctgcaggttttgcaggtttcacacttcttatcatggatgataagaacaaagtcaagaaggaaatagatggcccccttggacccccacctcgcaaggggggacttaaattcgcaccaaaagtacctcagaagaaacctgccaaggttgtcccaaagaagtatgtgattcggtctacatgttatttctacttacctggatgtcttccatttgagatttgcagaattggcaattctgatgtgaagtgagattttactgtaacttgacagggaaccggttgaagagagaaaggaggatgctttggataaggagttattgatgaaacttaagatgtcgcaaaacaagtatccctncagaattaagtccgacgaaaagcgtaagaatcctggtttttgttcacacatgctttatagtctaaatcttatcactgcctgtgaaaattcaagaagtggtacacaggttgca

SEQ ID NO: 46849 - protein, 70 aa, Zea mays
  misc_feature: Ceres CLONE 1453296-F
MDDKNKVKKEIDGPLGPPPRKGGLKFAPKVPQKKPAKVVPKKYVIRSTCYFYLPGCLPFEICRIGNSDVK

SEQ ID NO: 46850 - DNA, 832 bp, Zea mays
  misc_feature: Ceres CLONE 1453299-F
  misc_feature: Encodes the peptide sequence at SEQ ID NO. 46851
aagctggagctccccgcggtggcggccgctctagaactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcacccaaggggtggctcgtcgcctccctgctgctctgcctcgccgtcacatcggcagcggcaagagcaacgccccgctactgcgacactactgcccccttcccgcggggcaacgggaattgccggccccctgggaccaagaccaccaggatgccaaatatggggaaattttaccggtgggcggaacggcccccgtgattccttttcccccccccgttggtggtgctccccccgcgcgcctctcttaattatggtttccccccccggcccccggggggccctcccccctgggaccgggccctttatttgggcccgtttttccggaaaccaacggttcacgccctctttgtgcccgctatatttgtattccaccccccaggtggccgcggggtgctccggtggttgcctggtaaccctcgttaaacaccctcttaccgcatcgtctccgactccaccccctctatccccctacaaacaacacgaccatcgtactgccctctttatgcacatcctctcggactccgttccgccgggcgttcgtttccgcgacgagactggctccccgaccataatcacgataacccctttctctcatcgtctactctatcatacctccatcgcc

SEQ ID NO: 46851 - protein, 66 aa, Zea mays
  misc_feature: Ceres CLONE 1453299-F
MAPKGWLVASLLLCLAVTSAAARATPRYCDTTAPFPRGNGNCRPPGTKTTRMPNMGKFYRWAERPP

SEQ ID NO: 46852 - DNA, 742 bp, Zea mays
  misc_feature: Ceres CLONE 1453312-F
  misc_feature: Encodes the peptide sequence at SEQ ID NO. 46853
  misc_feature (378)..(378): n is a, c, t, g, unknown, or other
  misc_feature (380)..(380): n is a, c, t, g, unknown, or other
catgctggagctcaccgcggtggcggccgctctagactagtggatcccccgggctgcaggaattcgcacgagaccattacctagaacatcctaatcgaaaaaggaaaccctaggccgctacgcccttggccccttctctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagctacgtgcggcgaccggaccaggcagaccgtgtcatcggcaccctccttggatccctcctccccgatggcaccgtccacgtccgcaactcctacgngnccccccacagcgagtcggccgaccaggtcgccatcgagatcgactaccaccataacatgtacgcctcgcaccagaaggtgaaccccaaggaagtcatcgtcggatggctctcgactggatttggtgtttctgggggaagtacgcttacccatgagttctattcaagggaaggacaaaagccccttccattctaacagtggacaccgggctttccttggggggggaagcttcccactcaaagccctacgttctcatccaaccctgtccccctggggggaataggcaaaccgcgcgtggcccaatttccagggaaacacccctccggggaactcttaggaaaggaaacgggggccaaacaaaag

SEQ ID NO: 46853 - protein, 131 aa, Zea mays
  misc_feature: Ceres CLONE 1453312-F
  misc_feature (17)..(127): Pfam Name: Mov34 Pfam Description: Mov34/MPN/PAD-1 family
  misc_feature (67)..(67): Xaa is any aa, unknown, or other
  misc_feature (68)..(68): Xaa is any aa, unknown, or other
MATPPALLFPSPSSASSPPSSAQVEAVVLFNVCDSYVRRPDQADRVIGTLLGSLLPDGTVHVRNSYXXPHSESADQVAIEIDYHHNMYASHQKVNPKEVIVGWLSTGFGVSGGSTLTHEFYSREGQKPLPF

SEQ ID NO: 46854 - DNA, 721 bp, Zea mays
  misc_feature: Ceres CLONE 1453317-F
  misc_feature: Translation starting site: 174
agagctggagctccccgcggtggcggccgctctagaactagtggatcccccgggctgcaggaattcgcacgagaccattacctagaacatcctaatcgaaaagttgcccttctcttccccactcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagacaaaggggtcgttcctcgacaagggcgaggtcgccgaccgtgtcgtctccgtcgtcaagaacttccagaaggttgaaccctcaaaggtgacacctagtgctcattttcagaaggacctccccacttgatagcctggacactgtggagatcgtgatggcgtttgaggaagaattttcctttgagattcctgacaacgatgcagagaagattgactccatcaagacagcggttgatttcattgcttcgcatcctcaagcaaaataagaggatttctttttttttcgtatttcaaagtgtggttttgcacttttgcatccagaactgtatgcgacacgggactagttttatctagcttgccgcagcagatagggagtcatttctttacccttccgaatcccgcgtgtcccaacgattgttgggctcttgg

SEQ ID NO: 46855 - DNA, 720 bp, Zea mays
  misc_feature: Ceres CLONE 1453318-F
  misc_feature: Encodes the peptide sequence at SEQ ID NO. 46856
atagctggagctcaccgcggtggcggccgctctagaactagtggatcccccgggctgcaggaattcgcacgagaccattacctagaacatcctaatcgaaaaagatcaccagccataccacacgaccgcagaggagtagcaagagcccgggggagaaatgagcgcggcggcgggcgggctgcggcggctgctggcggcggcggcaacggcgggagccgcggaggtgcgggcgtccatcttcggccacgcgctgaaccctacggggaggcgcgcggcgacgaagctcctgcggaagaaaatggtcggcgaccaggtggcgcagtggtacccctacgacatcaagcgcgacgacccgctcgtcatggcgcgcgaggagaaggagcgtctggctaaactggaaatgctgaagcgtcgtggcaagggcccgccgaagaagggtcagggaaggcgtgccgtcaagaggagcaagtagtcgagctgtgctacctatcaatgctcatctctgtttctggagcttgccttgttcttacatgctgtaacgtactacactactaccagtgatttgtcgggtgagtgggcgacgatagatgcaaaaaaaaaaaaaccgccttttctatcaagtttagcttacagatgtttttcccccttcaattgcaatgaaaccgccttctatgttaaaaaaaaaaaaaaaaagcttatcgatcccgtcgacctccgagg

SEQ ID NO: 46856 - protein, 104 aa, Zea mays; identical to SEQ ID NO: 46805
  misc_feature: Ceres CLONE 1453318-F
  misc_feature (14)..(93): Pfam Name: Mit_rib_S27 Pfam Description: Mitochondrial ribosomal subunit S27

SEQ ID NO: 46857 - DNA, 730 bp, Zea mays
  misc_feature: Ceres CLONE 1453320-F
  misc_feature: Translation starting site: 182
aagctggagctccccgcggtggcggccgctctagaactagtggatcccccgggctgcaggaattcgcacgagaccattacctagaacatcctaatcgaaaagtcgcctcctccgccactgccatctccctcctctgtcctccgtaccactcgtcttcgtctagccgccgaccgccaccaccatggcacccggcctctacaccgacatcggcaagaagaccagagatctgctgtacaaggactacaacacgcaccagaagttctgcctcaccacctcctcccccaatggcgtcgcaatcacagccgcaggaacaaggaaaaatgagtccatctttggtgagcttcacacccagattaagaacaagaaattgacagttgatgtcaaagcaaactcagaatcagatcttttaacacaatcactgttgatgaagtcggtactccagggctaaaatcattatcaattttggttgttccagaccagaggtcagggaagctttgattccaatacctacatgaatatgcctgtgtgaaaggaaacgccgggcttaattccaacccataggtaaacctttcgggggcttttgaaaacaaacaccccccggcggggtttaatgcctcttttaaacgggcaaatgcgtttttccccaataaaaacttgcccggggccccccccggccaagaattttgggcccccccccccgaaaaaccccgggggaaccccggtggggccc

SEQ ID NO: 46858 - DNA, 577 bp, Zea mays
  misc_feature: Ceres CLONE 1453324-F
  misc_feature: Encodes the peptide sequence at SEQ ID NO. 46859
  misc_feature (341)..(341): n is a, c, t, g, unknown, or other
  misc_feature (577)..(577): n is a, c, t, g, unknown, or other
ctccccgcggtggcggccgctctagaactagtggatcccccgggctgcaggaattcgcacgagaccattacctagaacatcctaatcggaaaaacactcgcttcccccagccgcacgaaaccctaacgccgccgccgcttcacaggtaaaccgccgccatggtctccggttccggcgtatgcgcgaagcgcatcgtggtggacgcgcgccaccacatgctgggccgcctgtcgtcgattatcgccaaggaactgctcaatgggcagaaggtggtcgtcgtccgctgcgaggagatctgtatgtccggtgggctcgtacgccagaagatgaaggtacctccngcttcctcccgcaagcggatggacaaccaaagccatccccttggggcccatcccaatttccggggccccgttccaaaaatttctggggggggcaccccattcccccgggggattatttccccacaaaaaaccaaaaggggggaaaggggggttttggggagggccctaaaaaaataaaaaggggggtccccccccccccccttttaaaaaaaaaaacaaaagccctggtggttttn

SEQ ID NO: 46859 - protein, 119 aa, Zea mays
  misc_feature: Ceres CLONE 1453324-F
  misc_feature (11)..(107): Pfam Name: Ribosomal_L13 Pfam Description: Ribosomal protein L13
MVSGSGVCAKRIVVDARHHMLGRLSSIIAKELLNGQKVVVVRCEEICMSGGLVRQKMKVPPASSRKRMDNQSHPLGAHPNFRGPVPKISGGGTPFPRGIISPQKTKRGERGVLGRALKK

SEQ ID NO: 46860 - DNA, 848 bp, Zea mays
  misc_feature: Ceres CLONE 1453327-F
  misc_feature: Encodes the peptide sequence at SEQ ID NO. 46861
  misc_feature (1)..(1): n is a, c, t, g, unknown, or other
  misc_feature (11)..(11): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (848)..(848): n is a, c, t, g, unknown, or other
ntttttcgttnctctttttnncnccccgcctgtgggngggannnnnacaaactggagctccccgcggtggcggccgctctagaactagtggatcccccgggctgcaggaattcgcacgagaccattacctagaacatcctaatcgaaaaacgcctcgcttgcggcgactagggcgactgccgccgccgcccttcgcccagctgcccaggtcttcgtcgggcgctttaccggtgaagagcgcccaccataccagagtggccaccagaggattgctacatttgggaaggatgagcaaaggccctgttccattcgccaacattgggaagagagccaaagatctcttgtacaaggactacaactttgaccaaaagttttctttggcgacatgctctaactctggtttgaatctcacagccactggtgtgaagatcaatgaagactgccttggcgatataccggacacaccctaaaaggcggccgacccactcggcgatggcctatcccgatagtgattctgaagtgttaaccaaagtgcggtggtggatgaagcactaggtgggcttcgaagacttcatttgggcgttcaagggtcccggaaccccggggcttgggaagcattgactctgcaaatattgcccaccggcccgttttttcccgcgcattgtggaccctttgggtgtggacattcgcgccccttttgggggggggagctcggttggcaacgtggcccgcgtcccgagcggaaaccttcgccccttgtgggtcgccggaaaggtgcaggggggtgctggagtaaataagctccgcgaccctggctggcggtgacccataaatgtcgcacctctccn

SEQ ID NO: 46861 - protein, 60 aa, Zea mays
  misc_feature: Ceres CLONE 1453327-F
MSKGPVPFANIGKRAKDLLYKDYNFDQKFSLATCSNSGLNLTATGVKINEDCLGDIPDTP

SEQ ID NO: 46862 - DNA, 748 bp, Zea mays
  misc_feature: Ceres CLONE 1453328-F
  misc_feature: Encodes the peptide sequence at SEQ ID NO. 46863
  misc_feature (381)..(381): n is a, c, t, g, unknown, or other
  misc_feature (382)..(382): n is a, c, t, g, unknown, or other
aagctggagctccccgcggtggcggccgctctagaactagtggatcccccgggctgcaggaattcgcacgagaccattacctagaacatcctaatcgaaaagcaattcgcaattcccagccccattccccgtcggccgactccagcgagcgacttcgccccggtcggaagcaccaccagccaccagcgatgtctggcgaggaggaggagaacgccgcggagctcaagatcggcgaagagttcctcaaggccaagtgcctgatgaactgcgaggtggcgatcatcctggagcacaagtacgagcagatccagcagcacgcgtcgtcggagtcggacccgtcgtcgcacgtgtcgcaggtgttcgagaagttgctggagaacnnaaagcgcttcagccgctacaagaaccccgaccccacgcgctaggtccgcgagaacctgagccgctacggccctcgccgagtttcgaggtctgcacgttcggaaacctttgccccgacacctgggggagggcaccggggttggccccccccctcaattccggggggaaggttcttcgggaacccccgggacaaaaaaaaccaaaaaaaatgcccaagaacctcccccctaataaaaaatctctggtaaaagagggagcgcccccctccccctttaccttcctttccccgggaggggtggcgggggctcccgagagggggggggggatttctccctcttcctaccctttttccttgcaacaaattttc

SEQ ID NO: 46863 - protein, 78 aa, Zea mays
  misc_feature: Ceres CLONE 1453328-F
  misc_feature: SWISSPROT Homolog: EC 2.7.7.6 DNA-directed RNA polymerase
  misc_feature (65)..(65): Xaa is any aa, unknown, or other
MSGEEEENAAELKIGEEFLKAKCLMNCEVAIILEHKYEQIQQHASSESDPSSHVSQVFEKLLENXKRFSRYKNPDPTR

SEQ ID NO: 46864 - DNA, 511 bp, Zea mays
  misc_feature: Ceres CLONE 1453330-F
ggagctccccgcggtggcggccgctctagaactagtggatcccccgggctgcaggaattcgcacgagaccattacctagaacatcctaatcgaaaaatccaaatccgtcacggacgcttccacgcgaccaagcagccacgcggcgctggtctggccggccatgtcctgcctcgcggcgccgccggctgcaccgccaaagcgggggagcgcatgctccgcgccgccgctcctttgcgctcgcctttcgccgtgcccggggcctgcattacccgggtgcgggggggacttgaaagggggccaaaaaacccggggggcgggcccggggggaaaaaccgggggcccctctttgggggggcccccccccttgggggaaaacccccgggggggcccccgggggggaagggggctctttcccccatttttttttttatttaaaaggggggccccaaaaaaaacaccgggggggtttttttttccccaaaaaggaacccccccccgaaaggataaaata

SEQ ID NO: 46865 - DNA, 623 bp, Zea mays
  misc_feature: Ceres CLONE 1453333-F
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (214)..(214): n is a, c, t, g, unknown, or other
  misc_feature (224)..(224): n is a, c, t, g, unknown, or other
  misc_feature (365)..(365): n is a, c, t, g, unknown, or other
  misc_feature (402)..(402): n is a, c, t, g, unknown, or other
  misc_feature (407)..(407): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (423)..(423): n is a, c, t, g, unknown, or other
  misc_feature (426)..(426): n is a, c, t, g, unknown, or other
  misc_feature (448)..(448): n is a, c, t, g, unknown, or other
  misc_feature (452)..(452): n is a, c, t, g, unknown, or other
  misc_feature (453)..(453): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (469)..(469): n is a, c, t, g, unknown, or other
  misc_feature (470)..(470): n is a, c, t, g, unknown, or other
  misc_feature (475)..(475): n is a, c, t, g, unknown, or other
  misc_feature (476)..(476): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
ggagctccccgcggtggcggccgctctagaactagtggatcccccgggctgcaggaattcgcacgagaccattacctagaacatcctaatcgaaaagatcttgagacaaaacaaaacccaccgctgcggcaactccgcctcccgccgacccggggatcgcctgacaacaggcagcgaaaagaggcgcagggnnntttgcccgcccaagatgganggaacgtggnacgtcttcccgggcagctttgaagcagaatgacgggctttcttcccccccgggaggccctctaaaaaaggcgcccacaaaaaaagggccccccccccccccagaggttcttcaaaaaaaaaaaatttccccctgtgggggnttatacaagaaaaaaaaaaaaaataccgggcgggggnttttntgnnnnnnaagagganagnaggtaagagaagaggagggagnaggnntgagggtaannnnnannaaaannaggggaagnnnnnnnnnnnnnnnnnnntgggaaggaagagaaagagggagaagaaggagaagagnnanannnnagagagagggnnnggggtgggggtggcgaaaaaaaaaaaaaagagnnnnaannnnannnnnnaagtgggggaga

SEQ ID NO: 46866 - DNA, 711 bp, Zea mays
  misc_feature: Ceres CLONE 1453336-F
  misc_feature: Encodes the peptide sequence at SEQ ID NO. 46867
  misc_feature (552)..(552): n is a, c, t, g, unknown, or other
  misc_feature (554)..(554): n is a, c, t, g, unknown, or other
  misc_feature (563)..(563): n is a, c, t, g, unknown, or other
  misc_feature (565)..(565): n is a, c, t, g, unknown, or other
  misc_feature (566)..(566): n is a, c, t, g, unknown, or other
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaaattgcgatgaggctcatggatatgtccggaaggaggtttctcctcctcgcgacgatcccagtcctaatagtcgcgctactcgtcctggtggtgtccaacatcgtggacgtgggggacgtggcgcacgcggcgctctccacggccagcgtcatagtctacttctgcttcttcgtcatggggttcgggcccgtccccaacatcctctgcgcagagatcttccccaccacggtccgcggtgtctgcatcgccatctgcgccctggccttctgggtcggcgacatcatcgtgacgtacacgctccccgtgatgctgaacgtcgtcgggctcgccggcgtgttcgggatatacgccgtcgtgtgcgtcctagccctcgcgttcgtgttcgtcaaggtgcccgagacgaagggcatgcctctcgaggtcatcaccgagtttctctccgttggggcancnagcccaggnannaagaggaggaagaaggagagcccngggaaaggtgaacaaccggaaggccggacccagttaccgggaccccctgggggggatttttgggggccggccccctccccccgggttgcccccggaaaaaggtattttgaaaaaaaaaaag

SEQ ID NO: 46867 - protein, 236 aa, Zea mays
  misc_feature: Ceres CLONE 1453336-F
  misc_feature (184)..(184): Xaa is any aa, unknown, or other
  misc_feature (188)..(188): Xaa is any aa, unknown, or other
AGAPRGGGRSRTSGSPGLQEFARDHYLEHPNRKIAMRLMDMSGRRFLLLATIPVLIVALLVLVVSNIVDVGDVAHAALSTASVIVYFCFFVMGFGPVPNILCAEIFPTTVRGVCIAICALAFWVGDIIVTYTLPVMLNVVGLAGVFGIYAVVCVLALAFVFVKVPETKGMPLEVITEFLSVGAXSPGXKRRKKESPGKGEQPEGRTQLPGPPGGDFWGPAPSPRVAPGKRYFEKKK

SEQ ID NO: 46868 - DNA, 713 bp, Zea mays
  misc_feature: Ceres CLONE 1453340-F
  misc_feature: Encodes the peptide sequence at SEQ ID NO. 46869
aagctggagctccccgcggtggcggccgctctagaactagtggatcccccgggctgcaggaattcgcacgagaccattacctagaacatcctaatcgaaaagagctggtgttctccttttgctttctcttcttgttcaggagccgggcagggcggaggccgacttcggccggttcgacgtgaggcgcgtggtgcgcaccatctacgtgctcttcgccggcgccgagatcccgattgccaaggaagggcaggagatcatggacctggccgacctgtccacgcccctcccggagtggttcaccgaggaggacctggacgcctacgccaagctctacgagaagtccggcttcgggtacccgctcaagatgccgtacagatctatgcacaagctcccgaaccggctggacgccaagttccaggtgccggtgttcatggtgaatgggggagaaggactacgcgttcaagttcccggggttcgagaccgccatgcgcggcggggtcatggacaacttcatgccggacctcaagatcacctacatccctgaggggagccacttcgtgcaggagcagctcccagagcaggtcaacgacctgctcctcggcttcctcagggaccatccctccgccgcataagcagtgggtgagaccgtcagaataatggaatgcttcctgagcaacggtttctctactctattgccgttgcctggatccatc

SEQ ID NO: 46869 - protein, 95 aa, Zea mays
  misc_feature: Ceres CLONE 1453340-F
MDLADLSTPLPEWFTEEDLDAYAKLYEKSGFGYPLKMPYRSMHKLPNRLDAKFQVPVFMVNGGEGLRVQVPGVRDRHARRGHGQLHAGPQDHLHP

SEQ ID NO: 46870 - DNA, 749 bp, Zea mays
  misc_feature: Ceres CLONE 1453344-F
  misc_feature (377)..(377): n is a, c, t, g, unknown, or other
aagctggagctccccgcggtggcggccgctctagactagtggatcccccgggctgcaggaattcgcacgagaccattacctagaacatcctaatcgaaaactgtcattattgctgatttggtaactaatctttctgtggggtttatgcactgttaatttttccctgtcattttaggtctaatttgtattcgacactctcatcgtagtaactgcctcataggttttgtgccctctgtatacatctctatcggctccatgtccaaggcactgcaccacccttttgttatcaggttttaaaccggcttttggaattgtacacatggatcaatttgtgggagtggaaattagagcagatttctgtgcttttttttttgtanaacatctgccagactaaaatcatcagcaattgtccccccccccctatatctctttctcatcgtcaatggaggtgggtatagcaccagacaacatggcaacgacagacatggccaagctccggcatcctgctgacgcctgctgggggcatcagcctgttctcgtcgggtccccccgctccagatgccgttttcccttgcccctcaatagacacgcaaggccatgggcgcctgaagaaccagggaagaaaaaataagaaccccgaaagcttgtaaaaaaaccatatcggcaattccaccaagcgaaagaaccccccccgaaaacccccggccccaacgatccaacggggaccgccttcttcgcaaagagtatgc

SEQ ID NO: 46871 - DNA, 740 bp, Zea mays
  misc_feature: Ceres CLONE 1453499-F
  misc_feature: Translation starting site: 236
  misc_feature (437)..(437): n is a, c, t, g, unknown, or other
aaagctggagctccccgcggtggcggccgctctagaactagtggatcccccgggctgcaggaattcgcacgagaccattacctagaacatcctaatcgaaatatcgcgttacgtccctacccagcgatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagtttgggtgagggctctgctggtcaggtcacnaggaacatgcttgcaaatgaaggtgtccgttctttctacaagggtttgtccgcccgattgctgaagcaagcgacgtaaccgactgcctcctcttgatcctttaggggtcctacctaccaaaccctttgaaaagaatgaggggagcctttgcctttttttcagaagactttttttggccccaccgcggggcaaattggggcttgggttggaaacccgcgtaatcgggccccttaaaagggaacccatttccacgtccctttttcaaaccccccatttaaaaaagtttcccgggcccccccgaag

SEQ ID NO: 46872 - DNA, 761 bp, Zea mays
  misc_feature: Ceres CLONE 1453501-F
  misc_feature: Encodes the peptide sequence at SEQ ID NO. 46873
aaagctggagctccccgcggtggcggccgctctagaactagtggatcccccgggctgcaggaattcgtctcacccctaatcgaaaaccattctctctctttctcctgttccccgcgagagtcgctcaaggccgcggcgaggagaagcggcagcgcgtcacctctccaatggcatccccgtccttcctccgtgcaacctgtgcaccctcatgaggactagttcactccctgctgtcattgaggcttctggcaatgatgactggaagaaacgaaaggaagcacagagcctgaagaggctcgaggttaagaagaagaggattgagaggaggaactctctcacctgcaacacttcaaaagaagctgctgggcagagtccagaagagatgaatgcaaacactgacaaattagtaagttctgatgaaactattgccagcgctaacgaaagccatagcagtggcaagcatctggtgaaggggcttccaccaaagtaccaggctacaattacatcacaagacagttcgtcagcaatgcgaaagaagccaaactcggccttcaaaggaacagccatcactgaggagcagaactcgtcatcgtctgttccttcctccggtgaagctataagtagcgtgacggcaccaagtctgcctgcgttgtctttggtcccataacagcaacccttggttccagggaagaccaaagcattttaggcagggctggtgcaagggcaaacggcatgggggacgtggaaaggaggatgatgca

SEQ ID NO: 46873 - protein, 152 aa, Zea mays
  misc_feature: Ceres CLONE 1453501-F
MRTSSLPAVIEASGNDDWKKRKEAQSLKRLEVKKKRIERRNSLTCNTSKEAAGQSPEEMNANTDKLVSSDETIASANESHSSGKHLVKGLPPKYQATITSQDSSSAMRKKPNSAFKGTAITEEQNSSSSVPSSGEAISSVTAPSLPALSLVP

SEQ ID NO: 46874 - DNA, 789 bp, Zea mays
  misc_feature: Ceres CLONE 1453504-F
  misc_feature (421)..(421): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
ctggagctccccgcggtggcggccgctctagaactagtggatcccccgggctgcaggaattcgtctcacccctaatcgaaaaattccttccattttacccctccgtccgtctctcacactgtctctctccaccctctcgctctccgacaaggcgacgacgggtaggccaccgccgccggcgccgtcccactacgacaactgctgaggccttcatcgctttcttcgccggcgacgagcacccaccaactaaggtcatggaagagatgatagatctaacggggatggaggtgttcttaagacagtagtgcggaaagcaaaagatgatgctatagcgccatccgagagcctgcccttttggtgatgtcattacgaaggtacacttgctgagactggtgagttttcgataccacccatgaagatnactctattttctccatttgaattggaacaaggcgctgtcatcaaagcatggaattaagcctaaaaaccttgaaggtgggcaagttggcaaaattcctgcaaatcaaaaatgcatttggaggtcggggtccccccaaaaaaaccccccaagggacccttatttttgaggggagcttaaccctttcgggcgaagaaagtccaccctttgggggggtttttgaaaaaaacccccttttaaaatttaaaaaaccggggggccggtccctcacaaaaaaaagaagaaaaaaaaaggggggaannnggggggcgccaccccccggggggaaaaattttttttcccgggggggggggggaggggggggaaaaata

SEQ ID NO: 46875 - DNA, 852 bp, Zea mays
  misc_feature: Ceres CLONE 1453506-F
  misc_feature: Encodes the peptide sequence at SEQ ID NO. 46876
  misc_feature (422)..(422): n is a, c, t, g, unknown, or other
attccctcgccccccccccaaccccacaaaacaacccccaaacaaaagtgggactccccgcggtggcggccgctctttactagtggatcccccgggctgcaggaattcgtctcacccctaatccaaaaactttccgccgcctcccccccggaaaccccggccaggcctagggttcgccgccatgcctcacggagattacatataacttctccacaaacgcctcgtacggcggcatggactaccaggagcgcaagcgcaacaaggaggggcgcgccgtcaagaagaacgccaaggatgcccgcaagctacttggtgccaagggcaagatgttcgccaagaagcggtatgcctaccaggcgcagatgaagaagaccctgccaatgcacggatgagtcttctctcccggcagaaggatgagtaanaatttgaggaaggtgccattccttcgtatcttcttcccccccacccgacacagcgcgccaaggttctcggcgacagcattaagccaatcactgactgaaaaggttggggtatgagatgttccttttccctagcgccatacctgatcgcgtaacaagagatgttccaatcttctgtcagcggcatgcggaaaaatccaaaccatcgcaaacaaattgctaagttaacgccacccttctcttggcccgggcattttccaggaaggcccccccaaccaggacaaggttcattccctgccttgctgactctgcgtttccatccaaggttactttttgtctcaccctcggctttgaaaatgggaacggtactacccttggcatttctgttctctgtgggaggacaagaacgcaccattgttttccaccttatctt

SEQ ID NO: 46876 - protein, 52 aa, Zea mays
  misc_feature: Ceres CLONE 1453506-F
MDYQERKRNKEGRAVKKNAKDARKLLGAKGKMFAKKRYAYQAQMKKTLPMHG

SEQ ID NO: 46877 - DNA, 758 bp, Zea mays
  misc_feature: Ceres CLONE 1453508-F
aaagctggagctccccgcggtggcggccgctctagaactagtggatcccccgggctgcaggaattcgtctcacccctaatcgaaaaatcaaccatattattgagaccaacaagcaacatataaagtggaatcaagtaacaacaacagagcaacaatggcgaccaagatattttgcctccttatgctccttgctctttctgcatgagttgctaaagcagacaattttccctcaatgctcacaagctcctatagcttcccttcttcccccataccttccatcaatgagagcttcaatatgtgaaaacccagctcttcagccctataggctccaacaagcaatcggagcaagcaacatacctttatcacccttgttgtttcaacaatcgccagccctatctttggtgcagtcattggtacaaaccatcacggcacagcagctgcagcaactcgtgctacctgtgatcaaccaagtagctctggcaaacctttctccctactctcagcaacgacaatttcttccattcaagcaactgtctacactgaaccctgctgcttatttgcggcaacgactattaccattcgtccagctagctactgcctactctcagcaacgacaacttcttccatttaacctattggacgcactgaaccacgctgcttatttgcagcagcatatactactaccgtttatccagctagctgccacggaccgtgcttccttcttgacacatcatcagttgctgcctttctacgagcat

SEQ ID NO: 46878 - DNA, 761 bp, Zea mays
  misc_feature: Ceres CLONE 1453509-F
  misc_feature: Encodes the peptide sequence at SEQ ID NO. 46879
aagctggagctccccgcggtggcggccgctctagaactagtggatcccccgggctgcaggaattcgtctcacccctaatcgaaaacactacatcttctttgtcttgaacctctacgccagtgtcaccgtggttgagagtttgatgatggccattgcaagtgtcatacccaatttcctcatgggcatcatcataggagctggaattcagggaatattcatgcttgtctccggatacttcagacttccatatgacatcccgaaggttttctggagataccccatgcagtacatcagcttccattactgggcactacagggccaatgccagaatgacatggacggtctcctattcgacaaccaatacccggaccagccgaagatccctggggagttcatcctgaagtacatcttccagatcaatgtgcaccggtcgaagtggatcgacctgtcggtcatcttcagcatgatcttcatctaccgcctgctgttcttcatcatgatcaaggtgaacgaggacgtgatgccctggatccggggctacatcgcgaggaaaaggcttcagaagaaggtgcctgccatcggcaagacgccttccctgagaggctatgttgtggatccggagcttggtcctaacgaaggctagaaagatataagctgggggttgctgggtagcacaaataggaagtctcctaccggttcttggcgtgatatgtatctatggtcagagaaactggtaaatttttatacgttttggaaacaaa

SEQ ID NO: 46879 - protein, 165 aa, Zea mays
  misc_feature: Ceres CLONE 1453509-F
MAIASVIPNFLMGIIIGAGIQGIFMLVSGYFRLPYDIPKVFWRYPMQYISFHYWALQGQCQNDMDGLLFDNQYPDQPKIPGEFILKYIFQINVHRSKWIDLSVIFSMIFIYRLLFFIMIKVNEDVMPWIRGYIARKRLQKKVPAIGKTPSLRGYVVDPELGPNEG

SEQ ID NO: 46880 - DNA, 699 bp, Zea mays
  misc_feature: Ceres CLONE 1453511-F
  misc_feature: Encodes the peptide sequence at SEQ ID NO. 46881
  misc_feature (419)..(419): n is a, c, t, g, unknown, or other
  misc_feature (444)..(444): n is a, c, t, g, unknown, or other
  misc_feature (543)..(543): n is a, c, t, g, unknown, or other
  misc_feature (546)..(546): n is a, c, t, g, unknown, or other
aaagctggagctccccgcggtggcggccgctctagaactagtggatcccccgggctgcaggaattcgcacgagaccattacctagaacatcctaatcgaaaatcccaccgaattcattccacccccgtctcctccgatcggaccaccgggccagcagcggggcggatcgtgacgtcagcagccatggtgaaggcctaccccacggtgaacgaggactacctcaaggcggtcgacaaggccaagcgcaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcangctgctagagcccatcaaggagcangtccccatcctatcctacgctgacttctaccagcttgctggagtcgtggcagtcgaggtaaccggcggacctgatgtccccttccaccccgggaggcanggnacagctggagctccaccggaagggccgcctcctgatgccacccaggttctgatcacctcaggcagtttttctgaccccagatgggtttgaacaaccagaacatgtttgcccttctggtggccccaccctgggaagatgccccaaggacaggtt

SEQ ID NO: 46881 - protein, 150 aa, Zea mays
  misc_feature: Ceres CLONE 1453511-F
  misc_feature (19)..(151): Pfam Name: peroxidase Pfam Description: Peroxidase
  misc_feature: SWISSPROT Homolog: EC 1.11.1.11 L-ascorbate peroxidase
  misc_feature (79)..(79): Xaa is any aa, unknown, or other
  misc_feature (87)..(87): Xaa is any aa, unknown, or other
  misc_feature (120)..(120): Xaa is any aa, unknown, or other
MVKAYPTVNEDYLKAVDKAKRKLRGLIAEKNCAPLMLRLAWHSAGTFDVATKTGGPFGTMKNPAEQAHGANAGLEIAIXLLEPIKEXVPILSYADFYQLAGVVAVEVTGGPDVPFHPGRXGTAGAPPEGPPPDATQVLITSGSFSDPRWV

SEQ ID NO: 46882 - DNA, 717 bp, Zea mays
  misc_feature: Ceres CLONE 1453512-F
  misc_feature: Encodes the peptide sequence at SEQ ID NO. 46883
tggagctccccgcggtggcggccgctctagaactagtggatcccccgggctgcaggaattcgtctcacccctaatcgaaaactcaaccaccgccccgagatctccccttctctctcctcgcgccgttttcctctctacctctttgatccggcaatggccgcgcccgcccctgccaccaccggcgacctcctacgcgtcgaccccctcgagctacgcttccccttcgagttgagaagcagatctcgtgctccatgcagctgtcgaatcacaccgacgactacatcgcctttcaggtgaaaactacaagtccaaagaagtattcggggcgacccaccactggggttggcttgccccggcctaccctgggaagtgtttgtacaatgcaagccaggggggaacccccccccgaactgctgggaagggaaatttcctatccaaaaaggcttttcccccgggggtataactggaaagaatgcccgggggaaatttttcaaaaaaacccggggtaaaaaaaagaaagagaaatttggggggggctttttttttttcccccaaaacaccccctcttttttttaaaaaaattaaaaaaaaaagcccctccccccggggtgtttttaaaaaaaaaaaaaaaagaagcctctccgggggagccccccccccaccacaaaaaggggggggtttgccccaaaaaaaaaaagaagggggggtttttttttt

SEQ ID NO: 46883 - protein, 85 aa, Zea mays
  misc_feature: Ceres CLONE 1453512-F
MQLSNHTDDYIAFQVKTTSPKKYSGRPTTGVGLPRPTLGSVCTMQARGEPPPELLGREISYPKRLFPRGYNWKECPGEIFQKNPG

SEQ ID NO: 46884 - DNA, 757 bp, Zea mays
  misc_feature: Ceres CLONE 1453513-F
  misc_feature: Encodes the peptide sequence at SEQ ID NO. 46885
  misc_feature (757)..(757): n is a, c, t, g, unknown, or other
ctggagctccccgcggtggcggccgctctagaactagtggatcccccgggctgcaggaattcgtctcaccccctaatcgaaaaatctgcgcaccgacggccgggtccctgctcttcctttcgatccatttaaatatatacgctccccatcccttcccatcgcccccacaccgtctcctccacaacacgctcctcacctcgcggcgactcttgccagggcactcctccgcgaaagccgcatccgctccaaggggagttgatcgagaagcgttggtggacatgggtcagatccagtactccgagaagtacttcgacgacacctacgagtacaggcacgtcgtcctcccgcccgaggtcgccaagctcctccccaagaaccgcctcctgtccgagaacgagtggcgcgcgatcggagtgcagcagagccgcgggtgggtgcactacgcgatccaccgcccggagccgcacatcatgctgttccgccgcccgatcaactaccagcagcagcaggaggcggctgccgcgcagatgctggccaagtgagcccccggtggccagggcggcgaccaggaacgtttaaaaccctaaccccctttccatctctaaaaggggcgtcgctgttctgttgatcaattcctctatgctgttagttggaaacttcgggtgtagttggtggatttgctggtgtgtgccttgtgttcgtggaaattcctgtgaaggaactgccatgtgttaggctgttaccatgcccattttcn

SEQ ID NO: 46885 - protein, 87 aa, Zea mays
  misc_feature: Ceres CLONE 1453513-F
  misc_feature (1)..(72): Pfam Name: CKS Pfam Description: Cyclin-dependent kinase regulatory subunit
MGQIQYSEKYFDDTYEYRHVVLPPEVAKLLPKNRLLSENEWRAIGVQQSRGWVHYAIHRPEPHIMLFRRPINYQQQQEAAAAQMLAK

SEQ ID NO: 46886 - DNA, 709 bp, Zea mays
  misc_feature: Ceres CLONE 1453514-F
  misc_feature: Encodes the peptide sequence at SEQ ID NO. 46887
aagctggagctccccgcggtggcggccgctctagaactagtggatcccccgggctgcaggaattcgcacgagaccattacctagaacatcctaatcgaaaaatagcaacaccctcgccccctcccttctcagcctcaggcggtcaggcccactggccgtacccgcgacgtcttcctcctcggctccgccgccttctgccgatcgcctccgccgaatcgaatagaagaatcgagcgccgctgctggcgaggggctcggcgcacagcgcgggatggcgagcggcagcagcaacggggaaccaagcacggcgccgcaagccaaccggtggtaccacctccggctgggctcctcctggcgtgaaccatcccccaacggcaagttctgcactctcccgctatgaatttaagccagcatccattgaccagactccagcttggtctctgctgagtactaagataaccggggtactgtggaattctataataaactagctcgcaaaacaaaagtgacattttgagggaaacaagaaagaattcacgggaaaaagatgggggcctatttttttgaaggggagacccctttccccaaagaggtttcctaaaggctgtccaaagggtaaggcatgtccccaaattcccgaaaagtctgctcccacttaaatttgcagcctccaacaactgggaaagggggcgaaaaaacagacttctccc

SEQ ID NO: 46887 - protein, 42 aa, Zea mays
  misc_feature: Ceres CLONE 1453514-F
MASGSSNGEPSTAPQANRWYHLRLGSSWREPSPNGKFCTLPL

SEQ ID NO: 46888 - DNA, 829 bp, Zea mays
  misc_feature: Ceres CLONE 1453519-F
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (362)..(362): n is a, c, t, g, unknown, or other
  misc_feature (369)..(369): n is a, c, t, g, unknown, or other
  misc_feature (393)..(393): n is a, c, t, g, unknown, or other
  misc_feature (431)..(431): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (499)..(499): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (510)..(510): n is a, c, t, g, unknown, or other
  misc_feature (514)..(514): n is a, c, t, g, unknown, or other
  misc_feature (517)..(517): n is a, c, t, g, unknown, or other
  misc_feature (522)..(522): n is a, c, t, g, unknown, or other
  misc_feature (523)..(523): n is a, c, t, g, unknown, or other
  misc_feature (540)..(540): n is a, c, t, g, unknown, or other
  misc_feature (544)..(544): n is a, c, t, g, unknown, or other
  misc_feature (545)..(545): n is a, c, t, g, unknown, or other
  misc_feature (553)..(553): n is a, c, t, g, unknown, or other
  misc_feature (555)..(555): n is a, c, t, g, unknown, or other
  misc_feature (556)..(556): n is a, c, t, g, unknown, or other
  misc_feature (558)..(558): n is a, c, t, g, unknown, or other
  misc_feature (560)..(560): n is a, c, t, g, unknown, or other
  misc_feature (561)..(561): n is a, c, t, g, unknown, or other
  misc_feature (564)..(564): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (588)..(588): n is a, c, t, g, unknown, or other
  misc_feature (605)..(605): n is a, c, t, g, unknown, or other
  misc_feature (637)..(637): n is a, c, t, g, unknown, or other
  misc_feature (641)..(641): n is a, c, t, g, unknown, or other
  misc_feature (648)..(648): n is a, c, t, g, unknown, or other
  misc_feature (649)..(649): n is a, c, t, g, unknown, or other
  misc_feature (674)..(674): n is a, c, t, g, unknown, or other
  misc_feature (704)..(704): n is a, c, t, g, unknown, or other
  misc_feature (709)..(709): n is a, c, t, g, unknown, or other
  misc_feature (710)..(710): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (735)..(735): n is a, c, t, g, unknown, or other
  misc_feature (736)..(736): n is a, c, t, g, unknown, or other
  misc_feature (741)..(741): n is a, c, t, g, unknown, or other
  misc_feature (742)..(742): n is a, c, t, g, unknown, or other
  misc_feature (753)..(753): n is a, c, t, g, unknown, or other
  misc_feature (757)..(757): n is a, c, t, g, unknown, or other
  misc_feature (760)..(760): n is a, c, t, g, unknown, or other
ttcgcccggcccaaacttaccaaaaaccaccccccnnnnnnnncnnnnnccatactggagctcaccgcggtggcggccgctctatactagtggatccccccggctgcaggaattcgcgcgagaccattacctataacatcctaatcgaaaactggcgacagcggcggcggcgacgactagcatccacctggggaagagcacgtagcacgaaatggcggcgttcctgaggtcaaaatgttcaccatgtggacgtactttgatgggaagccttggaaatagttagtttggagctgcgaactcttctgttggggcaaaaacaggccttctcattgagatgctattattcagtaaatatcaacatncattccnatgaggactaaccagaaggtggangataaatccgggggtcagtggggtgtgttgtgtggttnaggnnnttgaggggggaggaaaagggagtagggttttgtgggaaatgaacccccgtgccccccccaanccannnccccncccnccncgacnnggttcacccaatagganaacnnaccccctncnngngnnggnaannntnnntggccggttttttgncgtaaagggatcgcaancggcatgggccagcgagggaacctcctttttnaccnacaaccnngggtggggtcctttgcttccccctntaaatttgtcaagcttgatagggcgacccnacggnnttttggtcccggttcccccgnnnannctttnngtcggtagaanggcnccntcagtcaccctgatttttttttttgaacccatttttttgggggtgaggtcctttacgccatgggtttgc

SEQ ID NO: 46889 - DNA, 721 bp, Zea mays
  misc_feature: Ceres CLONE 1453526-F
  misc_feature: Encodes the peptide sequence at SEQ ID NO. 46890
aaaagctggagctccccgcggtggcggccgctctagaactagtggatcccccgggctgcaggaattcgcacgagaccattacctagaacatcctaatcgaaaagcatttcataagggcactctggtaatatcgccttcgccgattttgaatatactcgggttctcggcaaaaccccacaccggcgccgcctcttcctctcggttaagtccagcccactccgccgccgccgaccgcgagaggagttctcttcgccgcctcaaggacgagatggacacatcaagccctgcagcacttgtcaatgcaaagattatgaacatgtttgttgggcaaagagtgcgcacagttgttcaagtccaacacaatgatggtggaatgcttgtcgggcagtcccctgatgggcatcaattgagtatcaaaagcgccatggatgtccctgtatcacactttatggaagtttatggaattgctgaaaacagccagaccatccgcgctgaagtttgcacagattttggtcctgactttgatcccgagacttttaatcaattgtgcaacctggcgagtaacaagttcaagcacatgttcctgtagaggtcatcatcaagtggaggaccttcggccaactgaagcttgtttgaaatcgatatgattcacctctaaatgttctttcactcaccccagtactctgttgtcagtattggactccttttagcatgtattaat

SEQ ID NO: 46890 - protein, 106 aa, Zea mays
  misc_feature: Ceres CLONE 1453526-F
  misc_feature (1)..(105): Pfam Name: Rep_fac-A_3 Pfam Description: Replication factor A protein 3
MDTSSPAALVNAKIMNMFVGQRVRTVVQVQHNDGGMLVGQSPDGHQLSIKSAMDVPVSHFMEVYGIAENSQTIRAEVCTDFGPDFDPETFNQLCNLASNKFKHMFL

SEQ ID NO: 46891 - DNA, 717 bp, Zea mays
  misc_feature: Ceres CLONE 1453534-F
  misc_feature: Encodes the peptide sequence at SEQ ID NO. 46892
  misc_feature (324)..(324): n is a, c, t, g, unknown, or other
  misc_feature (355)..(355): n is a, c, t, g, unknown, or other
  misc_feature (361)..(361): n is a, c, t, g, unknown, or other
  misc_feature (370)..(370): n is a, c, t, g, unknown, or other
  misc_feature (371)..(371): n is a, c, t, g, unknown, or other
  misc_feature (376)..(376): n is a, c, t, g, unknown, or other
  misc_feature (377)..(377): n is a, c, t, g, unknown, or other
  misc_feature (384)..(384): n is a, c, t, g, unknown, or other
  misc_feature (449)..(449): n is a, c, t, g, unknown, or other
aaagctggagctccccgcggtggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtgacgtccgccgcagccgccgaaggccccgcccccgctcctngcgtcgacgcccgcggccgcgtacccctcgncggggnctccctcgnncgcgnncgctttngggtacctctttctgctagatccccgccggaaaacctgggttcctggctccaaaaaaagaaatcntctggtctgggcccgcctggagccccagctccgggggtccgggggggccccttggtaaaaggtccccccgggcctttggtttattttatgggatttggcccccgggggggggtttttaaaaaaaggtgtcccccccggggggggggaaacttttttttaaacccccccgttttttgtccggggaaaaattgaaaacacccccgcgcggttttttgggggaaacaggagggagaaattttttttgttttttttgtgggcgggggggggg

SEQ ID NO: 46892 - protein, 137 aa, Zea mays
  misc_feature: Ceres CLONE 1453534-F
  misc_feature (33)..(33): Xaa is any aa, unknown, or other
  misc_feature (43)..(43): Xaa is any aa, unknown, or other
  misc_feature (45)..(45): Xaa is any aa, unknown, or other
  misc_feature (48)..(48): Xaa is any aa, unknown, or other
  misc_feature (50)..(50): Xaa is any aa, unknown, or other
  misc_feature (53)..(53): Xaa is any aa, unknown, or other
MAGLRMKFVAVAAMAAALVTSAAAAEGPAPAPXVDARGRVPLXGXSLXRXRFXVPLSARSPPENLGSWLQKKKSSGLGPPGAPAPGVRGGPLVKGPPGPLVYFMGFGPRGGVFKKRCPPRGGGNFFLNPPVFCPGKN

SEQ ID NO: 46893 - DNA, 715 bp, Zea mays
  misc_feature: Ceres CLONE 1453536-F
  misc_feature: Encodes the peptide sequence at SEQ ID NO. 46894
aaagctggagctccccgcggtggcggccgctctagaactagtggatcccccgggctgcaggaattcgcacgagaccattacctagaacatcctaatcgaaaaactctggactggagggcaccaagctaacatttagttgcaaaggagcgctaggaagaagaagcaacgagccatggcctccggtggcccgaaacccaaactggcctacatcatcttgtacgtgagggacgtggagaaggccgcctccttctacgacgccgccttcggctacaccgtccgccgcctcgaccagtcccgcaagtgggcggagctggagagcggggcgacgaccatcgcgttcacgccgctgcaccagcgggagacggacgagctgtcgggggcggtgcagctgccggactcgtcggccgccgggaggggctccgtagaggtctgcttcgcctacgcggacgtcgacgcggcgtacaagcgcgccgtggacaacggggccgtggccgtgagcgcgccggaagacaagccctggggccagaagtccggcttcgtgcgggacatggacgggcacatcgtgcgcatcgcgagctacgtggcgagagtagtcgcattccgctgcatcaccattcggtcgaatcgatcagcctttcccaaggctgtctcgtatactacacgttctacacgtgtacaaaaaaataaataataatccgtggtgcaaggtcatgtt

SEQ ID NO: 46894 - protein, 172 aa, Zea mays
  misc_feature: Ceres CLONE 1453536-F
  misc_feature (9)..(133): Pfam Name: Glyoxalase Pfam Description: Glyoxalase/Bleomycin resistance protein/Dioxygenase superfamily
MASGGPKPKLAYIILYVRDVEKAASFYDAAFGYTVRRLDQSRKWAELESGATTIAFTPLHQRETDELSGAVQLPDSSAAGRGSVEVCFAYADVDAAYKRAVDNGAVAVSAPEDKPWGQKSGFVRDMDGHIVRIASYVARVVAFRCITIRSNRSAFPKAVSYTTRSTRVQKNK

SEQ ID NO: 46895 - DNA, 741 bp, Zea mays
  misc_feature: Ceres CLONE 1453538-F
  misc_feature: Translation starting site: 518
  misc_feature: SWISSPROT Homolog: EC 2.7.11.1 Non-specific serine/threonine protein kinase
  misc_feature (741)..(741): n is a, c, t, g, unknown, or other
aaagctggagctccccgcggtggcggccgctctagaactagtggatcccccgggctgcaggaattcgtctcacccctaatcgaaaacttagtcatctcctcccgcatcgctagccgccctcatccccacacgctcgccaaaccctagctatcaacatcctacctctccctcctggagctcgcccagcagcgcgacatccttgtctacgacttcgtctccaacggcacgctcagtgccgccgtgccgctgctccccaggcggacccacctcgcgatggtcgcccagatcgcggcggcgctcgagaacctccactttggcatgaacccgccgtcgtgcaccgcgacatcacctcgtccaacatcttcgtggaggccgacatacgggcatgcctcagtgacttcggcctctccctcctcctcgcaccgccggacatgtgcgcaacggagggcactcgtgacctcgtgtgctgcacctcgcctagctggggcccgtggacgttggcaaggagcggcgggacatggcgctggcggtctgggtggcgcccaagatccaggtcggtgagcacagggtggtcgtcgacccaccggtgctgcccaagatccagtgtggttgtgtaggtaatagttgcctattatttactcttggatgataggattcgtacaagtggttatcttggatctcattttcaataatagagggatttgatgccccttgtacacatgtacagtgaggtattttggn

SEQ ID NO: 46896 - DNA, 731 bp, Zea mays
  misc_feature: Ceres CLONE 1453541-F
  misc_feature: Encodes the peptide sequence at SEQ ID NO. 46897
  misc_feature (628)..(628): n is a, c, t, g, unknown, or other
agctccccgcggtggcggccgctctagaactagtggatcccccgggctgcaggaattcgtctcacccctaatcgaaaagtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatattacgccttcaatgtgctcgggaaagggtgtgttttcacctatgatgcagtaggttcctatgagagaactggttatagtgctcagggaacgggatctactttgattatgccagtcctggacaatcaactaaaatcaccaagtcctctattgctccctgcccggnatgctgtcacaccattggtcggagtcagaggccatcgatctagttaaaggatgtgtttgcatctgccactgagaaaagactcctacctgggagacaagttgga

SEQ ID NO: 46897 - protein, 177 aa, Zea mays
  misc_feature: Ceres CLONE 1453541-F
  misc_feature (10)..(175): Pfam Name: Proteasome Pfam Description: Proteasome A-type and B-type
  misc_feature: SWISSPROT Homolog: EC 3.4.25.1 Proteasome endopeptidase complex
  misc_feature (163)..(163): Xaa is any aa, unknown, or other
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGKGCVFTYDAVGSYERTGYSAQGTGSTLIMPVLDNQLKSPSPLLLPARXAVTPLVGVRGHRSS

SEQ ID NO: 46898 - DNA, 728 bp, Zea mays
  misc_feature: Ceres CLONE 1453543-F
  misc_feature: Encodes the peptide sequence at SEQ ID NO. 46899
aagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgttaaataaa

SEQ ID NO: 46899 - protein, 72 aa, Zea mays
  misc_feature: Ceres CLONE 1453543-F
MGKTPVRMKAVVYALSPFQQKVMPGLWKDITTKIHHKVTENWISATLLLTPVVGTYQYAMWYKEQEKLSHRY

SEQ ID NO: 46900 - DNA, 590 bp, Zea mays
  misc_feature: Ceres CLONE 1453544-F
  misc_feature (402)..(402): n is a, c, t, g, unknown, or other
  misc_feature (412)..(412): n is a, c, t, g, unknown, or other
aaagctggagctccccgcggtggcggccgctctagactagtggatcccccgggctgcaggattcgcacgagaccattacctagaacatcctaatcgaaaagccacatcgcagagccagagcagggagacgacgcagatctcgccacgcgaacacagttagatcgaggggagtagtgagagtgagagccatgacgggagctgtcgacacggcgtgaccagcttcttcactggcggaggggtgggacccctccccccccaaaaggggaacggggggggggggcccccgggggaggggccgggccgggacgggccaagaagtttcggtttttgggggggggaaccctggggaattttgaaaacccccccgaaaacctttttttttgtggggccccccctctctanaaaaatcccnttttcttttaaaaaaacccccttgggtttttaaaaaaggggccccccccacaaaaaaccccctttagggggggggaaataatcccggggggggggggcgccttctttttttggggggggggggggggcccccccccccttttttttttgcaaacaaattttctccgggagagaaagaa

SEQ ID NO: 46901 - DNA, 748 bp, Zea mays
  misc_feature: Ceres CLONE 1453546-F
  misc_feature (380)..(380): n is a, c, t, g, unknown, or other
  misc_feature (403)..(403): n is a, c, t, g, unknown, or other
  misc_feature (426)..(426): n is a, c, t, g, unknown, or other
aaagctggagctccccgcggtggcggccgctctagaactagtggatcccccgggctgcaggaattcgcacgagaccattacctagaacatcctaatcgaaaactaataacatttcctactcctgccggatcagactagcgagccaagccaccgacggccgacgtcgagcctccgcggccgagcctccgcctagcaccaactccgtcgtcgatcgtcctatgcgaccacgcccccgtccgccttccgtctcctgcctccactgagtcgcgggcgcgacatcggggaacgccaaggctgagcttcgcccatacgcctaccgcccctgtatgccccgaaccgccgtgctgaggtccgcccagccggggctagagcttctcctngcagaccccaccccgtctaacgnagctccatgcctccgcccagggncatgttcgagctacgccccaagcttctgtccagtgccctggccacttagagggtctgctccccctggaatttgtctggttcaacaacttcaactccaccaagggagcttttttcccagaacttggggtgcccaaaggaataaaggggcggggaatttggcttttctccctggaaaaaggagggtacggggctggcccccccaataaaacattgggggggaaggggtttagaccccttgaaaaaattggggccccggggcaagggccccccccaaaataaaaaaaaggggggggggggggtcttttttttgggaaaaaggaaa

SEQ ID NO: 46902 - DNA, 733 bp, Zea mays
  misc_feature: Ceres CLONE 1453548-F
  misc_feature: Encodes the peptide sequence at SEQ ID NO. 46903
  misc_feature (424)..(424): n is a, c, t, g, unknown, or other
  misc_feature (425)..(425): n is a, c, t, g, unknown, or other
  misc_feature (433)..(433): n is a, c, t, g, unknown, or other
ctccccgcggtggcggccgctctagaactagtggatcccccgggctgcaggaattcgcacgagaccattacctagaacatcctaatcgaaaaactgaggacaaagcgaaaagaaaaaaaaagggaaaaggggctggtgcgcaaaaccctagcgcagtcgcatccatcatggcgatgtccatcttcgtcggcggcgactccggtgcgctcatcgcgccgtccgcgtcctcgctccgcccgccgttccgtcttgccgctggtcccaagggccatttttgtacttttcctcatggagcatctagcaatcacagccggctatgtgttgaacatcaaaggtgttctcgcagctccacccagaactatgctctttctaggaaggatttttctcctataactcaagatgcgcaaggcttcctttcacatgnntgtaacantgggttttcttgaccgtctgaaaattagcgtgaaagataatgttttctgccaccaccaccaaagatccctccattgcaaacatcgcaaacagagggctaagatgatcctgtttctccaacggggttgaatcagggataaggcaaagaaaaaaatcgggaaaactcctttgagcccctgtctgatatttttaaaaaaaaactcaggaaaaccccccaggggaaattcaaatgaaggtgggcttggacccgtaaccctggtaaatccctgggccccggggaaaccaaaacccggaattttaa

SEQ ID NO: 46903 - protein, 92 aa, Zea mays
  misc_feature: Ceres CLONE 1453548-F
  misc_feature (86)..(86): Xaa is any aa, unknown, or other
  misc_feature (89)..(89): Xaa is any aa, unknown, or other
MAMSIFVGGDSGALIAPSASSLRPPFRLAAGPKGHFCTFPHGASSNHSRLCVEHQRCSRSSTQNYALSRKDFSPITQDAQGFLSHXCNXGFS

SEQ ID NO: 46904 - DNA, 707 bp, Zea mays
  misc_feature: Ceres CLONE 1453551-F
  misc_feature: Encodes the peptide sequence at SEQ ID NO. 46905
  misc_feature (508)..(508): n is a, c, t, g, unknown, or other
  misc_feature (618)..(618): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaatttttgctactgatttctttgaagtcaaggctgtgaaagaaattgagcctgcacttaagaagcagctcatcatctccactgtcctgatgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgncatgtacggcatcgcagttgccgctcttggtatgctgagcacaatttgcactgggtctgctattgatgcttatggtccccatcagtgacatgctgggtgtattgctgaannatgctgaatgagtcacagaatccgtggagagactgatgctcttgatgctgctggcacaacactgccgctatttggaaaggatttgcct

SEQ ID NO: 46905 - protein, 135 aa, Zea mays
  misc_feature: Ceres CLONE 1453551-F
  misc_feature: SWISSPROT Homolog: EC 3.6.1.1 Inorganic diphosphatase
  misc_feature (107)..(107): Xaa is any aa, unknown, or other
MTVGIAVISWLALPAKFTIFNFGTQKDVSNWGLFFCVAIGLWAGLIIGFVTEYYTSNAYSPVQDVADSCRTGAATNVIFGLALGYKSVIIPIFAIAVSIYVSFSIAXMYGIAVAALGMLSTICTGSAIDAYGPHQ

SEQ ID NO: 46906 - DNA, 798 bp, Zea mays
  misc_feature: Ceres CLONE 1453553-F
  misc_feature: Encodes the peptide sequence at SEQ ID NO. 46907
  misc_feature (382)..(382): n is a, c, t, g, unknown, or other
  misc_feature (417)..(417): n is a, c, t, g, unknown, or other
  misc_feature (432)..(432): n is a, c, t, g, unknown, or other
  misc_feature (466)..(466): n is a, c, t, g, unknown, or other
  misc_feature (603)..(603): n is a, c, t, g, unknown, or other
  misc_feature (606)..(606): n is a, c, t, g, unknown, or other
  misc_feature (607)..(607): n is a, c, t, g, unknown, or other
ggagctccccgcggtggcggccgctctagaactagtggatcccccgggctgcaggaattcgtctcacccctaatcgaaaatctgtagcctcgtcagtttctgtagtactagctgttcctttggtgttccctagattgattcctatccacgatctcacatcaagggatgacgatgattctcttatacccagtccccttatgctcaatagtgagaatgtacaagaggatggagtttatttattggaaaatggtgaggatggtttaatttatgtaggaaacatggtaaatccggctaccctggaacaaatattcggtgtctcttctttggctgcattaccagcccagttggcgttggagcaatttgacaacgaactctcgagaanggtaacgaaagtgtaaatgaaataagaccccaaangtgctcatacttganggtaaagacatgcagaaggggtgaaccatctggntgatttttcccgggcattttaatggaagacaaggcgcctggcgtcttctcctacgtcgagttccttgtgcatgtccccaggcaaatcccaagcaagatgaactggagggcccaaaatcctggttgatacattcccgnccnnaaaatggattggatgttccccccggaagtttgattttctgctaaggagaacccccaagggggaattcctttacaaggtgagactaaaaagaggggccgaaaaaaaaaacccccgaaataaaggtgtggggggtttaacacaccctcttttgggagggggggggaatatgtgggttattaaacaaaaaaagg

SEQ ID NO: 46907 - protein, 66 aa, Zea mays
  misc_feature: Ceres CLONE 1453553-F
  misc_feature (62)..(62): Xaa is any aa, unknown, or other
MLNSENVQEDGVYLLENGEDGLIYVGNMVNPATLEQIFGVSSLAALPAQLALEQFDNELSRXVTKV

SEQ ID NO: 46908 - DNA, 729 bp, Zea mays
  misc_feature: Ceres CLONE 1453561-F
tggagctccccgcggtggcggccgctctagaactagtggatcccccgggctgcaggaattcgtctcacccctaatcgaaaaaaattagacggataatatcgtcctccgcgggacaaggcacctcacgagcccttctcgtcctcagatctagcgccgcctccttcaccctgctgctggccgcctggccggcgagctcctcagcgtggaagaagacaaaaaacgttatagtgaagaggaggggttgattgctgcattcaaaagtgtcggggataccttatccaatgctactgagaaggttgccacaggggacactgatgtgccagatgatctttttatagtttgataaacctttcaggttttgagcagacccacatatctctgtatttcaattatctggtggcgcaccctcacattgctagagccttcaacaagttgtcattcgaccacaagttaatctgggctcgcaatttcgtcagtgaaaagttcctaggagtgtgagggcagttggtaggtaggcttggagggttcttttgcttgaaccacattgaacaatgaactgcgatctatgtgtaaccaggagtgtgagggcagttagtagataggcttggacggttcttttgcttgaactacatcaaacaatgaaatgtcgtctaagtatgtcagcggattttgcttgaacatgcagattttgtggaagccttaaacttgatattatgtgtaatgctagga

SEQ ID NO: 46909 - DNA, 747 bp, Zea mays
  misc_feature: Ceres CLONE 1453562-F
  misc_feature: Encodes the peptide sequence at SEQ ID NO. 46910
ggagctccccgcggtggcggccgctctagaactagtggatcccccgggctgcaggaattcgtctcacccctaatcgaaaaactgccgtcttcactgctgccaggcgccagccacggcccacggccaatgcaattgcagttgcagttgcaattgcacggcacccatttccagagccgtcctcaattagctagtcaaatctcgctatcctttccccaccatccagatcttccctttcatggacgccgccgtctccaccctcaccgctctcgccatcttcgcgagcaccgtcgagcacggtcggtgcaggcctccgccacgctttctaaattgcttccctcccggtcccggggcaccgcacgacatgaacccacagctgcagtatctgtctaatctgtacaatgacctgctgatggtgtttcggtttcgagaagagaaaacggtcccacaactcgttaattcaaagcaacccatccgttgtggtgaacaggggaaaacttctgatttgggtgatgcatcggagtccgattcggatggggattgtcaatctggcaaagaacttgcaccaccagttcagaagcatacaagagccaaccggaagcatatagatagcattactttagttgatatagctcagtacttccatcttccaatccgagatgcatcaaagacactcaagattggggtcagcatattgaagaggaaatgccgacagtatgggatacctcgttggcctcaccggaagatcaa

SEQ ID NO: 46910 - protein, 170 aa, Zea mays
  misc_feature: Ceres CLONE 1453562-F
  misc_feature (122)..(170): Pfam Name: RWP-RK Pfam Description: RWP-RK domain
MDAAVSTLTALAIFASTVEHGRCRPPPRFLNCFPPGPGAPHDMNPQLQYLSNLYNDLLMVFRFREEKTVPQLVNSKQPIRCGEQGKTSDLGDASESDSDGDCQSGKELAPPVQKHTRANRKHIDSITLVDIAQYFHLPIRDASKTLKIGVSILKRKCRQYGIPRWPHRKI

SEQ ID NO: 46911 - DNA, 460 bp, Zea mays
  misc_feature: Ceres CLONE 1453564
  misc_feature: Encodes the peptide sequence at SEQ ID NO. 46912
acacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcatcgacaccgtcgcggaggcaccccacatcggctgaggtttaaatctacaaaatgaatgactcggacatgccatgcgtacctgtccgtcgcccaataatggatgtgtgtgtgcttcgatcgtccctataagttgctagtaaagataatggcatcgtcgttctgcatgaataacacgtatcagaaagtggaaactggctcgacttctaaacatcggagtc

SEQ ID NO: 46912 - protein, 71 aa, Zea mays
  misc_feature: Ceres CLONE 1453564
  misc_feature (12)..(71): Pfam Name: potato_inhibit Pfam Description: Potato inhibitor I family
MSSTGGGDDGAKKSWPEVVGLSLEEAKRVILCDKPDADIVVLPVGTPVTMDFRPNRVRIFIDTVAEAPHIG

SEQ ID NO: 46913 - DNA, 768 bp, Zea mays
  misc_feature: Ceres CLONE 1453570-F
  misc_feature: Translation starting site: 371
  misc_feature (708)..(708): n is a, c, t, g, unknown, or other
  misc_feature (709)..(709): n is a, c, t, g, unknown, or other
  misc_feature (740)..(740): n is a, c, t, g, unknown, or other
  misc_feature (751)..(751): n is a, c, t, g, unknown, or other
agagctggagctccccgcggtggcggccgctctagaactagtggatcccccgggctgcaggaattcgtctcacccctaatcgaaaacaaaaacgttttaccccgtccggccgtccccctcgttctttctctcccccttctctctcgctgcgacgactgggtaggctgccgccgccgccctacgccaggtcccgaggaccaaggcattcgtattcgtcagtctcttcgccgggcgacgccagtttggttggaacttggagtgtagagggaagatttggtgatgagcagccgcagcccgccgccgaaggaccgcaggatgcgtactgaacgcacctcataccgtggcgcaccatatcggagggacagccgccatggtccaagcaggtttcggaatgatttgtgcaacaattgtaagcgtcctgggcattttgctagagagtgtcctagcgtggctgtctgtcatacctgcgggcttcctgggcacattgcagctgaatgttcttccaaaggtacctgctggaactgcaaagagcctggccacatggctaacagctgcccaaatgaagggatatgccgtaactgtggcaagtccggacatattgcaagagactgcactgctccaccagtgccgccaggagaagtgatcctttgcagcaactgctacaagccagggcattttcgtgaggaatgcaccaatgagaaggcctgnncacattgccggcagagtggccatattgcccngtactgcaccnatgatccctgttgcacc

SEQ ID NO: 46914 - DNA, 707 bp, Zea mays
  misc_feature: Ceres CLONE 1453573-F
  misc_feature: Encodes the peptide sequence at SEQ ID NO. 46915
cagagctggagctccccgcggtggcggccgctctagaactagtggatcccccgggctgcaggaattcgcacgagaccattacctagaacatcctaatcgaaaaattcgcactctcctatgtcctatcaattcaccagcaaaaatttcccagcgccggcctcgcggcagaccggcctccgtatcactgcgcaaccgatggcttcctccccgtggctgcgcaccgccggtgccgcccctgtcccgccgctagaagcagcagctgctgctgctaccgccgccgccacccccgccccgacgtcggagcaacaccgggttaaggaggaaggaaacgctgccgccgcgactgtaccgaagcaggaggaggccaagctccacttgccgcgggacaacgactctaacccaagagcatggacaaaaaatcaatagatatcaagcaatccttgcagcccgtctgaaggctaagtttttctctaagaaggcttttgacagagggaacatttttgaatcagaaaccattgttggaggtgaaacaattcgctcaagcaggtggccatgtacaagatcatttgcaaacccagaatttttttcccgcgacaagaacatccatgagaagggaaattctccatcttcagcagcagatttttctgccaagaacaactctccacccttggctggtgaagcctcaccaaagaataatgctagtgctt

SEQ ID NO: 46915 - protein, 76 aa, Zea mays
  misc_feature: Ceres CLONE 1453573-F
MASSPWLRTAGAAPVPPLEAAAAAATAAATPAPTSEQHRVKEEGNAAAATVPKQEEAKLHLPRDNDSNPRAWTKNQ

SEQ ID NO: 46916 - DNA, 752 bp, Zea mays
  misc_feature: Ceres CLONE 1453575-F
  misc_feature: Encodes the peptide sequence at SEQ ID NO. 46917
aaagctggagctccccgcggtggcggccgctctagaactagtggatcccccgggctgcaggaattcgcacgagaccattacctagaacatcctaatcgaaaaaccattccccgttgggaattttcttgatttcgtagagattcgatcgggttcgccggttcgcgcccgccgccatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcccccgatgatcatatcaagcggactgaatggacttttaggcaaaagctactcttgagctcacccacaactgggggacggaaaaatgacctgaatttcaaaggttacaataatgggaactccaacccctcgtggttttggggcaaaaatagagtaactggggaatgaagtccaccaaggcatgggaacccctttgaaccccctttggggtttaattttcgtaaaaaaaccctgatagaggaaaaaaatcaaagggcttccttttccaccaaaaaaccctgagcgggttcccgggaaccaaaattttttccccccacaaattgggggacgtgaaacttttttcag

SEQ ID NO: 46917 - protein, 133 aa, Zea mays
  misc_feature: Ceres CLONE 1453575-F
  misc_feature: SWISSPROT Homolog: EC 4.4.1.5 Lactoylglutathione lyase
MATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKLLLSSPTTGGRKNDLNFKGYNNGNSNPSWFWGKNRVTGE

SEQ ID NO: 46918 - DNA, 725 bp, Zea mays
  misc_feature: Ceres CLONE 1453581-F
  misc_feature: Encodes the peptide sequence at SEQ ID NO. 46919
  misc_feature (321)..(321): n is a, c, t, g, unknown, or other
agagctggagctccccgcggtggcggccgctctagaactagtggatcccccgggctgcaggaattcgcacgagaccattacctagaacatcctaatcgaaaaaagcaacgagacaacaacaacaaccctgcaccgccgcagcacttgcgccgtccggtcctgtcctcccgcggtctcgacgccgtcccctaccgtcctaccttatcgcgcaccgctccatggccgccaagtgggcccagaagaccgtcgttatcccggcgcatcggcggggctgccacctcatcacccccaagattctgagggagatcgagggcgacctgnccgggttcaagtgcggtctcgcgcatttcttccttcagcacacaagcgcatcgctgaccatcaacgagaactatgactctgatgtgcaggctgacactgagacttttcttacagaattgttcagaggcccccatgctccttggaaccccctatggaagaactgataacttgccacccaatttaaaactccaggtttggtggtccccaacaatccaaaaactgaggggccttccataacgggccttgggaggggatttggttttggaaaatttgaaaccttgccccccccccaaaaattgtattactctcccgggggggaaatttgaaaattttattttccccccaaaaaagggcccagcaatttggcccccaaggtgttctcctccccccgcccatggtggggg

SEQ ID NO: 46919 - protein, 88 aa, Zea mays
  misc_feature: Ceres CLONE 1453581-F
  misc_feature (35)..(35): Xaa is any aa, unknown, or other
MAAKWAQKTVVIPAHRRGCHLITPKILREIEGDLXGFKCGLAHFFLQHTSASLTINENYDSDVQADTETFLTELFRGPHAPWNPLWKN

SEQ ID NO: 46920 - DNA, 739 bp, Zea mays
  misc_feature: Ceres CLONE 1453582-F
  misc_feature: Encodes the peptide sequence at SEQ ID NO. 46921
  misc_feature (627)..(627): n is a, c, t, g, unknown, or other
  misc_feature (628)..(628): n is a, c, t, g, unknown, or other
  misc_feature (670)..(670): n is a, c, t, g, unknown, or other
  misc_feature (724)..(724): n is a, c, t, g, unknown, or other
ggagctccccgcggtggcggccgctctagaactagtggatcccccgggctgcaggaattcgtctcacccctaatcgaaaattgggtatgatctgtatggtgccaacctgaatgatgatgacatggacatggctatgacccggtacagcttacctgaggtggttcttgtcaagaagagctatgagaagaggcctcgcacacggcgatggaagcttaagaggctgccggtggaggaagatgctgcaaataaggccaagggcgaggaagagaagaggctagatgagtacgaggctttcctcagggatttggaggtggactcagggatgtggtccaagatgaatctgtacaaaaatgaggactataggtctgagatggcatcaacagttggtgatgatatccctacggtgccaattgaggagctgattgaggacttgacccttggtgacgatgaggaggatgaagggaaagaaactgtggaagggaacactcatactggaatggtggaatgagcaatactgtctactatttgtttccgaattgctgactgggatgggttggcctacctgcccccttctggtgatgagcctgtcagttatcatatatgttatttttggttggtactgctacnnagtagaattttgggtgtagtgcttaagtttgaattctgctgnttgtcgaatcatcttttttttcaactctttccctgtattcccaactttcataanttttatataaaaagt

SEQ ID NO: 46921 - protein, 128 aa, Zea mays
  misc_feature: Ceres CLONE 1453582-F
MDMAMTRYSLPEVVLVKKSYEKRPRTRRWKLKRLPVEEDAANKAKGEEEKRLDEYEAFLRDLEVDSGMWSKMNLYKNEDYRSEMASTVGDDIPTVPIEELIEDLTLGDDEEDEGKETVEGNTHTGMVE

SEQ ID NO: 46922 - DNA, 732 bp, Zea mays
  misc_feature: Ceres CLONE 1453585-F
  misc_feature: Encodes the peptide sequence at SEQ ID NO. 46923
  misc_feature (354)..(354): n is a, c, t, g, unknown, or other
  misc_feature (355)..(355): n is a, c, t, g, unknown, or other
  misc_feature (360)..(360): n is a, c, t, g, unknown, or other
  misc_feature (361)..(361): n is a, c, t, g, unknown, or other
  misc_feature (487)..(487): n is a, c, t, g, unknown, or other
  misc_feature (495)..(495): n is a, c, t, g, unknown, or other
  misc_feature (499)..(499): n is a, c, t, g, unknown, or other
  misc_feature (518)..(518): n is a, c, t, g, unknown, or other
  misc_feature (519)..(519): n is a, c, t, g, unknown, or other
  misc_feature (573)..(573): n is a, c, t, g, unknown, or other
aaagctggagctccccgcggtggcggccgctctagaactagtggatcccccgggctgcaggaattcgcacgagaccattacctagaacatcctaatcgaaaaatcagagcaggcggtgctgctccagcggcaaccgccgccgtacgctaggcccgagcccgacacgcggagcgtcaagccggatcgcccggcgatgaggtttggtgccaagccgccgctccctcagccgggggcccaggtcggctgcaacaagctgctggctgggtacctggcgcacgagttcctgcggtgcggcacgctcctcggcgagcggaggctggagctgccccgtctgaaggagaaaggatccctcgnnctcannctcacccctgcgccggagccgagcaggcgctacgcggaggtttcgcggctgctttatgcgggcggggcccgcatacccggcgtcgtcaaccggtcgcagctcgaacgctggctccggattcaggantgacgggntggncatcccccccagccgctgnnagtcgggtgcatgcggacaatggccccattgcccactggttttctttcttccgnaggggccgattaaaagaaaccgttttttttgaacaaagcaggggggttttcagggttcaaattttttttcccttaaaaattttgcgggaaaaaataaaaaaaccagggggtcttttaaaaaaaaaaatggggcccgtttgggcaaaaaaattattttgt

SEQ ID NO: 46923 - protein, 97 aa, Zea mays
  misc_feature: Ceres CLONE 1453585-F
  misc_feature (54)..(54): Xaa is any aa, unknown, or other
  misc_feature (56)..(56): Xaa is any aa, unknown, or other
MRFGAKPPLPQPGAQVGCNKLLAGYLAHEFLRCGTLLGERRLELPRLKEKGSLXLXLTPAPEPSRRYAEVSRLLYAGGARIPGVVNRSQLERWLRIQ

SEQ ID NO: 46924 - DNA, 705 bp, Zea mays
  misc_feature: Ceres CLONE 1453586-F
  misc_feature: Encodes the peptide sequence at SEQ ID NO. 46925
agagctggagctccccgcggtggcggccgctctagaactagtggatcccccgggctgcaggaattcgcacgagaccattacctagaacatcctaatcgaaacgcatctacgttctactcccactcgcggtcgcggtagccggcggcggcggcggaggaaagcaggcaggccatggcgtcgtcgtcgtcgtcgaccccggcggccgtccgcgagatgcagaaggatctcgaggtccaggccaacgccctcagcaagatccagaaagacatcgccaagaaccaccaggtccgcaagcagtacaccatccaggtcggcgagaacgagctcgtcctcaaggagctggagctgctcagcgatggggccaacgtgtacaagctcatcggaccggtgctggtcaagcaggacctcgctgaggccaaggccaacgtcaagaagcgcatcgagtacatctccgcagagctgaagcggatgggatcggcgctcaaagacttggaggaaaagcaaaacagccagaaggaatccatattcaagttgccgcaaaggatgcaagcttgtacaggcttaaggtttttaaaaaaaactggtttttggggttcaacaatctccagggccgggtttttttttctccccaatcccccccccggttttttttttttggggggggaaaaaaggtgtctaaaatttctcccctccccccacaaaaaa

SEQ ID NO: 46925 - protein, 178 aa, Zea mays
  misc_feature: Ceres CLONE 1453586-F
  misc_feature (20)..(124): Pfam Name: Prefoldin_2 Pfam Description: Prefoldin subunit
MASSSSSTPAAVREMQKDLEVQANALSKIQKDIAKNHQVRKQYTIQVGENELVLKELELLSDGANVYKLIGPVLVKQDLAEAKANVKKRIEYISAELKRMGSALKDLEEKQNSQKESIFKLPQRMQACTGLRFLKKTGFWGSTISRAGFFFLPNPPPGFFFLGGEKRCLKFLPSPHKK

SEQ ID NO: 46926 - DNA, 759 bp, Zea mays
  misc_feature: Ceres CLONE 1453590-F
  misc_feature: Encodes the peptide sequence at SEQ ID NO. 46927
aagctggagctccccgcggtggcggccgctctataactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccccaactaaactgtttgagtactatgctaagctgaggagctgccttccctcatgtggtggagcccgagggaggctcctttatcgaaagcctcatttgtcccgaaggaatcaggcacccccccagccggggactaccctgggttgggttttggatgaaaaccacccgcgggttttgcaaaagcctatccgaaccaaaaaaacaaattgtttttaaccccatggttccccccccccaaaaattggggggccctggacacagggcggaaaaaccctcttaaaaaaaaaaaaaaaaaggaaccccggggcccaattcccccctagggggggtaataacccgccccctgggg

SEQ ID NO: 46927 - protein, 72 aa, Zea mays
  misc_feature: Ceres CLONE 1453590-F
AGAPRGGGRSITSGSPGLQEFVSPLIENKWERQRFGLQGGFVTNPLAEPNISSAGKTMVTHEGRKKDKTLQK

SEQ ID NO: 46928 - DNA, 636 bp, Zea mays
  misc_feature: Ceres CLONE 1453599-F
  misc_feature (353)..(353): n is a, c, t, g, unknown, or other
ctggagctccaccgcggtggcggccgctctagaactagtggatcccccgggctgcaggaattcgtctcacccctaatcgaaaagtttgttccacctgcgcaactgcgacggggataagtacgtcttccagatgacgacggcggcatggccgcggccacgcttcctcgtcctcccccagcctggattcctccgctcggtctgccacggcctctgctcccgctgtctcttctgcttcctgctgctcctcgccttcgcctgcagctccagctccgggcgggtggtggtcactagcttgctggctcgacgcgacctcccttccactcgaacagggtacgtgagtgggagagaccccngctcccctctctactactcgtcagccgagtccggcgccgcccccccccgatgcacccttcctcttctggtaccggggggaccgttgtcgttttaagggctccctaaaaaacggccctcgattcgcccggaaccctaaaagggccctgccggccgggataaaccccaactcggggaaaggggcacaatccccttcccaataccccgggggagcggggtttcccctcccgggattcacaagggccaatggcggaaaacttccggccccccgggggtaaggaaatc

SEQ ID NO: 46929 - DNA, 761 bp, Zea mays
  misc_feature: Ceres CLONE 1453600-F
  misc_feature: Encodes the peptide sequence at SEQ ID NO. 46930
  misc_feature (422)..(422): n is a, c, t, g, unknown, or other
  misc_feature (472)..(472): n is a, c, t, g, unknown, or other
ctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactcccaaactaaactngttgagtactatgctaagctgaagagctgcattcacatcatgtgttgaancgcgaggaaagcttccttatcggacaagcctcactggcaccgacccaatcaggcaccccccaaagccggtgactaccctgggtttggccttggcatgaaaaccacccgcttggtttgccaaaagccatttcggaaccgggaaaacaatgagcttttattcccaaagggttccccccccccccaaaattgggaacccccttggaaaagggccggagaaaaccctcttccaaaaaaaaaaaaaaaaaagagccccgcgggccccacattccccacaaaggggagccaatcc

SEQ ID NO: 46930 - protein, 71 aa, Zea mays; identical to SEQ ID NO: 46198
  misc_feature: Ceres CLONE 1453600-F

SEQ ID NO: 46931 - DNA, 775 bp, Zea mays
  misc_feature: Ceres CLONE 1453602-F
  misc_feature: Encodes the peptide sequence at SEQ ID NO. 46932
  misc_feature (306)..(306): n is a, c, t, g, unknown, or other
  misc_feature (407)..(407): n is a, c, t, g, unknown, or other
  misc_feature (452)..(452): n is a, c, t, g, unknown, or other
ctggagctccccgcggtggcggccgctctagaactagtggatcccccgggctgcaggaattcgtctcacccctaatcgaaaaaacagtccgtatattccgctcataattcctcaccggcctgcctcagagagagaaaaagcggagattagcggcggcgatggcactcccggcgtcgagctccggcctcttccgcttcgtctccccgcgcagccgcccccagtccaccgacatcgtggctgccgcctcctggggagtcttcgccggcaccgccggcctctacctcgtccagccatttgactggattnagaaaactttcttcgagaaacccccaccagaggcataaaaggctttgcagtctgcaactttggtacttcacttttatccgggatggttcctgactgaagangaccccgcatactccagcaatatacgagaccccctccggttcccntgtttgttttttattatccaatggagccacccccacaagggaaccggggaccgagaaactgctggggtcccctggggctataaaaacccccggggtacccaacggcggtgtttaaaccggggggaaaaattttttggtttataaaaaaaaaaattttaaaaaaaaaaaaagggggggcccccgggggccccaattccccccaagggggggattaaccggccctccgggggccgttttttacccggggagggggagaaacccggggtcccccatattaggctttggaaacccccctttccccgcgggggaaaaaaaaagaaccc

SEQ ID NO: 46932 - protein, 61 aa, Zea mays
  misc_feature: Ceres CLONE 1453602-F
  misc_feature (50)..(50): Xaa is any aa, unknown, or other
MALPASSSGLFRFVSPRSRPQSTDIVAAASWGVFAGTAGLYLVQPFDWIXKTFFEKPPPEA

SEQ ID NO: 46933 - DNA, 768 bp, Zea mays
  misc_feature: Ceres CLONE 1453605-F
  misc_feature: Encodes the peptide sequence at SEQ ID NO. 46934
  misc_feature (612)..(612): n is a, c, t, g, unknown, or other
aagctggagctccccgcggtggcggccgctctagaactagtggatcccccgggctgcaggaattcgtctcacccctaatcgaaaattcctcgtgcccgtcccctcaggcgctcttgctggttctggaagccggagcatcggcgctgtcgctcaggtctgtccattcccctccaaagccctaaagctaggcttcctgtgctaacccgaatcaagcaagccccgtcaacctcccccgccgtcgtcttcttctctgttgctctcctctccaccgggtccccatctcctcccttcaccgccccagaactcctcactcgggcgctgccgctgcgaggtctccgtggcatcgggccttcgtcattacgcagcagacgaagcagtgggaaacttggaactgcatgcacccaaggcaaaacgtcggtcatatatcccaacgaaaaatggaacagccatgatgcttccgctccatattcattacgaagatgtactacgtcaggatctgttgctcaaacagaatcatgccaatatcatgcaagttccagggttgtttgaggtcaaattagcaccaaaagctggctctgatctcaagatcccaattgggaaaatggccatggnagttttgagtggtcagagattcaaagaggcaaaaattgaccctttcgccaaagcaagaaagtcttctcgaaccaatccatttattggggccgacaaggacggtagcactgtcttcgcgcaaacaaccgttcttcgagggcatggcatgtacaactt

SEQ ID NO: 46934 - protein, 106 aa, Zea mays
  misc_feature: Ceres CLONE 1453605-F
  misc_feature (55)..(55): Xaa is any aa, unknown, or other
MMLPLHIHYEDVLRQDLLLKQNHANIMQVPGLFEVKLAPKAGSDLKIPIGKMAMXVLSGQRFKEAKIDPFAKARKSSRTNPFIGADKDGSTVFAQTTVLRGHGMYN

SEQ ID NO: 46935 - DNA, 732 bp, Zea mays
  misc_feature: Ceres CLONE 1453606-F
  misc_feature: Encodes the peptide sequence at SEQ ID NO. 46936
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
ctggagctccccgcggtggcggccgctctagaactagtggatcccccgggctgcaggaattcgtctcacccctaatcgaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatcnnncgtggcgactttgcctgtcgacatttggcagggaatgtcattcatgggaaagtgaccgcattggaaaagggcctaaaaaagagaaatggcccctggggtttcccccaagggccccctttttaaattggcaaaaacccccccgcccccccccgggtgttttttccgaaaaaaaaaaaaacgcggggaaaaatttctcccccccaaacacccctttgtgggcccccccaaaaagaaaccgcccccccccccctttttggttgttttaaaaaaaaattttttt

SEQ ID NO: 46936 - protein, 142 aa, Zea mays
  misc_feature: Ceres CLONE 1453606-F
  misc_feature (2)..(127): Pfam Name: NDK Pfam Description: Nucleoside diphosphate kinase
  misc_feature: SWISSPROT Homolog: EC 2.7.4.6 Nucleoside-diphosphate kinase
  misc_feature (102)..(102): Xaa is any aa, unknown, or other
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIXRGDFACRHLAGNVIHGKVTALEKGLKKRNGPWGFPQGPPF

SEQ ID NO: 46937 - DNA, 770 bp, Zea mays
  misc_feature: Ceres CLONE 1453609-F
  misc_feature: Encodes the peptide sequence at SEQ ID NO. 46938
  misc_feature (705)..(705): n is a, c, t, g, unknown, or other
aaagctggagctccccgcggtggcggccgctctagaactagtggatcccccgggctgcaggaattcgtctcacccctaatcgaaaatccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggccagaacgtgaagagtgctcctcctcctatgaaaaaggacttacacctggctaaccttccctgctggaaggagaaaccggatcccttgtgagaaaggggggagtccttaaataaaaaaacgggcttcggggcccatttccctccaagtttttttttttaaacccccaatttccgggtgtgcccttgggttattctgggagcccccaccaccgccttttttaaaaaatttttcccccgaaaagcggaaaccccaaagtccacccgggtgagacacgccaaaaaaaaaaagnccccccccgggggggccccctcctcccccccggggcgggaggtgggggagaaaatcgcgccccct

SEQ ID NO: 46938 - protein, 121 aa, Zea mays
  misc_feature: Ceres CLONE 1453609-F
  misc_feature: SWISSPROT Homolog: EC 4.1.1.50 Adenosylmethionine decarboxylase
MGLDATALSYGDLVKRVLRCFGPSEFSVAVTIFGGRGHAGTWGKALGAEVYDCNNMVEQELPGGGLLVYQSFCAAEDAVATSPKSVFHCFDGQNVKSAPPPMKKDLHLANLPCWKEKPDPL

SEQ ID NO: 46939 - DNA, 762 bp, Zea mays
  misc_feature: Ceres CLONE 1453610-F
  misc_feature: Encodes the peptide sequence at SEQ ID NO. 46940
atagctggagctccccgcggtggcggccgctctagaactagtggatcccccgggctgcaggaattcgtctcacccctaatcgaaaacctgaagcgtccgccatggacttcgtcggaggctatgcacttgctttggacatgacagcaaggggccttcaatctgttgctaagtctgcaggccttccatggactttggctaaagggcaagacaccttcactccaattagtgcagtagttccaaaatcatctgtcactaatcccgacgatctcgagctatggctaaaggtagatgatgaactaaggcagaaaggatcgacaagtgacatgatattcaagattccttttctgatcagctatatcagctccatcatgacattaatggagggtgatgtgatactaacaggtactcctgaaccccccccccctgtgcgagtaggtcagaagatcaaagctggtataactgacctaattgatgtcgagttcgatgttcagaggcgcaaccggtcattttccacatgattcaataagcaagaaagtaacggccaaccgccttgaagaatgctgctcgtgtcacgctcacgcgttcctcctgggtattcattcttccttgcgttgcagcgagattgcttcggcccatgagatgccaagtttagcctgtgcccccgcatggctaaagcaaaatactgctggcccaaggccgaaaccttgactggtgaaaatatactgtgtaaaataaaaaaaaagttttgtttttcaaaacaac

SEQ ID NO: 46940 - protein, 138 aa, Zea mays
  misc_feature: Ceres CLONE 1453610-F
  misc_feature (1)..(111): Pfam Name: FAA_hydrolase Pfam Description: Fumarylacetoacetate (FAA) hydrolase family
MDFVGGYALALDMTARGLQSVAKSAGLPWTLAKGQDTFTPISAVVPKSSVTNPDDLELWLKVDDELRQKGSTSDMIFKIPFLISYISSIMTLMEGDVILTGTPEPPPPVRVGQKIKAGITDLIDVEFDVQRRNRSFST

SEQ ID NO: 46941 - DNA, 794 bp, Zea mays
  misc_feature: Ceres CLONE 1453612-F
  misc_feature: Encodes the peptide sequence at SEQ ID NO. 46942
  misc_feature (397)..(397): n is a, c, t, g, unknown, or other
  misc_feature (408)..(408): n is a, c, t, g, unknown, or other
  misc_feature (415)..(415): n is a, c, t, g, unknown, or other
aaagctggagctccccgcggtggcggccgctctagaactagtggatcccccgggctgcaggaattcgtctcacccctaatcgaaaaacacacaacaccagtcaccagctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgcgccgccgccgaagaggaggcagaacagaagcgcgccgccgccgaagnatgagcagacnagcagcncgacgcgaagacagcaccccccggcgggccaagtgagtagctagatctgagcacccgaaacgttcagagggaaccgaacgtgtggtcctcgaacgtacgttaacgtgtacgaacgtagcatatcttttctcttctgtgcccatatgcttgccggggtggttacgccccgccagctatttgcccccaaatcttgcaaggggcccgtggggccgaaggcccccggtgaagcccaacccgaaaaaggcgctttccacaggggaaaaaaaagggcgcttaaaaaaaaaaaaacaaagggggcgcaaaaaaaggaaagttgggggccccgggcccaaatttagggggttccccaccccccataaaaccccccccgggggggggc

SEQ ID NO: 46942 - protein, 63 aa, Zea mays
  misc_feature: Ceres CLONE 1453612-F
METVVGDLMATELRLGLPGTVDDCSQHQQQTQLKVAAPPSNPTRGKKRAAAEEEAEQKRAAAE

SEQ ID NO: 46943 - DNA, 755 bp, Zea mays
  misc_feature: Ceres CLONE 1453613-F
  misc_feature: Encodes the peptide sequence at SEQ ID NO. 46944
atagctggagctccccgcggtggcggccgctctagaactagtggatcccccgggctgcaggaattcgtctcacccctaatcgaaaacatcacctgatcctcgtctgatcgtgtcaaaaatatgcttgtacctgaatctcaacctcaccggtgtccggcggtggtatcacgatggtggcgttgctggacaggcggatcggggtggctgcggcagctgccgcgttcatcgccctcgtggcgttcggatccgcctcatcctcgcccaagtccttcgtgaagtcaaccgtctccgcccacgacgtcgtaatcttctccaagtcatactgaccgtactgcaaaagagcaaaggccgtgtttaacgagcttgagttgaagaaagaaacatatgttgtgaaccttgatcagcgagaggatcccccccacaaccaagatgccttacttgagatagatgggaggggtactgtcacctcagttttatccatgaaaagcacttgggtggttctgacgatactgttgactcctacgaaagtgaagaactggctagacttcgaaacatcggagtcatggacgacctttgagtgacatgctacatcggtcagcctgttcgtttggtttcaacccgaaccggcatctacaacatccaaattgcttttgcctctattgactacagcttcaacgggctaaaaagctgatttccttccgaagccacattccaaacatcctcctgttttagtaccaaggattttttaggccacc

SEQ ID NO: 46944 - protein, 51 aa, Zea mays
  misc_feature: Ceres CLONE 1453613-F
MVALLDRRIGVAAAAAAFIALVAFGSASSSPKSFVKSTVSAHDVVIFSKSY

SEQ ID NO: 46945 - DNA, 782 bp, Zea mays
  misc_feature: Ceres CLONE 1453614-F
  misc_feature: Encodes the peptide sequence at SEQ ID NO. 46946
  misc_feature (406)..(406): n is a, c, t, g, unknown, or other
aagctggagctcaccgcggtggcggccgctctagaactagtggatcccccgggctgcaggaattcgtctcacccctaatcgaaaaataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgnaacgcaacaacaacaacaacagtttctgccatcactgagccacctagccgtggtgaaccctgtcacctacttgcaacagcagctgcttgcatccaacccacttgctctggcgaacgtagctgcataccagcaacaacaacagctgcaacagtttatgccagtgctcagtcaacctaccatgggggaccctgccgtctacctacaactacttttctctaaccccctccgggtggggaatggccctacgtacctacaacaccgtttgctgcaacaaaatgtaccacctcttgaccaccctagctgggggcaaacccctggctggcaacttacaaaaggttgcgttccattccaaccaactgggttgggtcaaaaatct

SEQ ID NO: 46946 - protein, 212 aa, Zea mays
  misc_feature: Ceres CLONE 1453614-F
  misc_feature (1)..(212): Pfam Name: Zein Pfam Description: Zein seed storage protein
  misc_feature (87)..(87): Xaa is any aa, unknown, or other
MATKILALLALLALLVSATNAFIIPQCSLAPSASIPQFLPPVTSMGFEHPAVQAYRLQLALAASALQQPIAQLQQQSLAHLTLQTIXTQQQQQQFLPSLSHLAVVNPVTYLQQQLLASNPLALANVAAYQQQQQLQQFMPVLSQPTMGDPAVYLQLLFSNPLRVGNGPTYLQHRLLQQNVPPLDHPSWGQTPGWQLTKGCVPFQPTGLGQKS

SEQ ID NO: 46947 - DNA, 724 bp, Zea mays
  misc_feature: Ceres CLONE 1453615-F
  misc_feature: Encodes the peptide sequence at SEQ ID NO. 46948
aagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttggataatctgtcaatgtcatttctttgctcagttttagttcaacccattttcacttttccatatgcatatacggtatctgtgcctggcaaacatattttgaggctagctaaatatgaacccttttgccctcttagttgttaa

SEQ ID NO: 46948 - protein, 72 aa, Zea mays; identical to SEQ ID NO: 46899
  misc_feature: Ceres CLONE 1453615-F

SEQ ID NO: 46949 - DNA, 759 bp, Zea mays
  misc_feature: Ceres CLONE 1453621-F
  misc_feature: Encodes the peptide sequence at SEQ ID NO. 46950
aagctggagctccccgcggtggcggccgctctagaactagtggatcccccgggctgcaggaattcgtctcacccctaatcgaaaactcaaccaccgccccgagatctccccttctctctcctcgcgccgttttcctctctacctctttgatccggcaatggccgcgcccgcccctgccaccaccggcgacctcctacgcgtcgaccccctcgagctacgcttccccttcgagttgaagaagcagatctcgtgctccatgcagctgtcgaatcacaccgacgactacatcgccttcaaggtgaaaactacaagtccaaagaagtattcggtgcgacccaacactggggttgtcttgccacggtctacctgtgatgttgttgttacgatgcaagcacagcgggaagccccgcctgacacccaccccaaggataagttcctagtccaaagcgtcgttgcccctgctggtataactgtgaaggatgtcactggggatatgtttacgaaggagtctgggtataagatggaagaggtcaaattgcgagtgacctatgttgctcctccacagccaccctctccagttccagaggaatctgaagaaggttctccacctagggcttctgaatcagaaaacggagatggaccttctgggagattcaccagagcactaagagagcgcattgagcctcaagacaatctaccgaggctggagcttttgtttccaaggtgacctgagagaaaattccgcgattcaacagaatg

SEQ ID NO: 46950 - protein, 189 aa, Zea mays
  misc_feature: Ceres CLONE 1453621-F
  misc_feature (12)..(119): Pfam Name: Motile_Sperm Pfam Description: MSP (Major sperm protein) domain
MAAPAPATTGDLLRVDPLELRFPFELKKQISCSMQLSNHTDDYIAFKVKTTSPKKYSVRPNTGVVLPRSTCDVVVTMQAQREAPPDTHPKDKFLVQSVVAPAGITVKDVTGDMFTKESGYKMEEVKLRVTYVAPPQPPSPVPEESEEGSPPRASESENGDGPSGRFTRALRERIEPQDNLPRLELLFPR

SEQ ID NO: 46951 - DNA, 756 bp, Zea mays
  misc_feature: Ceres CLONE 1453622-F
  misc_feature: Encodes the peptide sequence at SEQ ID NO. 46952
atagctggagctccccgcggtggcggccgctctagaactagtggatcccccgggctgcaggaattcgtctcacccctaatcgaaaaatcggactcatctccttcgattcagcagaggacagcgctctgcctctccactacttgacagccacggatccttccatccctcgcctagcgaacagacctggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgagctctgccatcgcattcatgttacctctgaaagcactcagacaatcctctagatttattgtcaataacagctgcgtatttggcattggcttcatcaaagttgccactatcaagttaacacgacgctagaaacactgtttgtcaggaagatgaacatcttcacggagccaaagtttacacttggaaaaacgaggatttctctgctctgaaaaaccgtcccactaccggagtttgagatcgctgatacacatggatatctctttgatccatccacgatggaacagcctgc

SEQ ID NO: 46952 - protein, 107 aa, Zea mays
  misc_feature: Ceres CLONE 1453622-F
MRYLKLNPKYEVSNEECVSLRLELSQSSVKLDTIFEASFKFMIYDQLIGKHKVHLGNHSFQTASTSSAIAFMLPLKALRQSSRFIVNNSCVFGIGFIKVATIKLTRR

SEQ ID NO: 46953 - DNA, 758 bp, Zea mays
  misc_feature: Ceres CLONE 1453623-F
  misc_feature: Encodes the peptide sequence at SEQ ID NO. 46954
aagctggagctccccgcggtggcggccgctctagaactagtggatcccccgggctgcaggaattcgtctcacccctaatcgaaaagcagtttctcgcgccatctgaagtcagctggggcgacgaagaaatgtcctctagcgatcaaaacccagctgccacacccgcgtcgtcgggccccgccgagccctcgccgccgggcaggccaacggcggtgtcctcgcgtgtcctcgacatgggcgcgcagctggcgcaggcgctgaagccggtgcggcagatgaagcagcacgcgtgcagcttcgcgctgtacgcccacgacttgcaccgccaggtggaggtccaccacttcgtcggccgggtcaacaggaagtcctccaggggggcggttaagattccaaaaagcccttggccccccttttggggggggataatttgtttcccaaaccctttttaagggcctggccccaaaaaaaaaaaggtgtggcccctccccccctaaaggggaaggcggggtttgaaccacactcgggggggggaggcgcctaaaaccctgaaagggggccccccagggaaaccgcaattttttgtccccctgggggggaccgagggaaaatctctcctccggggccggttttttattgttttaaaggaaaaaaaaaaccccgtctcgaaaaatttttggcgccccacaaaaaaaaaaaaaacacccaccccgggggtgcgccccggggggggggggaaaccccgcgcggctcccccc

SEQ ID NO: 46954 - protein, 107 aa, Zea mays
  misc_feature: Ceres CLONE 1453623-F
  misc_feature (23)..(104): Pfam Name: DUF1264 Pfam Description: Protein of unknown function (DUF1264)
MSSSDQNPAATPASSGPAEPSPPGRPTAVSSRVLDMGAQLAQALKPVRQMKQHACSFALYAHDLHRQVEVHHFVGRVNRKSSRGAVKIPKSPWPPFWGGIICFPNPF

SEQ ID NO: 46955 - DNA, 780 bp, Zea mays
  misc_feature: Ceres CLONE 1453629-F
  misc_feature: Translation starting site: 189
aagctggagctccccgcggtggcggccgctctagaactagtggatcccccgggctgcaggaattcgtctcacccctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgaacgcctccgtggtggggctggccgtggccacgccgggtgtcctgattctcagccccgtgctggtccccgccgcgctgctcatcgggacggccgtcatggggttcctcacgtccggcgccctggggctcgggggcctgtcttccctcaggggctccccaaacgggccgggaggggttccacgcaccccggaaaaactgaaaaagccccccccaagatggggagggcccgggcaaccgggccaaaaaacccggagggggggccgccctcccgggggggccaaaaaccccccccccgggaaaggaaaaggccccccctttggggcgggagaggtttttcccctaaagaaaacccccccgggaaatatgaaaaccccccccccccccc

SEQ ID NO: 46956 - DNA, 763 bp, Zea mays
  misc_feature: Ceres CLONE 1453631-F
  misc_feature: Encodes the peptide sequence at SEQ ID NO. 46957
  misc_feature (531)..(531): n is a, c, t, g, unknown, or other
  misc_feature (708)..(708): n is a, c, t, g, unknown, or other
atagctggagctccccgcggtggcggccgctctagaactagtggatcccccgggctgcaggaattcgtctcacccctaatcgaaaaatgtcacgactcacgacgacggaaacagtagtgctgccagtagagctctcagaactcgggaaaaaaaatgtcagaggccgccgtgcgtgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctccaccacggcaagcccatctccgagtctctgatcatcgtccagtacatcgacgaggtctggtcctccggcgcgccggccttcctccccgccgacgctcatgcccgcgccgtccagcggttctgggcgcagtacgtcgacgacaagctgccttgggcgatccgcatactgaagggaacggacgacgacgggggcaaggagcangcggcggggcagctgtccgcggccctgcagctcctcgaggaggctttcgcgcagctcagccaggggaagcgctacttcggcggggacagcgtcgggtacctggacatcgctctggtgtcgcatgtcggctgggtgaagggggtggagagatcgccggggtcaccctgctggacaggnccaggccccgaccctgtggcgtgggctgatcgtctgtgtggcccccgggcgtggc

SEQ ID NO: 46957 - protein, 203 aa, Zea mays
  misc_feature: Ceres CLONE 1453631-F
  misc_feature (4)..(77): Pfam Name: GST_N Pfam Description: Glutathione S-transferase, N-terminal domain
  misc_feature: SWISSPROT Homolog: EC 4.4.1.5 Lactoylglutathione lyase
  misc_feature (126)..(126): Xaa is any aa, unknown, or other
MSEAAVRVIGLWPSPFVIRVLIALKLKGVEFEFVEEVVGRKSELLLRSNPVHKKIPVLLHHGKPISESLIIVQYIDEVWSSGAPAFLPADAHARAVQRFWAQYVDDKLPWAIRILKGTDDDGGKEXAAGQLSAALQLLEEAFAQLSQGKRYFGGDSVGYLDIALVSHVGWVKGVERSPGSPCWTGPGPDPVAWADRLCGPRAW

SEQ ID NO: 46958 - DNA, 886 bp, Zea mays
  misc_feature: Ceres CLONE 1453634-F
  misc_feature: Encodes the peptide sequence at SEQ ID NO. 46959
  misc_feature (413)..(413): n is a, c, t, g, unknown, or other
  misc_feature (424)..(424): n is a, c, t, g, unknown, or other
  misc_feature (431)..(431): n is a, c, t, g, unknown, or other
  misc_feature (432)..(432): n is a, c, t, g, unknown, or other
  misc_feature (436)..(436): n is a, c, t, g, unknown, or other
  misc_feature (440)..(440): n is a, c, t, g, unknown, or other
atagctggagctccccgcggtggcggccgctctataactagtggatcccccgggctgcaggaattcgtctcacccctaatcgaaaaaaccagcccaacaaatccaggcgtgccccgtgcgcgcatccctccgcgtctccgcctcatggcggcatcagcgtctcggcccctcgcgctcctcgcgtgcacctcggcatctcacggcgctgggcggcgggcgtgggctcgcttggctgtctcttcctattcggcgaggtcggcgctccccaggctccgcgggcgtcggtcgttcgccgcccccgcatggggcgccctgatggggaaccccaagcccccggcgccggtgacgcccacatcgggaaggaaggttgtaaaacccccccctcatgtgttagggataattgttttttaaanaaccggccatncccccannaaantaanaaaaaaaaccaaggtaagactggccctctccccggcacaaaaaaaaaaaaccgtggaaaagatcctcgccacaaaagtctctccaacggtttctacgttttatgtttttcaacacccccaccttggtccccaccccgctagaagttgggtggggatatagagagtgaacatatcctcatatcttgtttaagagcacacactctcacggggttgaggcaatttccatttctcacgcgcagtgtctcactattctattctcgaaaaatatttttagcaatcggggcaggaaaaacaatgacctcaccgtcgagacagtctttctgtacatacgtaaaataataactctgcttactttcttcgctactggccagatgtgttcttccccgtcggggaggcatcgtgatgctgccccgcctcacttggcaaagatggccctcaccttgttc

SEQ ID NO: 46959 - protein, 88 aa, Zea mays
  misc_feature: Ceres CLONE 1453634-F
MAASASRPLALLACTSASHGAGRRAWARLAVSSYSARSALPRLRGRRSFAAPAWGALMGNPKPPAPVTPTSGRKVVKPPPHVLGIIVF

SEQ ID NO: 46960 - DNA, 820 bp, Zea mays
  misc_feature: Ceres CLONE 1453636-F
  misc_feature: Encodes the peptide sequence at SEQ ID NO. 46961
  misc_feature (387)..(387): n is a, c, t, g, unknown, or other
  misc_feature (394)..(394): n is a, c, t, g, unknown, or other
  misc_feature (395)..(395): n is a, c, t, g, unknown, or other
  misc_feature (416)..(416): n is a, c, t, g, unknown, or other
atagctggagctccccgcggtggcggccgctctagaactagtggatcccccgggctgcaggaattcgtctcacccctaatcgaaaaacacaatttctcgcgctcctaccgccgccgcttcgttctctaaccttggctcccgctccctccgcaggagcatctcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatccccgtccgcangtattgnntgcgtgttgacgtacccccangctaagtctcgtccctcaaatgggcaggaaaccctgcctgccaaatccgtaaaatccatccaaaaccttctcaaaaatgctaaaaacaatgcctaagaaaaaaggccttgaattccaaaccccccttttgtgtccccacttcaaggagaccccggttcaaaaaaagggggccaagaacctaaccgtgtattggggcgacaaacactttaaagttgccccccgcgggccaaataaaatttcttttttaaaaaaaaaaaaaacccccttaaaaaaaaaggtttttctcccaacctcccccccggaagtgtttgaaagaagggcaaaccaccccctttatttggggaggaagaaaaattttggtgaaaattttttccccccccatttttccccacaaattgtttgcg

SEQ ID NO: 46961 - protein, 71 aa, Zea mays
  misc_feature: Ceres CLONE 1453636-F
  misc_feature (62)..(62): Xaa is any aa, unknown, or other
  misc_feature (64)..(64): Xaa is any aa, unknown, or other
  misc_feature (65)..(65): Xaa is any aa, unknown, or other
MVKYSTEPTNPTKSTKAMGRDLRVHFKNTRETAFALRKLSLTKAKRYLEDVIAHKQAIPVRXYXXRVDVPP

SEQ ID NO: 46962 - DNA, 802 bp, Zea mays
  misc_feature: Ceres CLONE 1453639-F
  misc_feature: Encodes the peptide sequence at SEQ ID NO. 46963
  misc_feature (381)..(381): n is a, c, t, g, unknown, or other
  misc_feature (383)..(383): n is a, c, t, g, unknown, or other
  misc_feature (415)..(415): n is a, c, t, g, unknown, or other
  misc_feature (416)..(416): n is a, c, t, g, unknown, or other
  misc_feature (421)..(421): n is a, c, t, g, unknown, or other
  misc_feature (429)..(429): n is a, c, t, g, unknown, or other
  misc_feature (432)..(432): n is a, c, t, g, unknown, or other
caagctggagctccccgcggtggcggccgctctatactagtggatcccccgggctgcaggaattcgtctcacccctaatcgaaaaacgaatagagacacacgcaccactcgaaccagaaccaccaggctgctggtgctggaagggggcgcggcagctgggcagctggcaacggacatggcggcggccggcggcgagaccatgatgacgagggagcagctgctccacctcttctcccgcttctccttcgtcacctccctccccgaggtcaagcagcggattgccgacgccgtcagggacaagcaggaggctgtggccgtgaccactgaaatacaagaggagattcttcgcgagatgggagtagatccaagttttggtatagnanggctaggaaaggtgaatgttgtttaaaaacannacatnctcgtcanaanaaaattctatcaatttgttgccaaacaagacacggctatcgatcaacctgaccttgaacccacagaattggctgaaaaactacttgctcaacaaattatgcaagaaaagcaactgaacatgctagtttgagatgaaggaaaattactcgaagagagcccatcctgccctaactggggaccttcgcactccagaatgggaaggaagctaattttggaaattcaatggctctcgctctttgaccccccgaaccaaattccagagaaatttgttcaaaaagtgataatattttccaaacaaattgagaatcagggaccccgcccttggcccccccatatggggggttgcttacgcgcacacacgcttctcggt

SEQ ID NO: 46963 - protein, 77 aa, Zea mays
  misc_feature: Ceres CLONE 1453639-F
  misc_feature (69)..(69): Xaa is any aa, unknown, or other
  misc_feature (70)..(70): Xaa is any aa, unknown, or other
MAAAGGETMMTREQLLHLFSRFSFVTSLPEVKQRIADAVRDKQEAVAVTTEIQEEILREMGVDPSFGIXXLGKVNVV

SEQ ID NO: 46964 - DNA, 779 bp, Zea mays
  misc_feature: Ceres CLONE 1453640-F
  misc_feature: Encodes the peptide sequence at SEQ ID NO. 46965
  misc_feature (424)..(424): n is a, c, t, g, unknown, or other
  misc_feature (426)..(426): n is a, c, t, g, unknown, or other
  misc_feature (441)..(441): n is a, c, t, g, unknown, or other
  misc_feature (442)..(442): n is a, c, t, g, unknown, or other
  misc_feature (494)..(494): n is a, c, t, g, unknown, or other
  misc_feature (683)..(683): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (768)..(768): n is a, c, t, g, unknown, or other
cgtactggagctccccgcggtggcggccgctctttcctaatggatcccccgggctgcagtatttcctctcacccctaatcgaaaaattttgtcagtaaacaacgtgtgaggatggtgtactaccccaaacccttgtacataatggcattcgggcgaatcccacgttccataatggcataattccatatttctccagctgttccgcccagcgaacgacccacaaccagaagccaccccttggcgtacgcgaagcgatcggagcaacccctcccaagaagagaaactccggccccgccacaccggggaaaaaggggaaaacacacataccaaaaaaagcgggggtgtaagctattgtttttttttttttaacccccccctccccccttgtgtttgtgtttttttttttgttcgcccctgttttaananaaaaaaaaaaaaacnnaaaaaaaaaaacaacaccccccaccaacacaccaacccaaacccacacaccnaaaaaaaaaaaaaaaaaaaacccccacccaaaaaccaacaggaaaataacccaacacaacacccaacccaagccaaaacaaaaaccccacataacacgcgaaaaaaaactccaaaagtaacttcccccccccgtgtatattattctccaccttttctacccctctctaaccacgttcattgaacactantttcgcccccctcaccctcttgtttctgtttggtcttcactaccattatctgtcgtgggcacgcgttnnnnnnnnnnnnnnctcnttttgcatcag

SEQ ID NO: 46965 - protein, 31 aa, Zea mays
  misc_feature: Ceres CLONE 1453640-F
YWSSPRWRPLFPNGSPGLQYFLSPLIEKFCQ

SEQ ID NO: 46966 - DNA, 733 bp, Zea mays
  misc_feature: Ceres CLONE 1453643-F
  misc_feature: SWISSPROT Homolog: EC 5.3.99.6 Allene-oxide cyclase
aaagctggagctccccgcggtggcggccgctctagaactagtggatcccccgggctgcaggaattcgtctcacccctaatcgaaaactagagttttagtgccagcctgccaggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgccaggcgtccagagtcgtagcggtgagcggggcccggcagagccgcggcggcggcgtcgccgtgcgggcgtcgctgttctcgcccaagcccgcggcggccaaggacgcgcggccgaccaaggtgcaggagctgtacgtgtactattatccaccaccgccaccgcgagagccccgcgtacctgcgcctcagcgccaagcagacggagaacgcgctgggcgacctcgtccccttcaccaacaaggtgtacaacggcagcctggacaagcggctgggcgtcaccgcgggcatctgcgtgctcatccagcacgtccccgaccgcaacggcgaccgctacgaggccatctacagcttctacttcggcgactacggccacatctccgtgcagggcccgtacctcacctacgaggagtcctacctggcggccaccggcggctccggcgtcttcgaagcgtatacggccaggtcaa

SEQ ID NO: 46967 - DNA, 756 bp, Zea mays
  misc_feature: Ceres CLONE 1453644-F
  misc_feature: Translation starting site: 315
  misc_feature (416)..(416): n is a, c, t, g, unknown, or other
aagctggagctccccgcggtggcggccgctctagaactagtggatcccccgggctgcaggaattcgtctcacccctaatcgaaaaatctctaaaatagtctcccctgtgcaggcatccacttcttctctccctgatccaaatcgtgaaatagcgtcggcggttccctgcgctcctcccctctttttctagcggcgcgcagcagccacgaccggtgttctggcgatcctggacgccccctgcccagactgcgatccattttcgagcttcgaggaatcgacagtcaagcttcggcgaccaagtgatctggctcttcatgttctacaaagttgaagaccctgagcatctgtttggtgaaggttgcctttgggtgcatctatgctcaggtaaagaagaaagcgtcgagatggatctccancacctccagacgttgatgaagtcgaggattaggctagcaacctccccagtcagctgcctgtggtcatcttcttccaccaccccgtgaacgagtacttgatgcagtccctgatggactacgaggaccaagagttccaaaccgtggccaaggagggactgaaactgggcaagacctccaactccaggaactcaggagtccttcaagaacctaactactggggaaaaaagccccggaagaaaaacctggactccggaaaaaacaaacggtgtgacaaccccccggggtggggccccccaaaggggggggaccccactggaaaaatattcgcggcccaaccccg

SEQ ID NO: 46968 - DNA, 883 bp, Zea mays
  misc_feature: Ceres CLONE 1453645-F
  misc_feature: Encodes the peptide sequence at SEQ ID NO. 46969
  misc_feature (386)..(386): n is a, c, t, g, unknown, or other
  misc_feature (387)..(387): n is a, c, t, g, unknown, or other
  misc_feature (430)..(430): n is a, c, t, g, unknown, or other
  misc_feature (431)..(431): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (453)..(453): n is a, c, t, g, unknown, or other
  misc_feature (468)..(468): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (481)..(481): n is a, c, t, g, unknown, or other
  misc_feature (572)..(572): n is a, c, t, g, unknown, or other
  misc_feature (769)..(769): n is a, c, t, g, unknown, or other
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattacccgagccgaacatttcatctgcacggaaaacaatggttactcatgaaggcaggaagaaggataaaactttacaaaagtgaagggcgggttacgcatgatgaagacattctgttccaagcgtgaactgctccagtctgcttattatcatggaaggcggaagtagttctcttttccaccccaaccgctttttttttcctaaggacgaacattggtctttttggaaactttttgtatgtttttaaanncccttgaattatagaaggtttgagttttgttaaattttccccnncccccaaaaaaaaannnaaaanaaaaaaatttataanaaaaaaaannnanaaaaaaacccgggggggggcttttttatgggaaaggattcaccttttactatagagatttttggggccccccccctaccccgggcaacacncccggcgatggagtttttttacaatataacatcccccttctgtctttcccaccctatccttcacaccttctctaagaaacaagaggtgttatgtatttcatatcttccctcccccctccacacaaacaaataacgacctcatcgatctcactgtgcgcgtgagtgtgttttttttttccaaaaaaataaataaaaantataagaacgtcttgagcggctctctattgttcgtcttagttagggtctaatactctcttcccttctctgcgacatgctacttttgtatatgccctcgacgtgtatctccctgt

SEQ ID NO: 46969 - protein, 73 aa, Zea mays
  misc_feature: Ceres CLONE 1453645-F
KAGAPRGGGRSRTSGSPGLQEFVSPLIENKWERQRFGLQGGFVTNPLPEPNISSARKTMVTHEGRKKDKTLQK

SEQ ID NO: 46970 - DNA, 936 bp, Zea mays
  misc_feature: Ceres CLONE 1453649-F
  misc_feature: Encodes the peptide sequence at SEQ ID NO. 46971
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (186)..(186): n is a, c, t, g, unknown, or other
  misc_feature (484)..(484): n is a, c, t, g, unknown, or other
gcgggggccaccaccccccccccccnnnnntttcannnnnnacatagctggagctccccgcggtggcggccgctctataatagtggatcccccgggctgcaggaattcgtctcacccctaatcgaaaaaactgtccggccgcttccagcacgcatcattctcgtctcccgtctcgagagattgcanggggcggcgctcaaagctggaggaagcggaccggttcccgatgggggccgagggatcctcgggtccagtcgtccttcccagaaactttaggctggtagaaaaactagaacgtggtgagaaggccattggtgatggaactgtgagctatgggatggatgatgctcatgacatatatatgcggtcctggacaggaactaatattggtcctccccatagtggttcaggaagggtggaaaccaaccaacaaaaagctgtttttgtgatacaaaataaaccccccccctccccccccacaacnccaaattcccaaacatcggatatcatatttaacctggcccgacccccacaaaaaacgaggatcgagcccactcgctgacctctcttcgttgtcttgccaagacccctatcaaaccttgctcctggggcacttctttcggactctcgacaatagagggtcccatcatactaaatgccacaccggggtttatctctaccggctgtgaacccaaagcgcgagccctccctacaatcttagggtgcaacccgggataacctggcagtccggttattccgtaactaacagaggtactgcgccccccgtatataaaatcagaaaaaatctgatcacgttttattacccatctcatctacacccatcccggctccccgctcctatctgctttgacgctaacgcatcctcgttgccctcgtcggcagagtgagcctacccgctactatagaacgaccagc

SEQ ID NO: 46971 - protein, 111 aa, Zea mays
  misc_feature: Ceres CLONE 1453649-F
MGAEGSSGPVVLPRNFRLVEKLERGEKAIGDGTVSYGMDDAHDIYMRSWTGTNIGPPHSGSGRVETNQQKAVFVIQNKPPPSPPTTPNSQTSDIIFNLARPPQKTRIEPTR

SEQ ID NO: 46972 - DNA, 859 bp, Zea mays
  misc_feature: Ceres CLONE 1453650-F
  misc_feature: Encodes the peptide sequence at SEQ ID NO. 46973
  misc_feature (378)..(378): n is a, c, t, g, unknown, or other
atagctggagctccccgcggtggcggccgctctataactagtggatcccccgggctgcaggaattcgtctcacccctaatcgaaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcatgaagagaaagggtgttgatgagttcccctactgtgtgcaccttgtctcttgggagaaggagaatgtctccagtgaggctcttgaggctgcccgtattgcctgcaacaggtacatgacttatttanccaagaaaaggatgccttccaccttcggggtccagggtaccccccccccgcggccccttcgtttcaaacaaaaagccttccgtggtgtctgggcgctcgaaaggctcccagaacggggagtgagggggggacctttgggcaaggcctacaggggaacacggggggtaaggggggacattcgcgcccgagggttgtcctatctccggggccgaaaagaagggaccacccacttgcttttcctagcgccctggggagggcttgcgttgacgctgtcccatcgttctatggcgtccctcgctcgccgccacatacgactttttggggttcgctcggaacgtgcgggctctgggttcccgtgcgtcgcgcctggcctggctttcctgtggtcgcaccacgcgttgggggtatagcaaatctctccacggaggtcgcgtccccgctccacggcactctccattgtggatcacctccgagtagactc

SEQ ID NO: 46973 - protein, 215 aa, Zea mays
  misc_feature: Ceres CLONE 1453650-F
  misc_feature (5)..(159): Pfam Name: Ribosomal_L16 Pfam Description: Ribosomal protein L16
  misc_feature (80)..(80): Xaa is any aa, unknown, or other
MGRRPARCYRQIKNKPYPKSRYCRGVPDPKIRIYDVGMKRKGVDEFPYCVHLVSWEKENVSSEALEAARIACNRYMTYLXKKRMPSTFGVQGTPPPRPLRFKQKAFRGVWALERLPERGVRGGPLGKAYRGTRGVRGDIRARGLSYLRGRKEGTTHLLFLAPWGGLALTLSHRSMASLARRHIRLFGVRSERAGSGFPCVAPGLAFLWSHHALGV

SEQ ID NO: 46974 - DNA, 725 bp, Zea mays
  misc_feature: Ceres CLONE 1453652-F
  misc_feature: Encodes the peptide sequence at SEQ ID NO. 46975
aaagctggagctccccgcggtggcggccgctctagaactagtggatcccccgggctgcaggaattcgcacgagaccattaactagaacatcctaatcgaaaaactccatcccggctccgtcgtcgcgtgccatcctagggtttctttccccgtcggcgcctccccagatttggccgccgccgccgctgacccaggaacacatatcaactcttcctagtgtaattgctggtggaccatgtcttcggtatggaccgtgttaccacacgtggtcaatgttggactctgtcatgagtgttacaatgttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgaca

SEQ ID NO: 46975 - protein, 163 aa, Zea mays
  misc_feature: Ceres CLONE 1453652-F
  misc_feature (77)..(163): Pfam Name: Pyrophosphatase Pfam Description: Inorganic pyrophosphatase
  misc_feature: SWISSPROT Homolog: EC 3.6.1.1 Inorganic diphosphatase
MSSVWTVLPHVVNVGLCHECYNVVLMAPAVEAVKETGTFQKVPALNERILSSMSRRSVAAHPWHDLEIGPGAPTIFNCVIEIPRGSKVKYELDKKTGLIKVDRVLYSSVVYPHNYGFIPRTLCEDSDPLDVLVIMQEPVIPGCFLRAKAIGLMPMIDQGEADD

SEQ ID NO: 46976 - DNA, 756 bp, Zea mays
  misc_feature: Ceres CLONE 1453653-F
  misc_feature: Encodes the peptide sequence at SEQ ID NO. 46977
tggagctccccgcggtggcggccgctctagaactagtggatcccccgggctgcaggaattcgcacgagaccattacctagaacatcctaatcgaaaaatcgtccatccgtatttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcagggttacccacagcagggctacccgccgcagtacgcgcagccgcctccacagcagcagcagagcagcgggccttccttcatggaaggatgcttggctgccctctgctgctgctgcctcctggacgcctgcttctgacggaaccatccgtgccgggtccaacacggctgcaagtgaagcaaccagcttacggaagagctggaactgggccgtgctattctagctttgtcctgcgttatcgccctcttttctttttttttctctctctctctctctctggtatgagactaccggaactccggcgatgccaattggattaaactagggctgggtgggcactcctggggatgctccgagtttccggtgggaatcaaagtccacccctgggaatagggcatttcccccaaccg

SEQ ID NO: 46977 - protein, 93 aa, Zea mays
  misc_feature: Ceres CLONE 1453653-F
MSYYGQQPPVGVPPQQGYPGKDGYPPAGYPPAGYPPPAQGYPPQGYPQQGYPQQGYPPQYAQPPPQQQQSSGPSFMEGCLAALCCCCLLDACF

SEQ ID NO: 46978 - DNA, 766 bp, Zea mays
  misc_feature: Ceres CLONE 1453661-F
  misc_feature: Encodes the peptide sequence at SEQ ID NO. 46979
  misc_feature (382)..(382): n is a, c, t, g, unknown, or other
  misc_feature (412)..(412): n is a, c, t, g, unknown, or other
  misc_feature (420)..(420): n is a, c, t, g, unknown, or other
tagctggagctccccgcggtggcggccgctctagaactagtggatcccccgggctgcaggaattcgcacgagaccattacctagaacatcctaatcgaaaaaaactggtaccatccgccgccgcagccatccgcttgttctcttcggttcagttctcgaggcatttctgcagtttccaggatgaaggtaatagctgcctatctgcttgctgttctgggtggaaacacttccccgactgctgatgatgttaagagcattctggaatcagttggtgctgaagctgatgaagaaaaactagagttcctgctcacagaactcaaagacaaggacataacagaagtgattgcagctggaagggaaaggttatcctctgtgccttcangtggtggtgcaattgacatgggagctccanacccccanctggcggtggcgcagcacctgctgaagaggcaaagaaggaagaaaaggttgaagagaaggaagagtctgatgaagatatgggtttcagcttgttcgattaaaacagcactaccagtttacagtttcttcgcgaatggtctcataatattggccggtttccacaaaataagattgtcaatagctactacgtacttatgctattctgcatgtgatgtacgagtgtgcatctttcagaatctttaagttgaatggtcggtggtcccataataatattggtaacaatgtaaattgtatgtcctgtacgtactttggtatcgcgacatctcagtgtgcatcttccaagaac

SEQ ID NO: 46979 - protein, 160 aa, Zea mays
  misc_feature: Ceres CLONE 1453661-F
  misc_feature (17)..(76): Pfam Name: Ribosomal_60s Pfam Description: 60s Acidic ribosomal protein
  misc_feature (68)..(68): Xaa is any aa, unknown, or other
  misc_feature (78)..(78): Xaa is any aa, unknown, or other
  misc_feature (80)..(80): Xaa is any aa, unknown, or other
MKVIAAYLLAVLGGNTSPTADDVKSILESVGAEADEEKLEFLLTELKDKDITEVIAAGRERLSSVPSXGGAIDMGAPXPXLAVAQHLLKRQRRKKRLKRRKSLMKIWVSACSIKTALPVYSFFANGLIILAGFHKIRLSIATTYLCYSACDVRVCIFQNL

SEQ ID NO: 46980 - DNA, 703 bp, Zea mays
  misc_feature: Ceres CLONE 1453662-F
tggagctccccgcggtggcggccgctctagaactagtggatcccccgggctgcaggaattcgcacgagaccattacctagaacatcctaatcgaaaaaccggcacttgtcttcttccataccacatttccactggagcgaaaaatggtgatgctacctctccagcactcgtaggccgccacaattatgcgcttccatttccacttctctgagaccagacagctcgagtctttatccgtcgcccccacttgacccctctcgccactccctcccctccatcaacaattcggtttcttgggtgattttttttcttgcttgctcggtttcttgtggggcgggccgcgaaccggcgaggcgggggcgcggggcaacgcaaagcagcgcaggggcaacgcagtgcagcaaaagcttcgatctttatccgccggattcctctcctcccctttcctctctctccgtctccccgcttgctttgtgcttcgttgttgagaggaggggagaggaggggagacccacatccacttgcctttctcctctctcctctcgcagccccccttccaactcctcctggtccctggaaaaaggagaccttttggtgcaagattcgatctgctgtggctgcctcgaccttgctgcgtgcgcggagatttggtttcttggctggcgcgcgcgggcagttggagctctttgattcacaggttcaa

SEQ ID NO: 46981 - DNA, 806 bp, Zea mays
  misc_feature: Ceres CLONE 1453664-F
  misc_feature (36)..(36): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
aaaataaaaaaaacccccaaaaccaaaacacccaanccccncnncnnaaaaaatgggactccccgcggtggcggccgctctataatagtggatcccccgggctgcaggaattcgcacgagaccattacctagaacatcctaatcgaaaaaacattggatgcgccatctcgcccagttcccctcgtcgtcgcttctggtataacctagcggcctcccctgcatcctgcgtcgcccgccgaccggtgactgccaacaggattagatgcggcagaggggggatgacctcgctgccgctcctccctgcacttacggtacaaccgctcctccccaacgagatccatcggatgagaacccccggcggcgaaggaggcgccaccacttcggcctgcggcggaggaggacgcgatgctctttaagaaggattacatagtgaaggaatcagctgtataaggttcagccacccgccgatctaagtgtgcctgacggctcaccaccctgctggagaaaaaacccggcgatttcaaagagaacttgccacgacacgcggtgccctttggaattaagagtttggacctcttggaaagcaaggtggaccacgagaatctagccgccggtccccaactaatcccatcaatgaggttgcgagccttgggggggacagacgcacttaggggtcgggatgggtccccctcccgcgcgcgaaacagggatatgttctccaccttggggattttgcgggtttggtgtgagaatacaattaaccagacggtcagcttttctacaaggcggcgccatttatcgggctg

SEQ ID NO: 46982 - DNA, 754 bp, Zea mays
  misc_feature: Ceres CLONE 1453666-F
  misc_feature: Encodes the peptide sequence at SEQ ID NO. 46983
  misc_feature (408)..(408): n is a, c, t, g, unknown, or other
tggagctccccgcggtggcggccgctctagaactagtggatcccccgggctgcaggaattcgcacgagaccattacctagaacatcctaatcgaaaaacaaacccgtcctctgtccgtcctaccaccaccgctcacctcggtttggctttctcccctcttccgcacccgcttctcgctccggattccggattccctctgctctttccctaacgaaggtagccatggcggggagaggtaaagcgatcggctcaggcgccgccaagaaggccacgtccaggagctccaaggctggcctccagttccccgtgggaaggatcgccaggttcctcaaggccggcaagtatgccgagagagtcggcgccggcgcccctgtctacctcgctgccgtgctcgagtatcttgctgcncacccccttgagctggccggcaatgcggcacgtgacaacaagaagacccgcatcgtaccgcgccacatccagctcgccgtccgcaacgacgaagagctctcccgcttgctgggcacggtgaccatcgctagcggtggtgtaatgcccaacatccataaccttttgctcccgaagaaggcggcggcggcagcgccaaggctgcggctggtgacgaggactaagtccttgactacgcctggtggcacctccagatgctgccgtatcaacatgtgtctgtgtagtacgttaggtgtccttgtagctgggtatgtgggttgctgtacactgctaacctaattacccttgg

SEQ ID NO: 46983 - protein, 173 aa, Zea mays
  misc_feature: Ceres CLONE 1453666-F
  misc_feature (19)..(92): Pfam Name: Histone Pfam Description: Core histone H2A/H2B/H3/H4
MAGRGKAIGSGAAKKATSRSSKAGLQFPVGRIARFLKAGKYAERVGAGAPVYLAAVLEYLAAHPLELAGNAARDNKKTRIVPRHIQLAVRNDEELSRLLGTVTIASGGVMPNIHNLLLPKKAAAAAPRLRLVTRTKSLTTPGGTSRCCRINMCLCSTLGVLVAGYVGCCTLLT

SEQ ID NO: 46984 - DNA, 702 bp, Zea mays
  misc_feature: Ceres CLONE 1453669-F
  misc_feature: Encodes the peptide sequence at SEQ ID NO. 46985
ggagctccccgcggtggcggccgctctagaactagtggatcccccgggctgcaggaattcgcacgagaccattacctagaacatcctaatcgaaaaacattactcggcagacggcagcgcacacattcacttggccttggcttttgcctttgtgctgtgacttgcaaggaacgtcggcgagagggccgggcaggcaggcaggcgcacagcacagacacagactcctccatcctcgcccaccggccggccggcgctcccgatggcgtccaggtgcttcttccccagggacgctgcggccgccgaccacccgcagtccaaggcggcggcggcccaggccctcgagcggctgcaccacggcgggcgcctcctgtccagggaggacgtcgggggcgcggtgcgcgtcaacatcgtcgtcagcaagcgcgagctcaagcagatggtcgcggcgctcggcgacggcggtctggtggccgcggccagcagcgagcgccaccggcagcgcgcggcggcagcggcagggccgggcgccgagcagaggctgcagtcgctgcggcggcgcagcgtgcggcgggcggccgaggctgccgcgcggcggatgcaggcgggcggggagtgggagcccggcctgcagagcatccccgaggaggtttgctgatgactaccagaccagtagatgatgtatgatgatggcgtccttctctt

SEQ ID NO: 46985 - protein, 131 aa, Zea mays
  misc_feature: Ceres CLONE 1453669-F
MASRCFFPRDAAAADHPQSKAAAAQALERLHHGGRLLSREDVGGAVRVNIVVSKRELKQMVAALGDGGLVAAASSERHRQRAAAAAGPGAEQRLQSLRRRSVRRAAEAAARRMQAGGEWEPGLQSIPEEVC

SEQ ID NO: 46986 - DNA, 712 bp, Zea mays
  misc_feature: Ceres CLONE 1453681-F
  misc_feature: Translation starting site: 170
  misc_feature (267)..(267): n is a, c, t, g, unknown, or other
  misc_feature (268)..(268): n is a, c, t, g, unknown, or other
  misc_feature (279)..(279): n is a, c, t, g, unknown, or other
  misc_feature (287)..(287): n is a, c, t, g, unknown, or other
  misc_feature (288)..(288): n is a, c, t, g, unknown, or other
  misc_feature (291)..(291): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
ggagctccccgcggtggcggccgctctagaactagtggatcccccgggctgcaggaattcgcacgagaccattacctagaacatcctaatcgaaaagcggaaatctcgcccgcccgcgagatcttctcgtcctggcgccctcccacgctcatcctcccctcgctcgcatatggcgccgtgcaacccggcacgctcggccgcctcacggcgctgcagctgctcagcctgcgctccaacaacctgtcgggcccgctcccccgcgacctnnccgcgctgccngcgctcgnnggnctcccannnnnnttnnncaaaccggnnnnnnaaacccgccccttttttctttccccgggggggggcggggttttccccccggccccccggggcttccgccgggttcgccggcgcttccagggggtcgaccctctacttccaaagggtttcggggggggggatcccccaaagggggttcgccaaaacttaaacccggcttttggccgggttttaaatcctccaaaaaaaattcgttttccgggggccggttcccgggaacctggggggctccccgcgcgtttaattttcccaaaaccttcccaaaaaaaaccgcctcttaaggggggccgggggggcgggggccaccttccccggggttttcgcaaaaaaaccccctttttttttgggggaaaaaaaaaaaatgggacgccccccccccccc

SEQ ID NO: 46987 - DNA, 751 bp, Zea mays
  misc_feature: Ceres CLONE 1453682-F
  misc_feature: Encodes the peptide sequence at SEQ ID NO. 46988
  misc_feature (333)..(333): n is a, c, t, g, unknown, or other
  misc_feature (378)..(378): n is a, c, t, g, unknown, or other
  misc_feature (463)..(463): n is a, c, t, g, unknown, or other
tccccgcggtggcggccgctctagaactagtggatcccccgggctgcaggaattcgcacgagaccattacctagaacatcctaatcgaaaacagctctcactcactcactcacaagtcacacagccacacttgaaccgctgcccgcagcggagggagcttgcacgggccaacgcacacataacacaagctcgtcgtcgatggcgcggtgggctgcggtgctggcgctggccgcggccacggccatcgccgtggcgtccgtggcgggcggcgacatgagcgcggactagactgagtgcgcggaccagctggtgggcctggcgccgtgcctgcantacgtgcaggggcaggcccgcgcgccgccgcctgactgctggcgncggctgcgcccagtgcttgggaaaagcccaaagtgcctgggcgggctcctcaggacaaggacaatcccaacctgggtaaaagatnaagggcacccttgggttggggttcccaaaggctggggggccccccggcccaaaagtccccaaggggtaaatccctggaaattcccccggggccaaaaaaaccccctttttttcccccgggggaaaaggtttcccctccccccccccaagaaaaaacttgggggaaaaacctcccccgccttgagaaaaacacgaaaggggtttctctcccccgggggaacacggggggagcccccgggggggtttcccacccccactcctctgtggggagagaaattccccttttttt

SEQ ID NO: 46988 - protein, 29 aa, Zea mays
  misc_feature: Ceres CLONE 1453682-F
MARWAAVLALAAATAIAVASVAGGDMSAD

SEQ ID NO: 46989 - DNA, 815 bp, Zea mays
  misc_feature: Ceres CLONE 1453683-F
  misc_feature: Encodes the peptide sequence at SEQ ID NO. 46990
  misc_feature (368)..(368): n is a, c, t, g, unknown, or other
  misc_feature (401)..(401): n is a, c, t, g, unknown, or other
  misc_feature (407)..(407): n is a, c, t, g, unknown, or other
  misc_feature (422)..(422): n is a, c, t, g, unknown, or other
gagctccccgcggtggcggccgctctagaactagtggatcccccgggctgcaggaattcgcacgagaccattacctagaacatcctaatcgaaaagtccaattcatccaccttgtccgtccctccctgagaaccagaaggccacccaccttccaaggcaggagaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcatggtctgttanatcaccgccatggtcccatcctactacaagaanatgtgnaccctgcccccccanccaccaataaaataacccgtgtgcccccctcaacgaggaaaggccctcgaaggtcaattggccaccagctgctgcggttgggaatcaggggcgctccctcctccctcccaggacgggggcacctgaacaacttcccccttcctttgaagaactgggctttaaaatcggcctttccttggcccgtaattcagggtgaaagaaaagacccccccatcccctggccttttcggtgtaccccgtggcttcctcttcctctaataatggacggccgcggcaaacctgtccccttggagagaaaccctcaagcaccttacccctctttcgttcaaagggtaaggcgctgggccctaccgcgcgcagcctctcaatgtatgtggctggctgtatcacttt

SEQ ID NO: 46990 - protein, 88 aa, Zea mays
  misc_feature: Ceres CLONE 1453683-F
  misc_feature: SWISSPROT Homolog: EC 4.2.1.1 Carbonate dehydratase
  misc_feature (66)..(66): Xaa is any aa, unknown, or other
  misc_feature (77)..(77): Xaa is any aa, unknown, or other
  misc_feature (79)..(79): Xaa is any aa, unknown, or other
  misc_feature (84)..(84): Xaa is any aa, unknown, or other
MDDPVERLKDGFHKFKTEVYDKKPELFEPLKAGQAPKYVVFACSDSRVCPSVTLGLQPGEAFMVCXITAMVPSYYKXMXTLPPXPPIK

SEQ ID NO: 46991 - DNA, 759 bp, Zea mays
  misc_feature: Ceres CLONE 1453684-F
  misc_feature: Encodes the peptide sequence at SEQ ID NO. 46992
  misc_feature (759)..(759): n is a, c, t, g, unknown, or other
ccccgcggtggcggccgctctattactagtggatcccccgggctgcaggaattcgcacgagaccattacctagaacatcctaatcaaaaaatcctcgttcctatcgacagttcgccacctcctttgctctcgcctcgcgcgcgctcccccccgcgcatcgtgccgttcggcaccgcaccgcgcccatggaggtcgccgccgtgcccagatccgccgcggcctgccgtgcggcgcccctgctcccggccgcccgagccgctgcgtgccacctggccctgcccatgcgcgcgttctccgcatccgtcacgacggaaacagcgccacgacgtgatcgccgctcgtcgcgctgcggatggtgagggagaaaagactgccccagatgctctccccatatgaaacccaccgcgccggttgtgagcgtgctggacatcagccaaagccgcgagatcctcccccacagggtccgattccttttggatgactgactacttgagtactgggctggagaatatgcagtgacccatgagaatgttattctctgtgcaaaatttcttcacaggacatttttcttgaatcgcccgatatgcccggtgttgctctggttgaggctatgtcccaagctctcgggactggtgatcctgctgcctcaaataggtgaatgacttgacaatttccttcttcgctgggattgaccatgtttcgttcaggaaaacaatgatttgcaggctctacgctgatctgcgaggtttatattgattn

SEQ ID NO: 46992 - protein, 57 aa, Zea mays
  misc_feature: Ceres CLONE 1453684-F
MEVAAVPRSAAACRAAPLLPAARAAACHLALPMRAFSASVTTETAPRRDRRSSRCGW

SEQ ID NO: 46993 - DNA, 739 bp, Zea mays
  misc_feature: Ceres CLONE 1453693-F
  misc_feature (452)..(452): n is a, c, t, g, unknown, or other
ggagctccccgcggtggcggccgctctataactagtggatcccccgggctgcaggaattcgcacgagaccattacctagaacatcctaatcgaaaaaccaaacagcgccgcgctccgcattgcgctagggttttagaactcttcctccggtcctccccgttatccctccaaaaggcagcgcccgctagggttttagccgccgcctccttccctctcctcctccacgtctcctcaacagccgctgccacccggagccttcccgcagcgacgccatgtgggctcttcgccgagctggcaaccccctcaggttccgtgcccaaaaagttgcaagtgcccatgtctgtgcgagtctttgagtgctgctagctgctgatgcaaagaatgtagaagagcacccatgagcagactgccagaaaatgtgctgctgtcataaaccaggtcaccagcctttncaatgtcattttcatctggccaggttgcttgcagtaggggttcctcctctcagcaggtgcaaattctggtgacaagctgatgaataaaaggacgaatttctgatctcaagttccacagcagttgtcaaagcgatgacgggtggcttcgaaaaaaattctgaagaggagcccctaaaaaattggcttgcccgaaggggatcccaaaccaaacccgggaagggcccccttaaaatatattggattcttttcccccaaaaattttttaaattttttccccccaaaagtgg

SEQ ID NO: 46994 - DNA, 737 bp, Zea mays
  misc_feature: Ceres CLONE 1453696-F
  misc_feature (256)..(256): n is a, c, t, g, unknown, or other
  misc_feature (367)..(367): n is a, c, t, g, unknown, or other
  misc_feature (387)..(387): n is a, c, t, g, unknown, or other
  misc_feature (391)..(391): n is a, c, t, g, unknown, or other
  misc_feature (392)..(392): n is a, c, t, g, unknown, or other
  misc_feature (412)..(412): n is a, c, t, g, unknown, or other
  misc_feature (415)..(415): n is a, c, t, g, unknown, or other
tggagctccccgcggtggcggccgctctagaactagtggatcccccgggctgcaggaattcgcacgagacaattacctagaacatcctaatcgaaaaatctaccggtgaaaacataaacaagtgtcgtaagcggaatcggggaaggaaacgaagtccggatccgttcctctttctcggaccggccgatggcgtcggcgtcggcggcggcggctttggagaaggctcggcagctgctggagggaggcggcggccgantcgctgccgacggagcaggtggacgcgctgccgtcggggttctacgacgccttcgtgctctgcggcatccgcgtccacgccgtcgagcccggccgcctccctctgcacttncacgtccccgcccgcgtccntcanntcggcaacttcctgcacggnggncgccaccgcgtccctggttgacttggtggggactgctggcttctacaccgccggggcgcaaaacagggggctcaccactagaaatgaccatcccctatctggaggctgcattttcggaagaaaaattgatttccgggcccagggttctgcggcttggaaaaccaagggagggccccctgggaactgaaaaaaaaatttgggaaaatttccctcaggcccctatttccaaagttttgggggcccccaaaaaagggggagggtcccctttctttaacctaacaccctgtttttctttttttttttgggccccctatataaaaaa

SEQ ID NO: 46995 - DNA, 750 bp, Zea mays
  misc_feature: Ceres CLONE 1453697-F
  misc_feature (161)..(161): n is a, c, t, g, unknown, or other
  misc_feature (163)..(163): n is a, c, t, g, unknown, or other
  misc_feature (167)..(167): n is a, c, t, g, unknown, or other
  misc_feature (395)..(395): n is a, c, t, g, unknown, or other
caaagctggagctccccgcggtggcggccgctctagaactagtggatcccccgggctgcaggaattcgcacgagaccattacctagaacatccctaatcgaaaaaaaaaaagacgcccaaaggttattccccaagcacaaacctctgagtctctgaaacancnccgnccgccgcgccgcatccgctacaggctaccctcaccaccgcgcacacccgaagtagtagcaggcggtgccccccccaatggcggcagaactggttgtgggcgcgtagggtgtgggaaaagtgggccgcgaagcacatcggcccctccgggaagccggtccaggctgcgctcctgctcaactacgaccccctccggccatctcgcctccttcccgtcgtagcagaagcangagggaacacaacttttcagctcttgatatgcaaccactcctggacttttgtcaagaggggtaatctgcagactgaatggttctcttgtgggctgaaccaacttttggccacctccatccatgaaaactggtttttcccccccctgcctttaccgcccaaaacccgaaaggggaaaggaataaaatttttccccaatgggaccttcgctaattaaccccctaggaaggccggggtctctctgcgccacttcccaaaaaaaagggggccccccaacactttttccaaacctttaaccccgggggaccccccatttcccccaataattccccgggagggtgttttcccccctttttt

SEQ ID NO: 46996 - DNA, 891 bp, Zea mays
  misc_feature: Ceres CLONE 1453706-F
  misc_feature: Encodes the peptide sequence at SEQ ID NO. 46997
  misc_feature (13)..(13): n is a, c, t, g, unknown, or other
  misc_feature (18)..(18): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (519)..(519): n is a, c, t, g, unknown, or other
  misc_feature (522)..(522): n is a, c, t, g, unknown, or other
gagagggaaaccnccacnacaaacacccccccccnncnnnccatactggagctccccgcggtggcggccgctctagaactagtggatcccccgggctgcaggaattcacactagaccgttacctagaacatcctaatctaaaaaaactgagcaaacccctcatcctattctacgcgcccggcgtctcgcttctccaaccaccgttgctaatccgcgcggcgaatcccactcccagtccaagctcggccgatgagatggacagtagcctacgcgaatccgaacagatcctgtagctgatgcggcagcagctggccaccaatgccggcaaggaggtcaccaagaaggtcggcctcacctaccagctcaacatcgcccccaacaagatcggcggtgatgaggagatcttcgtggtcgatgtcaagaatggaaaggtcaccaaagggccgtatcatggaaaggctgaacccaccctctccttcagggacaaggatttccttggaaccggcccccaccaagacnaancacaaagataggagttcattcaaagggagtgattaaacatcaaaggggaaggatcatatgcgtgcgacgcaagtttcacccccttgacattctatccccataacctaggctaagcctgatacaaaggtagagaattgtgggaataacgctgcccccaatgtggaaaaaagaaatggtttgggtagaggttgaaattaataatatagactataacaccccagatttgagaaataataaataagacaactttgcatcggtcggagaaattgatgaaacagatggggaagctctcgcacctttgatcaacgtgaagtataaatatagtgcttatttgaaagacacgatcgaacatttgcagagggtggcgtc

SEQ ID NO: 46997 - protein, 78 aa, Zea mays
  misc_feature: Ceres CLONE 1453706-F
  misc_feature: SWISSPROT Homolog: EC 2.3.1.176 Propanoyl-CoA C-acyltransferase
  misc_feature (75)..(75): Xaa is any aa, unknown, or other
  misc_feature (76)..(76): Xaa is any aa, unknown, or other
MRQQLATNAGKEVTKKVGLTYQLNIAPNKIGGDEEIFVVDVKNGKVTKGPYHGKAEPTLSFRDKDFLGTGPHQDXXQR

SEQ ID NO: 46998 - DNA, 715 bp, Zea mays
  misc_feature: Ceres CLONE 1453707-F
  misc_feature: Encodes the peptide sequence at SEQ ID NO. 46999
  misc_feature (522)..(522): n is a, c, t, g, unknown, or other
aaagctggagctccccgcggtggcggccgctctagaactagtggatcccccgggctgcaggaattcgcacgagaccattacctagaacatcctaatcgaaaaaggaaagcaaagcgcttcgcaagcacaggcagtgatcggtaaccaaatccggacagtcttgagctctctcagtctcagcatttcagttcccagattcacatagccccagcccccaagtagcgaaatggcagctgctccgttcgcgattgccggccggctctcccccgttgcgcgcctcccggtccgcgcctggaggcccgcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcccgcgccgcgcgacagcgctcgacatctccccatccccgttcgggttagttgatccgatgtcgccgatgcggacgatgcngcagatgctggacacgatggacaggctgttcgacgacgccgtgggggtccccatggggacacgggagtccccggcgaacaccggcgaagtacgcctggccgggggaactcggggaggaccaaaaggaggggaaaaagccgaatcaaatgccggggccccccccccaaacaagggaaaggtgaaggggaaaaaa

SEQ ID NO: 46999 - protein, 163 aa, Zea mays
  misc_feature: Ceres CLONE 1453707-F
  misc_feature (99)..(99): Xaa is any aa, unknown, or other
MAAAPFAIAGRLSPVARLPVRAWRPAHGFASSGRARSLAVASAAQENRDNSVDVQVSQNGGNRQQGNAVQRRPRRATALDISPSPFGLVDPMSPMRTMXQMLDTMDRLFDDAVGVPMGTRESPANTGEVRLAGGTRGGPKGGEKAESNAGAPPPNKGKVKGKK

SEQ ID NO: 47000 - DNA, 762 bp, Zea mays
  misc_feature: Ceres CLONE 1453708-F
  misc_feature: Encodes the peptide sequence at SEQ ID NO. 47001
  misc_feature (390)..(390): n is a, c, t, g, unknown, or other
  misc_feature (719)..(719): n is a, c, t, g, unknown, or other
cgcacgtgaccattacctacaacatcctaatcgaaaatctgagatgcactgctgtggaggcacttgttcacccattcttcgatgagcttcgagatcctaatactcgccttccaaatggccgctttttgccaccacttttcaatttcaagcctcacgaacttaaaggagtcccatcagacattgtcgcgaaattgattccaaaacatgcaaagaagcaatgctcctatgttggattgtgaaatgaccgcgccttgagactggaacctgtggttgcaattgtgcattttcgcctgggatgtttgaagaccccaaggaaagcaagccctgctgtagaaaatgcatagatacccccccccccgtggttgttgtgttcccccccaccccaacaanccctttttgttgtggtccacccaacgggctcccccccccttttgttttttgtccaccccttctttttgtttttttgttttgtcccccccttttttgttccccccctctccccccctgttgttgttttttgtttgttttgtccccccccccaatgttattatttgggatattcactttccacttttctccatatatcctcttgtgtttcctcacccgtttgtttgtccctccctattatattttgtagatactctcccagcgctatcctgttgtggtctataacaataatataataataattcttctccttccctctctccaccccctanggggtggtgcgctgcgcccctcattttcctcttttgtttctgt

SEQ ID NO: 47001 - protein, 78 aa, Zea mays
  misc_feature: Ceres CLONE 1453708-F
  misc_feature: SWISSPROT Homolog: EC 2.7.11.1 Non-specific serine/threonine protein kinase
HVTITYNILIENLRCTAVEALVHPFFDELRDPNTRLPNGRFLPPLFNFKPHELKGVPSDIVAKLIPKHAKKQCSYVGL

SEQ ID NO: 47002 - DNA, 791 bp, Zea mays
  misc_feature: Ceres CLONE 1453710-R
  misc_feature: Pfam Name: PH_2 Pfam Description: Plant pleckstrin homology-like region
  misc_feature (1)..(1): n is a, c, t, g, unknown, or other
  misc_feature (2)..(2): n is a, c, t, g, unknown, or other
nncccgattgggtaccgggccccccctcgaggtcgacggtatcgataagcttttttttttttttttttaattcctctaaaaataaatggatcgaaacgtccggtgatgtgaaatgtacattcagcaagttcaactgattagaggcaacattaactcctctatagtcagtaactccccaatcaccatgcatgatgacgggatgccatcacacaacatcatctctgcatctgcatttgcatgcatgctctttacagcgacctaactttacattacatggcgacccgggtacctgtcactgtcagtaccaacgctcagcgctttccgggcgtcggccaggaggcgcgcgacgcccttggtccacacctcatgctcgcgctggctgccgcactcgaactcgattacccgctgctccgcggtgcgcaggccgaagtagcgcccgtgctcgccgctgtccagcaggtgccgcccgggccacgctgccacgtcccggcacacgttcaacaccacgctcttctttctcttcgtgaaggggcccacgacgtgccaactcttcatcttcagcatcaccagccccggcgggttgatggacaccgagacgacctttcaatggaaccaccctttttcgggggggccttgaacaacttcggtgccccggcccaaaccaactcccggcgtgcaaattcccaaagaaaatttttttttcttccgccaaagaaacacagtcggtcgccttaaaaaaaaaatggccgccttgccttttttgctggcccccccaaccccccccggagaga

SEQ ID NO: 47003 - DNA, 724 bp, Zea mays
  misc_feature: Ceres CLONE 1453712-F
  misc_feature: Encodes the peptide sequence at SEQ ID NO. 47004
aagctggagctccccgcggtggcggccgctctagaactagtggatcccccgggctgcaggaattcgcacgagaccattacctagaacatcctaatcgaaaacttttttctcccccttggctggacgccccctccccctatggcagccatcctccattgcttcctcccccaagatctccccctacgcagcaaggatcgagaaaaggaggggcacgttgaattgaagaggaagagaggatcaaggagatgttcttccccatctcctcttgaagatttcttggggaaaccctaggtggctacactccagatcatgtcttgtacatttcttcttcttcgatgaaggtgcttgttgctcatcaaggggagtgggaagtagcagcacatccaccttcattctcataataatgctgcccagacgcagccatgatttaattagaaacttcttgtcaaatgatgtttgtttttaactagtcgtgcgcactgattaattcagttcatgttgttatggttgtcttcccattgctagcagattattaatgtcttatatgttttcttatcatgataaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcag

SEQ ID NO: 47004 - protein, 50 aa, Zea mays; identical to SEQ ID NO: 15603
  misc_feature: Ceres CLONE 1453712-F

SEQ ID NO: 47005 - DNA, 887 bp, Zea mays
  misc_feature: Ceres CLONE 1453713-F
  misc_feature (13)..(13): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (37)..(37): n is a, c, t, g, unknown, or other
aaaatatcaaaanacacanncnccccccaccaacccnaacaaatactggagctccccgcgcgggcggccgcgctctttctaaagaatagccccccctgcaggaattttacaaagaccgagaccgacaacatccaaacccaaaatcagaaatagaaagaccaactcggcggctcgagaagaaacctccacacctccagatcctctccagtactccacccaacccaactcccccacctcgctcgcataaaagctcgcctcgccaccgaccgaagccaccctcccaccaccgaacccgcagccgccgccgccaaaccacaccgcgctactctctggcggataacgaacagcgattttgatcggcagcactaacaacacatccccaaaaggatcaggaaggagaagataatgctggtgatgccccaaataataaacctgatgcacggagaagtttaagtaacaacccaactgcacccgggaaggaagactcccaacaggcaacaggaccaagacacccctcagcaaagagaaaaaagaagaattaagaatggatagaattttaggggtgcatagcaagatgaagtatcgtgctgtaaacaaaattcaacatgaaagactaagagagctcagagaggcaaccgaataacgaaaagtcatacaagcaaagaacaaggaggagccacctacaggatatggtgcgaggcccaaaaatttcactggggagtctgcgaaggtaacgtatgataacacaccattgagaaatcaagataagaactacaggatcgttacgtgaaagatttcgcctgacctcagcatgaagagggtagctcccttacaccatttataattgcataggacacgaaggagtcgtagttccacctctatctcgg

SEQ ID NO: 47006 - DNA, 956 bp, Zea mays
  misc_feature: Ceres CLONE 1453714-F
  misc_feature: Encodes the peptide sequence at SEQ ID NO. 47007
  misc_feature (24)..(24): n is a, c, t, g, unknown, or other
  misc_feature (25)..(25): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (309)..(309): n is a, c, t, g, unknown, or other
  misc_feature (468)..(468): n is a, c, t, g, unknown, or other
  misc_feature (476)..(476): n is a, c, t, g, unknown, or other
  misc_feature (481)..(481): n is a, c, t, g, unknown, or other
  misc_feature (485)..(485): n is a, c, t, g, unknown, or other
  misc_feature (846)..(846): n is a, c, t, g, unknown, or other
  misc_feature (956)..(956): n is a, c, t, g, unknown, or other
caggaacggtaaacatacaacccnnaccnnncnccccnnnnaaaaatactggagctccccgcggtggcggccgctctattcactagtggatcccccgggctgcaggaattcgcacgagaccattacctagaacatcctaatcgaaaaatctcgtccacgaaacgtacggacttcgggcatcggccccaacgccagcggcaccgcacccgcaccaccaagctcgtcggcgacatgaatccgcccgcaacagccgcgtccaccggcgcaggaggccacgccgcggcgcctgcggcagccccggagtacgcncactacccgaggctctcgccagaggaggtggccccgcccccgcccccccctttataagccgccaccgccgcgccctccggcttacggatggaaaccctttattttattcgcccgccggggggggtccgccacctccccgaagaaataggagttgaacancccccaanaaaanaaanaaggaaaaaagggaaaaaaagggtttgggcaacggccgcaccccccaaaaacgtgaaacctctcccggcggcatatttccgggggcagccctttttaaaaaccggtgacccagcctttatatcggtgtggccgttattgtgtatgatgggttcttttcggagggatcgcccacaaaatcattgttcaaaaaaagtggggattatttcaaaaagaaatttcccctctcaaaatattttatgggatgtgccccccctgcgggaaaagatattccataagggccgaagtccatgtattaatgtcgcgaaaaacaccgcgaaggggtcgctaagtgattgggagcgcattttgatcgcctcaaanatgacttaagacgtgtgcttatcacggcatagacacaccccttctctatcgattacggtggatatatactactctgagtagtagagaatcacttacgggagcgcggctcn

SEQ ID NO: 47007 - protein, 152 aa, Zea mays
  misc_feature: Ceres CLONE 1453714-F
  misc_feature (24)..(24): Xaa is any aa, unknown, or other
  misc_feature (27)..(27): Xaa is any aa, unknown, or other
  misc_feature (29)..(29): Xaa is any aa, unknown, or other
  misc_feature (30)..(30): Xaa is any aa, unknown, or other
  misc_feature (150)..(150): Xaa is any aa, unknown, or other
METLYFIRPPGGVRHLPEEIGVEXPPXKXXRKKGKKRVWATAAPPKNVKPLPAAYFRGQPFLKTGDPAFISVWPLLCMMGSFRRDRPQNHCSKKVGIISKRNFPSQNILWDVPPLREKIFHKGRSPCINVAKNTAKGSLSDWERILIASXMT

SEQ ID NO: 47008 - DNA, 709 bp, Zea mays
  misc_feature: Ceres CLONE 1453715-F
  misc_feature: Encodes the peptide sequence at SEQ ID NO. 47009
  misc_feature (545)..(545): n is a, c, t, g, unknown, or other
  misc_feature (566)..(566): n is a, c, t, g, unknown, or other
  misc_feature (567)..(567): n is a, c, t, g, unknown, or other
aagctggagctccccgcggtggcggccgctctagaactagtggatcccccgggctgcaggaattcgcacgagaccattacctagaacatcctaatcgaaaactcgcattcgccgctgcgtcaacgtgtcttccttcccgcggtctctccgccgcctcccagatccggcggccatggcaaggaacccgggctgcaccgtcttcataggtaacttggatgacaaggttcctgagagggttctgtatgaaattcttattcaggtaggtcgtgttgtagacctacacatacctcgtgacaaggaaactagccgaccaaaaggctatgcttttgctgagtatgaaacagaggagattgcccaatatgctgttaagctattttctggtcttgttcgacttcataataaaacgcttagatttgcgatctctgggcaagacaaaccctcattaaatggcaatatcccctgtactcctaggttaaactctgtaccacagccaaagcctcatcaacctatgaggtctagtgatactccttttgcacagcatgcancattgaatggcaggaatgccnnggtatggatccccacaaatcattctacgaaccgcacctccagcactgtcgaggggttaccgaatgagggactaccaacggactttgattatggaggccgtgatttggtccgttcgaatgaattaaccctcagctaccgggaa

SEQ ID NO: 47009 - protein, 179 aa, Zea mays
  misc_feature: Ceres CLONE 1453715-F
  misc_feature (9)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (125)..(125): Xaa is any aa, unknown, or other
  misc_feature (132)..(132): Xaa is any aa, unknown, or other
MARNPGCTVFIGNLDDKVPERVLYEILIQVGRVVDLHIPRDKETSRPKGYAFAEYETEEIAQYAVKLFSGLVRLHNKTLRFAISGQDKPSLNGNIPCTPRLNSVPQPKPHQPMRSSDTPFAQHAXLNGRNAXVWIPTNHSTNRTSSTVEGLPNEGLPTDFDYGGRDLVRSNELTLSYRE

SEQ ID NO: 47010 - DNA, 731 bp, Zea mays
  misc_feature: Ceres CLONE 1453716-F
  misc_feature: Encodes the peptide sequence at SEQ ID NO. 47011
  misc_feature (412)..(412): n is a, c, t, g, unknown, or other
tggagctccccgcggtggcggccgctctagaactagtggatcccccgggctgcaggaattcgcacgagaccattacctagaacatcctaatcgaaaaaaaagccattgcttgctcagcctctctgcactgcagggcgatgatgaggcaacggcaaactggcagcagcaagtactactagcgcttgctaaaggccaggagcccaggacccggaggtgctcgctgtcgctgatcaaccgcgcgccgtcgcaggcagcacagcaaccagcaacagccaacagctaggcaggtagtagtagtatacatgagcaggttcgcggggcagacgtccaccaggccgtgggtggggatggcgggctctggtgtcattgtgtccaaacctgccgccgccgacgtcgcgaggttctaccccanccccgccatgaggggcgccggcgccggcgccggcaccaacgccagcgccatctccttcggcttcgcggccacggcggtcctcgtctccatgttcctcctcatggccatcttcgagcacctcatcaagcccggcctggcttcctcctcctcccgcggcgcatcgggctcccatgaagacgccgccgacgacgatggcgaaggccgcggccaccgccaccgcatggggagatcacccccggctcgactgcgcgagcgcgacgacgcggcgccggacaagctctgtcacctgccaaaggtgaaggccgtggtggacttgacg

SEQ ID NO: 47011 - protein, 143 aa, Zea mays
  misc_feature: Ceres CLONE 1453716-F
  misc_feature (37)..(37): Xaa is any aa, unknown, or other
MSRFAGQTSTRPWVGMAGSGVIVSKPAAADVARFYPXPAMRGAGAGAGTNASAISFGFAATAVLVSMFLLMAIFEHLIKPGLASSSSRGASGSHEDAADDDGEGRGHRHRMGRSPPARLRERDDAAPDKLCHLPKVKAVVDLT

SEQ ID NO: 47012 - DNA, 560 bp, Zea mays
  misc_feature: Ceres CLONE 1453721-F
  misc_feature (332)..(332): n is a, c, t, g, unknown, or other
  misc_feature (428)..(428): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (486)..(486): n is a, c, t, g, unknown, or other
ggagctccccgcggtggcggccgctctagaactagtggatcccccgggctgcaggaattcgcacgagaccattacctagaacatcctaatcgaaaaattcggtctcttgctctctccctccttgtgcacagccatgtctagacgcttccagctgccccccatcctctcccttcctaatcacccgtgctgatcagcggcacggcggtcggcaaaaaacccccggggactggccataacccgtggcttggcgcccccaattcggttggaggaaaccattaaaagggtttacccgcccaaccgaaaaccggttcccaattttgaaaaaggggggnggggggggcccttcggggggggaaattatttccccaccccccccccccggggatttttccattaaacccccccgggagaagaaaaccccccccggngtttttttttttccccccccccccggagagggggggggggttccccccccnnntcccnttctcgcgggcgggggaaaaaaaaaaaaaaaaccccccccccgccaaaaaaaaaaaaaacctcttcttctcttt

SEQ ID NO: 47013 - DNA, 773 bp, Zea mays
  misc_feature: Ceres CLONE 1453727-F2
  misc_feature: Pfam Name: Acyl-ACP_TE Pfam Description: Acyl-ACP thioesterase
  misc_feature (315)..(315): n is a, c, t, g, unknown, or other
  misc_feature (316)..(316): n is a, c, t, g, unknown, or other
aaagctggagctccccgcggtggcggccgctctagaactagtggatcccccgggctgcaggaattcgcacgagaccattacctagaacatcctaatcgaaaagaatctttcagatcctgcacaatattcaagactaggactagtgccaagaagagctgatctggacatgaaccaacatgtcaataatgttacttacattggttgggtccttgaaagtatacctcaagatataattgatcacacgagttacaacaatcactctcgactatagaagagatgtcacacgatgacatagttgattctctacttacgtannagaaggagagagagagcatgaacgctctgcttctcagtgccgacaccgacagcggcggcagttcttgcttgctggaaatcgcacccaatgggatgaatcacccgggccgacccggtggggaaacctcctaaaaaaaggattttgggcccaaaattcggccccctttgctccccggggtgggggcccttgccccaatttcccaggggcaaagggaatttccctttttctgggttaaccccccggccttttttacaaagaaaagttgggggaaaaataaaaaccggttttccccccaaaaaaaaaaaaaattttttttcccccccccccgggggggggccccccccctctcccctttagtgttttttaccccgccgccgcggcggtttttttccgggggggaaaaaaaggggtgtaaaaattttgtgggggccccccccccttccgcgggtgagaaaga

SEQ ID NO: 47014 - DNA, 773 bp, Zea mays; identical to SEQ ID NO: 47013
  misc_feature: Ceres CLONE 1453727-F
  misc_feature: Encodes the peptide sequence at SEQ ID NO. 47015
  misc_feature (315)..(315): n is a, c, t, g, unknown, or other
  misc_feature (316)..(316): n is a, c, t, g, unknown, or other

SEQ ID NO: 47015 - protein, 52 aa, Zea mays
  misc_feature: Ceres CLONE 1453727-F
KAGAPRGGGRSRTSGSPGLQEFARDHYLEHPNRKESFRSCTIFKTRTSAKKS

SEQ ID NO: 47016 - DNA, 775 bp, Zea mays
  misc_feature: Ceres CLONE 1453730-F
  misc_feature: Encodes the peptide sequence at SEQ ID NO. 47017
  misc_feature (411)..(411): n is a, c, t, g, unknown, or other
  misc_feature (413)..(413): n is a, c, t, g, unknown, or other
  misc_feature (425)..(425): n is a, c, t, g, unknown, or other
  misc_feature (448)..(448): n is a, c, t, g, unknown, or other
ggagctccccgcggtggcggccgctctagaactagtggatcccccgggctgcaggaattcgcacgagaccattacctagaacatcctaatcgaaaaactattgacaggacgtagaccatttgacagctctagacccaggtcagagcagtcacttgtgcggtgggcaacaccccagctgcatgacatcgacgcattggacaggatggtcgatcctgcactcaagggtctatacccagccaaatctctatcccgatttgctgatgtccttgccctgtgtgtccagcctgaaccagaattcaggccaccaatgtcagaggtggtgcaagcattggttcgacttgtgcagagggccaacatgacgaagaggatgcttgatggggatacttctcggcgaccagatgacctggaccnangattcatatgancagctgaaactctgtcagattgnattattttcgtcgactagcggcccagccgagaccttatcccccaggaggaagaaacagaactctgtcagcttcgcccggacataatcacaagtttttcctgggaagcaaaggtgggccaaaagggtgggaccgggcccacaaaaaagaccttggatcttaccccaaaaaaaaaaaaaaaaactttaccataccccccaaccccaggggggcgcccggaaccaaattcccccaataggggcccattacccccctcccgggcccctttttaaacgccggggagggaaaacccgggtttcccattatacgcccgggaaaaaccccctttc

SEQ ID NO: 47017 - protein, 73 aa, Zea mays
  misc_feature: Ceres CLONE 1453730-F
  misc_feature: SWISSPROT Homolog: EC 2.7.11.1 Non-specific serine/threonine protein kinase
  misc_feature (70)..(70): Xaa is any aa, unknown, or other
  misc_feature (71)..(71): Xaa is any aa, unknown, or other
MVDPALKGLYPAKSLSRFADVLALCVQPEPEFRPPMSEVVQALVRLVQRANMTKRMLDGDTSRRPDDLDXXFI

SEQ ID NO: 47018 - DNA, 758 bp, Zea mays
  misc_feature: Ceres CLONE 1453731-F
  misc_feature: Encodes the peptide sequence at SEQ ID NO. 47019
  misc_feature (744)..(744): n is a, c, t, g, unknown, or other
  misc_feature (745)..(745): n is a, c, t, g, unknown, or other
aaactggagctccccgcggtggcggccgctctagaactagtggatcccccgggctgcaggaattcgcacgagaccattacctagaacatcctaatcgaaaaaacataccactacactacagcaggttgcccagttctgcacccccttcttccttctctcacttgcattgcacaccgaaaacctcttcttcgtcaggcaggcatgaagcttggaggacaagggaggcagatggggaggctcaacagggccttcagggagaaaagggcaaggttctacattttccgccgctgcgtcgtcatgctgcttcgctggagcgattagatattggtctccatgggagatgacttcccctccattctagatgttttttatttttttggtttggagctagtatccattttggtagagttttagaatttaggcgtagttgctcacttgctctgtacaggatggccggccgtgtgctggttcgagtggcaatcttttttgttttctttgcttgcatgttgtttcaggcaagggtgactgatccagctctgtggtctgagattgccataatttgtactgctgaaagaagattggtatgaaaaatatgttgttgttaacggcaaaaaaaaaaaaaaaaaagcttatcgataccgtcgacttcgagggggggcccggtacccaattcgcctatagtgagtcgtattacgcgcgctcactggccgtcgttttacaacgtcgtgactgggaaaccctggnncgtaccacttatc

SEQ ID NO: 47019 - protein, 39 aa, Zea mays; identical to SEQ ID NO: 45736
  misc_feature: Ceres CLONE 1453731-F
  misc_feature (18)..(36): Pfam Name: DVL Pfam Description: DVL family

SEQ ID NO: 47020 - DNA, 747 bp, Zea mays
  misc_feature: Ceres CLONE 1453733-F
  misc_feature: Translation starting site: 114
aagctggagctccccgcggtggcggccgctctagaactagtggatcccccgggctgcaggaattcgcacgagaccattacctagaacatcctaatcgaaaatcgcctgcatccatggtctcgctgctccctcgcgctccctcactcgccttcctcgctaagtccgcctcctcgcagcggccgcctgcgccatccatgtcgtcgcccttctccgccgcttccgtggccgcggggtcagaggcggcagccggcacgaggaagctgcctgtgctgctgttcgacgtcatggacaccctcgtccgggacccgttctaccaccacatcccccggcttctttcaaatgtccttgaaggaactactagaaaggaagtatccaacggccttggcaaaatttgaaaaaagactgattgacccccccaaaatggccaaaagttctttcagggagggcaaaacttttgatttccaaggccaaaaaaggggctggggaaaacaaatgaatactttgaggggcccaaaaaattttttttctgttgaaaaaaaaaaatttggaaaggcgggtttttaaaaatttcccccgggggcccccttattttgggggaaacccaaacctctccaaaaatttttttttgggaaattttttttctgggagaaagggccttaaaatttcttgtataaacctccctaaaaagaaaattctcctcttttttgggggggtggggcccccccccccccccctcggaaaagcccg

SEQ ID NO: 47021 - DNA, 727 bp, Zea mays
  misc_feature: Ceres CLONE 1453735-F
  misc_feature: Encodes the peptide sequence at SEQ ID NO. 47022
  misc_feature (423)..(423): n is a, c, t, g, unknown, or other
  misc_feature (424)..(424): n is a, c, t, g, unknown, or other
  misc_feature (444)..(444): n is a, c, t, g, unknown, or other
  misc_feature (460)..(460): n is a, c, t, g, unknown, or other
  misc_feature (536)..(536): n is a, c, t, g, unknown, or other
  misc_feature (563)..(563): n is a, c, t, g, unknown, or other
  misc_feature (564)..(564): n is a, c, t, g, unknown, or other
  misc_feature (579)..(579): n is a, c, t, g, unknown, or other
gggagtccccgcggtggcggccgctctagaactagtggatcccccgggctgcaggaattcgcacgagaccattacctagaacatcctaatcgaaagtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcanngccgccgggagaagctagcntattataaagcttaantaagtatagcggcgtcgctgtgtgtgtttcgagtcagtcagtcagttgcgtgccatggcatgctctgagtctgaanatgatgtgatggctgaatgcggcgtcnntgtccttcccctggncctctggggcgctttctgccagcaatgtgttgtgttggtgtggttgccgcacgctagcaggcttagcatgtgccctggctgggttgtgtcaccatccatctattatcttatccataccccacctttttgtgcaaaaaaaaaaaaaaac

SEQ ID NO: 47022 - protein, 82 aa, Zea mays; identical to SEQ ID NO: 43085
  misc_feature: Ceres CLONE 1453735-F
  misc_feature (1)..(80): Pfam Name: Metallothio_2 Pfam Description: Metallothionein

SEQ ID NO: 47023 - DNA, 736 bp, Zea mays
  misc_feature: Ceres CLONE 1453736-F
  misc_feature: Encodes the peptide sequence at SEQ ID NO. 47024
  misc_feature (353)..(353): n is a, c, t, g, unknown, or other
  misc_feature (422)..(422): n is a, c, t, g, unknown, or other
aagctggagctccccgcggtggcggccgctctagaactagtggatcccccgggctgcaggaattcgcacgagaccattacctagaacatcctaatcgaaaagacagtgcagcttgttctacttctgcttgctctggtgtctgtgccttggatgttgattccaaaacctcttctattgaagaagcaacatcagcaaaggcatcaaggtcaccagtacgcaatgcttcagggcgttgatgaatcagtgggagcagagctgggggaacatcatgaggaagcacatgaccatgaggagtttgagttcagcgaagtttttgttcaccagctgattcacacgatcgaatttgttcttgntgcagtctcaacacagcttcgtaccttcgctttgggctctgagtcttgcacactcgaggtgttcactgnattctacgataagtactactcatggatgggggttaaacatgtcatcatccttattatgggcatcatctcctcacaatttcccaccgttggttccctgtttgtttggaaaccctgaagggtttcctttccccccttgggtcttcctgggggggattcccaaaaaagttttttaaagggagggggtgaaaaattcccccccattttccttttgcctaattttggaagaaaaaaaataaaaccccccccttggcccaaaaaaaattttttgggggttttttccccaaaaaaaattttttttttgttgggggcggaga

SEQ ID NO: 47024 - protein, 128 aa, Zea mays
  misc_feature: Ceres CLONE 1453736-F
  misc_feature (68)..(68): Xaa is any aa, unknown, or other
  misc_feature (91)..(91): Xaa is any aa, unknown, or other
MLIPKPLLLKKQHQQRHQGHQYAMLQGVDESVGAELGEHHEEAHDHEEFEFSEVFVHQLIHTIEFVLXAVSTQLRTFALGSESCTLEVFTXFYDKYYSWMGVKHVIILIMGIISSQFPTVGSLFVWKP

SEQ ID NO: 47025 - DNA, 734 bp, Zea mays
  misc_feature: Ceres CLONE 1453738-F
  misc_feature: Encodes the peptide sequence at SEQ ID NO. 47026
  misc_feature (480)..(480): n is a, c, t, g, unknown, or other
  misc_feature (503)..(503): n is a, c, t, g, unknown, or other
  misc_feature (531)..(531): n is a, c, t, g, unknown, or other
  misc_feature (562)..(562): n is a, c, t, g, unknown, or other
tggagctccccgcggtggcggccgctctagaactagtggatcccccgggctgcaggaattcgcacgagaccattacctagaacatcctaatcgaaaaacccacccacgccgacgagcaaaccctagcgagcgagagagcccggagccgagagaccagccagccatggcgctgcgtgccctgtacaacgagatccggagcatgaaggtccgcgacgtgccggcttacctgaagccgcgcttgacctgggacaacgtcaagaagagcgccgaccaggccgtcgaccgctacatcgagaagtacatcgacacgagctcgccggaccctctctaccacgtctgcatcggagggatgatcttctcctacttcgtcaatctgccctgggagcgcgcccacctcgcccacctcgaggagatggagaggaccggtgggaagcactagatccgctgccccgtccctcgccggcagcgcgggaggacggntgactttcatggggtccattcangctgatggcttctgtttttctctgctgntgagctactggagtcatgttacttgggtcgntggtttttgacccagacagcaagaaactgtccagctttattgccttggtcccccgcgggctggtcaaaattactttcaaacaaaggagggcaggccttgggattaaaaaactttttcccaattggaatacaaaaattcccctttttttgtggaatttttacccccaaacccg

SEQ ID NO: 47026 - protein, 91 aa, Zea mays; identical to SEQ ID NO: 44946
  misc_feature: Ceres CLONE 1453738-F

SEQ ID NO: 47027 - DNA, 738 bp, Zea mays
  misc_feature: Ceres CLONE 1453742-F
  misc_feature (547)..(547): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (590)..(590): n is a, c, t, g, unknown, or other
  misc_feature (591)..(591): n is a, c, t, g, unknown, or other
  misc_feature (603)..(603): n is a, c, t, g, unknown, or other
  misc_feature (608)..(608): n is a, c, t, g, unknown, or other
  misc_feature (631)..(631): n is a, c, t, g, unknown, or other
  misc_feature (634)..(634): n is a, c, t, g, unknown, or other
  misc_feature (640)..(640): n is a, c, t, g, unknown, or other
  misc_feature (715)..(715): n is a, c, t, g, unknown, or other
  misc_feature (717)..(717): n is a, c, t, g, unknown, or other
  misc_feature (720)..(720): n is a, c, t, g, unknown, or other
  misc_feature (721)..(721): n is a, c, t, g, unknown, or other
ttccccgcggtggcggccgctctagaactagtggatcccccgggctgcaggaattcgcacgagaccattacctagaacatcctaatcgaaaaaagagactcactgctactcgcgctcttgccaccgtctactctccaacccttctgccatccctcggcaccagctcgctgacgctaccgccacccctaccgccaggccgcatagccgtgctccgctcaccttctctcgcgctacagtctcaagggtagctagccaagctaccaagctcgtcaggagcgagagaaagaggccgccggcggtgcgcggggatgatgatgatgagcagcggccgggcgggcggcggggccaccgcggggcggtaccccgttcacggcgtcgcagtggcaggagctggagcaccaggcgctcatctacaagtgcctggcgtccggcaagcccatcccttcctacctcatgccgccgctccgccgcatcctcgactccgccctcgccacgtcgccgtccctcgcctacccgccgcaaccctcactgggctggggctgcttcnggatgggcttcacccggaggccgacgagnnnaccgagcccggnncgtgccgcgcancgacngcaagaagtggcgctgctcccangangcgtanccggactcccagtactgcgagaagcacatgcaccggggcaagaacccgtcaagaaagcctgtggaaatgtccttngncanncgcggccccggcgccgc

SEQ ID NO: 47028 - DNA, 772 bp, Zea mays
  misc_feature: Ceres CLONE 1453744-F
  misc_feature: Encodes the peptide sequence at SEQ ID NO. 47029
  misc_feature (301)..(301): n is a, c, t, g, unknown, or other
  misc_feature (357)..(357): n is a, c, t, g, unknown, or other
  misc_feature (417)..(417): n is a, c, t, g, unknown, or other
acccgcggtggcggccgctctagaactagtggatcccccgggctgcaggaattcgcacgagaccattacctagaacatcctaatcgaaaagttctctaaccttggctcccgctccctccgcaggagcatctcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaaggaagttgtcactcaccanggcaaaaggtaccttgaggatgtgatttgcccacagcaggccatccccgtccgcangtattgtgggcgtgttggacgtaccgctcaggctaagtctcgtcactcaaatgggcaggnaaccttgccctgtcaaatctgctagattcattccaaaccttcccagaatggtaaaagcatgcttaagtaaaagggcttgaatgcaaacccctcaatgggcccaaatttcaatggaaccggttcaaaaaagcggggccagaacctcccggccttggggcgcataacccttaaagggccccccccgggccaaaataaatccttttttaaaaaaaaaaaacccccgaaaaaaaaggggtatttcctaaccccccccagaatttttaaaaaggggaaaccctccccgatgggggggagaaaaattttgggaatatttttcccccccactttttcacaaaaattgtttgcggggttctct

SEQ ID NO: 47029 - protein, 89 aa, Zea mays
  misc_feature: Ceres CLONE 1453744-F
  misc_feature (43)..(43): Xaa is any aa, unknown, or other
  misc_feature (62)..(62): Xaa is any aa, unknown, or other
  misc_feature (82)..(82): Xaa is any aa, unknown, or other
MVKYSTEPTNPTKSTKAMGRDLRVHFKNTRETAFALKEVVTHXGKRYLEDVICPQQAIPVRXYCGRVGRTAQAKSRHSNGQXTLPCQIC

SEQ ID NO: 47030 - DNA, 635 bp, Zea mays
  misc_feature: Ceres CLONE 1453755-F
  misc_feature: Encodes the peptide sequence at SEQ ID NO. 47031
  misc_feature (331)..(331): n is a, c, t, g, unknown, or other
  misc_feature (537)..(537): n is a, c, t, g, unknown, or other
ctccccgcggtggcggccgctctagaactagtggatcccccgggctgcaggaattcgcacgagaccattacctagaacatcctaatcgaaaagcgatgggagagcaggtcgtgacggagcgtatccagcggaagctggaggaggccaacgctaccgtccaacagcacctcgccggcatccaggaccacgtcaacttcaccatgcagcaagcatacttcaagtgcgcatatgattgcttcgatcggcgccgtactcaggaagcgatcaacaattgtgtggagaattgtggtatgcctgtccttgctgtcaacaatgtttttgagagtgagantggccaagttttcaggaaacggttgaacccggccactggagggggccgtggcaaaaaaaattttttgaaccccccccccccaaaagaaaaaaaaagcccccccggggaggggggcccctggggggccaaaaaattttttttaaaacaaccgggggggcccccccaatatgtgggggggcaaaaaaaaaaaccccccccccccctcnttggggggggggtgttttcctttttcttttaaaaaaaaaaaagagggggggggggggggttaccaccccccgggggggggattttttttttggggaga

SEQ ID NO: 47031 - protein, 157 aa, Zea mays
  misc_feature: Ceres CLONE 1453755-F
  misc_feature (10)..(112): Pfam Name: DUF842 Pfam Description: Eukaryotic protein of unknown function (DUF842)
  misc_feature (79)..(79): Xaa is any aa, unknown, or other
  misc_feature (148)..(148): Xaa is any aa, unknown, or other
MGEQVVTERIQRKLEEANATVQQHLAGIQDHVNFTMQQAYFKCAYDCFDRRRTQEAINNCVENCGMPVLAVNNVFESEXGQVFRKRLNPATGGGRGKKNFLNPPPPKEKKSPPGEGGPWGAKKFFLKQPGGPPQYVGGQKKKPPPPLXGGGVFSFFF

SEQ ID NO: 47032 - DNA, 771 bp, Zea mays
  misc_feature: Ceres CLONE 1453757-F
  misc_feature: SWISSPROT Homolog: EC 3.1.3.16 Phosphoprotein phosphatase
  misc_feature (579)..(579): n is a, c, t, g, unknown, or other
ggagctccccgcggtggcggccgctctagaactagtggatcccccgggctgcaggaattcgcacgagaccattacctagaacatcctaatcgaaaacccgttctggcgttcacacctctggctgccttcatttcctgttgacgactgagcgggcgagcgccggcgccctttgccaggtccgtcggcccgttagccggcgactagcgcctccctttgccaggtcttcgacgtccccttcgccgtcgactggcgcccagcagccagcagatccttttctatctgtcgtgttctgtctgcctggtacatttggaagaatgggggtttaccttagcactccgaaaactgagaaggtatccgaagaatggggaaaatgataaacttaaattcggaagtttcatctatgcaagggtggcgtacaactatggaagaatgctcactcggctttgctagatctcgacaatgacactgcgttttttggtgtttttgatggacatggaggaaaagtagtcgccaaattctgtgcaaaatatctacacagagaagttctcaggagtgaagcctatgcagctggtgacctgngtgctgctgtccacagagcttacttcagaatggatgaaatgatgcgaggtcaaagaggatggcgggaactttcagcacttggagatagataaatcagtttagtggcataatagaaagcttaatttggtctccctaaagcagtgatccaatgatagacatgatgattgggcttttgaggagtactccgtgaac

SEQ ID NO: 47033 - DNA, 754 bp, Zea mays
  misc_feature: Ceres CLONE 1453761-F
  misc_feature: Encodes the peptide sequence at SEQ ID NO. 47034
  misc_feature (364)..(364): n is a, c, t, g, unknown, or other
  misc_feature (407)..(407): n is a, c, t, g, unknown, or other
  misc_feature (410)..(410): n is a, c, t, g, unknown, or other
  misc_feature (430)..(430): n is a, c, t, g, unknown, or other
  misc_feature (434)..(434): n is a, c, t, g, unknown, or other
aaactggagctccccgcggtggcggccgctctataatagtggatcccccgggctgcaggaattcgcacgagaccattacctagaacatcctaatcgaaaaacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagccccctcgcctccgccaccccaggcgcgcgtcgcgctttccctgtacggctgctgctccaggcatctgcgctcgcgccgcgccagcgcgccttggccgtgaccgtgagggnccagagcgacgacgccgaagccgagcccaaggaggaggcggcngcngccaccaccccgggcgcaangtcnaaggcggcggcaaacgcaagcccccggcttggggacccgctgggttcaggggccgggttcccgagggcataaacggcgcctcgccagggtgggcttcggggcgggccccgccgtcaaggcgtcccggggggggggccctcccttcaaggccggaaagggttccgggtctcccgggtttcgggccccgggggccgggttttccggggcccccgggggcccctcctccgggggaacacccccaaaagacaaaaagggcccctcttaagggccccaaaccaaattttggagagggcccctttccagtgggggcgccccccccg

SEQ ID NO: 47034 - protein, 93 aa, Zea mays
  misc_feature: Ceres CLONE 1453761-F
  misc_feature (47)..(47): Xaa is any aa, unknown, or other
  misc_feature (69)..(69): Xaa is any aa, unknown, or other
MAATVMASMSPLASATPGARRAFPVRLLLQASALAPRQRALAVTVRXQSDDAEAEPKEEAAAATTPGAXSKAAANASPRLGDPLGSGAGFPRA

SEQ ID NO: 47035 - DNA, 705 bp, Zea mays
  misc_feature: Ceres CLONE 1453763-F
  misc_feature: SWISSPROT Homolog: EC 3.2.1.23 Beta-galactosidase
ctggagctccccgcggtggcggccgctctagaactagtggatcccccgggctgcaggaattcgcacgagaccattacctagaacatcctaatcgaaaatatttcttgatgaagatgaacctgttgctgcttagttgtagtcttctagactatgatgtggtcatctgacatgtgctttcactgctttgtcattgagtgattgtgagagagtcattttgtattgtaatatacatttgtaacagatacaaacttagtgattaaactttgagctggctgcactcttttttcctttctagggtttctcacaagggtgagttttacctagaaaggtttttaatgaggcagcattgcacaaaacaactcatttattataaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatccttgcagcacatccccctttcgccagctggcgtaatagcgaagaggcccgcaccgatcgcccttcccaacagttgcgcagcctgaatggcgaatggaaattgtaagcgttaatatttttgtaaaattcgcgttaaatttttgttaaatcagctcatttttttaaccaataggccgaaatcggcaaaatccctt

SEQ ID NO: 47036 - DNA, 756 bp, Zea mays
  misc_feature: Ceres CLONE 1453764-F
  misc_feature: Encodes the peptide sequence at SEQ ID NO. 47037
  misc_feature (609)..(609): n is a, c, t, g, unknown, or other
  misc_feature (679)..(679): n is a, c, t, g, unknown, or other
  misc_feature (715)..(715): n is a, c, t, g, unknown, or other
  misc_feature (728)..(728): n is a, c, t, g, unknown, or other
ctccccgcggtggcggccgctctagaactagtggatcccccgggctgcaggaattcgcacgagaccattacctagaacatcctaatcgaaactccgcgcactccacccaactcgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccaactcaagttccagaggaacaagaggtctgtcgctgaggagagagctggacgtaagcttggtggactgagggttcttaactcctactgggtgaatgaggatagtacctacaagtattttgagatcatccttgtggacgttgcccacaaagccatcaaaactgaccccgagatcaactggctatgncaccctgtgcacaagcaccgcgagctccgtggcctcacctcggcaggcaagaagttccgtggcctgcgtnggcagggcacacccacccacagaacaggcccctcangagagccacctgnaaagcgcaccagaccctctccctccgcc

SEQ ID NO: 47037 - protein, 201 aa, Zea mays
  misc_feature: Ceres CLONE 1453764-F
  misc_feature (2)..(193): Pfam Name: Ribosomal_L15e Pfam Description: Ribosomal L15
  misc_feature (152)..(152): Xaa is any aa, unknown, or other
  misc_feature (176)..(176): Xaa is any aa, unknown, or other
  misc_feature (188)..(188): Xaa is any aa, unknown, or other
  misc_feature (192)..(192): Xaa is any aa, unknown, or other
MGAYKYVSELWRRKQSDVMRFVQRVRCWEYRQQPSIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHKAIKTDPEINWLXHPVHKHRELRGLTSAGKKFRGLRXQGTPTHRTGPSXEPPXKRTRPSPSA

SEQ ID NO: 47038 - DNA, 781 bp, Zea mays
  misc_feature: Ceres CLONE 1453765-F
  misc_feature: Encodes the peptide sequence at SEQ ID NO. 47039
  misc_feature (403)..(403): n is a, c, t, g, unknown, or other
  misc_feature (411)..(411): n is a, c, t, g, unknown, or other
ggagctccccgcggtggcggccgctctagaactagtggatcccccgggctgcaggaattcgcacgagaccattacctagaacatcctaatcgaaaaatttcccgatcagacctgttatttcccgatcagacctattcctctctcggcctcccaccgccaccggcggcgacgagtaactcgcccgctgaccccagcaggcagccatgggagggcacggcgggttgaacatcctgccgcagaagcggtggaacgtctataacttcgacaaccgtgagaaggtgcaaaaagacgaggccgccgccgcccgggaggagcagctccagcgcgaggcggaacgccgccgcgagtcggatctacgcctcgctgcactacgccgtaaccgcggcctgttccaggcggagangccccccnctcctccatctcaccccggctgccccgctgatccggcggacgcccttcctccccggaggacgccctttccttccccggaaacggatggagaacacatcaaccctcttctcaaggggaatagggggtcccccccggatttccgatgcctcccccccggcccatggtgggaaggggccccgctcccgaaaccggaaccctggtcccaacccctatcccctaaaacccgaaaaaaaaaaggaaaaaaaggggaggggtttgggggcccccaataagaaaaaaaaaaagggggggtcacgccctttgccggaaaagaggggggcggggccccttgataattttacaacccccgcgcggagacccgccaaagaga

SEQ ID NO: 47039 - protein, 159 aa, Zea mays
  misc_feature: Ceres CLONE 1453765-F
  misc_feature (67)..(67): Xaa is any aa, unknown, or other
  misc_feature (70)..(70): Xaa is any aa, unknown, or other
MGGHGGLNILPQKRWNVYNFDNREKVQKDEAAAAREEQLQREAERRRESDLRLAALRRNRGLFQAEXPPXPPSHPGCPADPADALPPRRTPFPSPETDGEHINPLLKGNRGSPPDFRCLPPGPWWEGAPLPKPEPWSQPLSPKTRKKKGKKGEGFGGPQ

SEQ ID NO: 47040 - DNA, 763 bp, Zea mays
  misc_feature: Ceres CLONE 1453771-F
  misc_feature: Translation starting site: 180
agagctggagctccccgcggtggcggccgctctagaactagtggatcccccgggctgcaggaattcgcacgagaccattacctagaacatcctaatcgaaaaaacaaattcccgagacgccattctcaccatccacacaaagccacagcccaagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcgggcgagcccccgccgtgatcggggcggcgctggcaaagcgctgggctttctctacccgctggcgggcgcatcggggagggggacccccggggcggcccgccatccgttgcacggcgaaaggttttacttcccggaggcccaaggggacttgcaccctgaaggacgtggctttcttggaggggccctggtttttgccaaggaagaccttgtgccttaccccggaaaaacccttgggcccctttgccccacaaacccttttttgagtggggaaacccccattttccccctgggggggttttggggaggggggcggggtaacaccccccctcggggagggggggggggggggggggatttaattaacaccctggggagaaaaatgggggggggggtggggaaaacaaaagagtctcccctctttgtcccacaaaaaa

SEQ ID NO: 47041 - DNA, 752 bp, Zea mays
  misc_feature: Ceres CLONE 1453778-F
  misc_feature: Encodes the peptide sequence at SEQ ID NO. 47042
ctcaccgcggtggcggccgctctagaactagtggatcccccgggctgcaggaattcgcacgagaccattacctagaacatcctaatcgaaaaaatcctcctctctttactttgttcgtgagtgccgccgacgacgacggaggaaaagctaggggagctagcgagtgagcccagacatcctcctctaagattagcttttagctagcactagctagctagctcgatcatctgtcggtcggtccggcgcgcgcgagaccatggcgtccatcatcgtcatcgccgtcgtgctcgtcctggacgtcctcgccttcgtgctcgccatcggcgccgagcggcgccggagctacgccaacgtgaccgccgccgactcgtccgggcgtgcctactgcgtgtacagctccgacgcgtccacggcgtacggcgtgagcgcgctgctgctgctgctcgccgcgcaggccgtggccatggccgccacccgctgcttctgctgcggccgcggtctctcgccgggccgctggcgggcatggtccggcacctgcttcatcatctgctgggtgacgttcgtgatcgcggagctgtgcctgctggcggggtcggtccggaacgcctaccacaccaagtacgtctcgctgttcagcaacgccccgccccggtgcgccgtgctgcggaagggagtctttcgcgccggcgcccgcttcgcctttcctcacgcgctcctgggcgagctgcactacctcttctacgccagggcgg

SEQ ID NO: 47042 - protein, 165 aa, Zea mays
  misc_feature: Ceres CLONE 1453778-F
  misc_feature (44)..(159): Pfam Name: DUF1218 Pfam Description: Protein of unknown function (DUF1218)
MASIIVIAVVLVLDVLAFVLAIGAERRRSYANVTAADSSGRAYCVYSSDASTAYGVSALLLLLAAQAVAMAATRCFCCGRGLSPGRWRAWSGTCFIICWVTFVIAELCLLAGSVRNAYHTKYVSLFSNAPPRCAVLRKGVFRAGARFAFPHALLGELHYLFYARA

SEQ ID NO: 47043 - DNA, 751 bp, Zea mays
  misc_feature: Ceres CLONE 1453781-F
  misc_feature: Encodes the peptide sequence at SEQ ID NO. 47044
  misc_feature (384)..(384): n is a, c, t, g, unknown, or other
  misc_feature (409)..(409): n is a, c, t, g, unknown, or other
tacccgcggtggcggccgctctagaactagtggatcccccgggctgcaggaattcgcacgagaccattacctagaacatccttatcgaaaaaattgcgtgcgccctcgcctgtccccgcgtccccgcccctgtctcccgaagtcgtccgcgaccgccgccatgctcccctcgccccgtgccgcgtccgtcgtgacacggatcttagaacaccccatggatgtgtccgagattcgaggcctccccctcccttcccctccctcacccccatcggcgatgcctggatccgcgaccgtcgccgtccaaccccgacctccgtctatgaccgctctgtggtgacgcaagcgctggaggcatccacagggggctaccgcggctgggacggnttcgtgctcaccaccgatgactggnacgtccatcgggggaccttcccggcatggatggtgtctttgcaaggaaacgacagctcgctggtgctgctgaacacccgtccgggtcccgctgcggacggtgcaggcatggcgaagcacctgcagctgcacctggggcaggtgagcctacggagctggccaagttccttggctgctggggggcccgctgaaccttccgtccgaatgcaaatcagcgccttcttttggatcgtttcggggtttgcacgagcaccgcccgtgggtccggctccacaaatctaaccttcaaaacctgggaagggaagcggggtattttgggacgggtgcccccccggtccccccc

SEQ ID NO: 47044 - protein, 83 aa, Zea mays
  misc_feature: Ceres CLONE 1453781-F
MVSLQGNDSSLVLLNTRPGPAADGAGMAKHLQLHLGQVSLRSWPSSLAAGGPAEPSVRMQISAFFWIVSGFARAPPVGPAPQI

SEQ ID NO: 47045 - DNA, 739 bp, Zea mays
  misc_feature: Ceres CLONE 1453782-F
  misc_feature: Translation starting site: 183
ggagctccccgcggtggcggccgctctagaactagtggatcccccgggctgcaggaattcgcacgagaccattacctagaacatcctaatcgaaaactcaacaaaaaccctcgcaaaaatctgggatctatctagaagcatcactcaacaaaccctaggttgcctgatcggttgatcgctccatggcgatcatctccgacttcaaggacgacgaggcaccggagcagcagctggcggccggccacggcgtcgaggtggccctcgtggcggcgttggagaggagcggcggcgcgctccccttcctacaggcggatatggatgtcgcccaccgcaggtccggcctgttccgcgacccttcggcggtgagcaaggtcaccgcgatggcggcggccgtcagggcgcatatctcaccccacgagagggtgaccagcgaggcggacgccaataggaaggcggacgaggacgagaggaaggcggaggccgaggcgcagagggctgccaaggaggcggtaatggcgacggcagaggagaaccagagagcacggtggagaaggacagcatggaggtggataagaaagaagaaagccacgtgagacaaccaattgctggcaatggtcttgacttggagaagtactcgtggactcaacaggtgcccagaagttaccatcaccattcctgggtcctcaggacaaaatcaagattgtggtattgaattaaagaggaccatctgaaggttggc

SEQ ID NO: 47046 - DNA, 964 bp, Zea mays
  misc_feature: Ceres CLONE 1453787-F
  misc_feature (10)..(10): n is a, c, t, g, unknown, or other
  misc_feature (38)..(38): n is a, c, t, g, unknown, or other
  misc_feature (468)..(468): n is a, c, t, g, unknown, or other
  misc_feature (486)..(486): n is a, c, t, g, unknown, or other
  misc_feature (491)..(491): n is a, c, t, g, unknown, or other
catttttgtnaccagacaacacaaaaaaaaaaaacccnccaaaactgggactcaccgcggtggcggccgctcttttacagtggatcccccgggctgcaggagttcgcacgagaccattacctagaacatcctaatcgaaaaaaccctaaaccacccactatacccacccgcccggctagggttttgcctccatggccgccgccgcggccgccgcaccggaggctcctctcccgccgcgcctcctcgaactcaatctccgcgttcatccgccgcggtgctgctccaggagcaatagatgcctggctaccccgcaatcgcggccgacatccgcctcgagttaacacactagaatgacgcgaaagccctgcagagtcactgctacagcccgaggccaggaacccggtgtcttttgaatacgggtgcccctgattccaggggcttgctataaattagttgatgttattcctnacttactttaccaaaaanaaaangaaagggcgccacacaatgcagtctttaaggattcaaacggcaacattcaataaactctctttaatagggttctcgggatatgcgaccttgcgagaggttaaaataaaaaataattctagaaatctgttcctccaggggaaaaccctttagttttaagaggtgtatggggagcctctacaatcttttggaacacatatctatttcagcgcggatatgatgggcgccccccctagggtggctcattatagcgttatttatcctggagtaatctatctttttgtatccctcttgaaatttatgaactaatctatcacttatattacttgattgtgttcaaggcttcaactgtatgttcgagacagggcatttacgttatggtattgaataatcgagcatctaacttcgctccaagtacaattggttctccaagaaagagccttaacatacacaggtggatgtggcgcgcgtcagg

SEQ ID NO: 47047 - DNA, 722 bp, Zea mays
  misc_feature: Ceres CLONE 1453788-F
  misc_feature: Encodes the peptide sequence at SEQ ID NO. 47048
aagctggagctccccgcggtggcggccgctctataactagtggatcccccgggctgcaggaattcgcacgagaccattacctagaacatcctaatcgaaaaataaaaccctaaacccaggacccaggtttatcggtgaggcgagccgcgagtggaactgtggaagcgtcgagcttttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgacattttgggcacacttgtggactgattcagatcccggggcaagcgggtggtgagatgcgtaggaatttgaggttgggaacaaactccagaaagaactgtgccccggtcggggtgtcataaaatttgggggggaaacctcctatcctgggggataaaacttggtgcgcttttttgggatggcaaaaaaaaaaaaaaaaagagcttatccgtacccggcgaacg

SEQ ID NO: 47048 - protein, 98 aa, Zea mays
  misc_feature: Ceres CLONE 1453788-F
  misc_feature (4)..(96): Pfam Name: Cpn10 Pfam Description: Chaperonin 10 Kd subunit
MAKRLLPSLNRVLVEKLVQPKKTAGGILLPETSKQLNAAKVVAVGPGERDKAGNLIPVALKEGDTVLLPEYGGSEVKLAADKEYLLFREDDILGTLVD

SEQ ID NO: 47049 - DNA, 766 bp, Zea mays
  misc_feature: Ceres CLONE 1453793-F
  misc_feature: SWISSPROT Homolog: EC 2.6.1.2 Alanine transaminase
tggagctccccgcggtggcggccgctctataactagtggatcccccgggctgcaggaattcgcacgagaccattacctagaacatcctaatcgaaaacttgcttacgacgaaaatgacctcaccctagtatcacttcattccgtttcaatgagctatggggagagtggcagaagaggaggctacatggaggtgtctggtgttgcagctaatgtgaaggatcagatttacaaggtggcttctttaacactctgccccaacattgctggccagattctcgtcagccttgcaatggatccaccgaagctaggagatgaatctttcgagtcatttgataaggagaaggaacagatccgttcatccttccgcaagcgagccaagaccctggagaaagctttcagcggcctggagcgcccgacttgcaacaagttagagggtgcgctgtacttgttcccacggctccacctcccctccgctgcgatcagggccgccgatttcgagggagtttcacctgacatattctacgctcacccgcctgcttgatgccaccggggattgccgttgtgccgggctctgggttccaccaggcctctgggacgatccctatccgatgcacgatccttcctgacgaaagaaaatcaaggcgatggtcccacgctttgaggcgttccataaagcgttcatgaacgagttcccgggctctcagcaagtcatgaacgatctcctccctgatggtgtcaatgcatgcccgggttaggctgtgccggg

SEQ ID NO: 47050 - DNA, 758 bp, Zea mays
  misc_feature: Ceres CLONE 1453796-F
  misc_feature: Encodes the peptide sequence at SEQ ID NO. 47051
atagctggagctccccgcggtggcggccgctctataactagtggatcccccgggctgcaggtaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcaccagaagcagggcgccatgatgacggcgctcaaggccgcgacggccgcgaccttcggcgggtcgatgctggtgctgtcggggctgaacctgggcggcaccgtgatcgtgctcaaggtgccccccccccccgcgggggatcttcacccccgtgctggggccgggccgcaatccccttggccgctcatgccgggcggggttcttcacctcccggggacctcggcgcccctcgccctgaccgtggtcctcctggaaggtcaaatttactgaagggggaaaaaccccggcggggctccccacccgcttgtggccccccccaagggaaagggttgggcccccaagggcccgcccatcttaggggtttgacgcccacgcaccccttttcaccaggccctcgggggttctttaaaaaaaaaaaaccaccctctagaggagaaccccgcgggcaacacctcttataaaaccccggc

SEQ ID NO: 47051 - protein, 119 aa, Zea mays
  misc_feature: Ceres CLONE 1453796-F
MADHHRGATGGGGGYGDLQRGGGMHGEAQQHQKQGAMMTALKAATAATFGGSMLVLSGLNLGGTVIVLKVPPPPAGDLHPRAGAGPQSPWPLMPGGVLHLPGTSAPLALTVVLLEGQIY

SEQ ID NO: 47052 - DNA, 695 bp, Zea mays
  misc_feature: Ceres CLONE 1453797-F
  misc_feature: Encodes the peptide sequence at SEQ ID NO. 47053
  misc_feature (483)..(483): n is a, c, t, g, unknown, or other
  misc_feature (484)..(484): n is a, c, t, g, unknown, or other
  misc_feature (511)..(511): n is a, c, t, g, unknown, or other
  misc_feature (538)..(538): n is a, c, t, g, unknown, or other
  misc_feature (568)..(568): n is a, c, t, g, unknown, or other
ggagctccccgcggtggcggccgctctagaactagtggatcccccgggctgcaggaattcgcacgagaccattacctagaacatcctaatcgtaaactggctctcagtcacccacccccaccccaccccaccggcaccctcaccctcaggcctccgcctctttctcagcttctctccggttccttccttccggtcgccgattcttctacgcgaaagattcctggctgcctctcgtctctcgtctcgtttctcgcgtgcatggggctggacgtcggggagatcgggatgggcctggatctggggctggacctcaggctgttcgccgcgcggagcgccggagggatggccaagggcgctgcgccggcggggatccagtcctgcatcaggagcctcgaggtggagcgcaggaagatcgaggtgttcaggcgcgagctcccgctctgccttcgcctcctcgccgacgtgatcgacgagttgaagganngagctgccctagagagagagtacaacnacgggggcgcgacggtggacgacggcnaacaacggaaatgaatgaccacagctacanttgtgggtggaaagcaacccaattcgaaacaattctgacaaaaaccaccgaggtggaatcccctccccccccggaccccaatgtggttgggggggggcccacccacccccaaaagggggggccgttt

SEQ ID NO: 47053 - protein, 97 aa, Zea mays
  misc_feature: Ceres CLONE 1453797-F
  misc_feature (75)..(75): Xaa is any aa, unknown, or other
  misc_feature (76)..(76): Xaa is any aa, unknown, or other
  misc_feature (85)..(85): Xaa is any aa, unknown, or other
  misc_feature (94)..(94): Xaa is any aa, unknown, or other
MGLDVGEIGMGLDLGLDLRLFAARSAGGMAKGAAPAGIQSCIRSLEVERRKIEVFRRELPLCLRLLADVIDELKXXAALEREYNXGGATVDDGXQRK

SEQ ID NO: 47054 - DNA, 735 bp, Zea mays
  misc_feature: Ceres CLONE 1453801-F
  misc_feature: Encodes the peptide sequence at SEQ ID NO. 47055
  misc_feature (735)..(735): n is a, c, t, g, unknown, or other
gctggagctccccgcggtggcggccgctcttcactagtggatcccccgggctgcaggatttcgcacgagaccattacctagaacatcctaatcgaaaaacggatgtcacgtgggtggggctcttgatccctcgtccgcccccgggatccccgcgcggccgcgcgcgcgagcatttccggatctctctggtagccttctgatgtgctccgtcgggcctccgcttcatccactcgcccacctccatggcggcggtcccccccgcggaggcggatgcgcaggccgccttgatggacctcctcgaggacgaccacacagttctcagagttcgagatcgactccccaatgggatgaccaggaagatggcaacgaagctgtccagccctgggaggatgactgggatgatgacgacctcgacgatgatttctcactgcatctgatgatggagctggagggaggcaactctcacaagagctgacctacttcgatcaggctctgtgtggacattgctctctgaccctgtgatacttccctgccgatatcacgctctgatacttatcttcgtttctgcactgtgtatcatactgtgtgccttcttgcacggagttatcggctgcactttccataacttgcccagccgtgatattccgagagcctatctgcttagctcaaactggatggtgagtatgctctccataccatccacctcctgtggcgcgccggtaccacttcgacctn

SEQ ID NO: 47055 - protein, 91 aa, Zea mays
  misc_feature: Ceres CLONE 1453801-F
  misc_feature (39)..(86): Pfam Name: DSS1_SEM1 Pfam Description: DSS1/SEM1 family
MCSVGPPLHPLAHLHGGGPPRGGGCAGRLDGPPRGRPHSSQSSRSTPQWDDQEDGNEAVQPWEDDWDDDDLDDDFSLHLMMELEGGNSHKS

SEQ ID NO: 47056 - DNA, 820 bp, Zea mays
  misc_feature: Ceres CLONE 1453802-F
  misc_feature: Encodes the peptide sequence at SEQ ID NO. 47057
ggagctccccgcggtggcggccgcactacaactagtggatcccccgggctgcagtaattcgcacgagaccattacctagaacatcctaatcgaaaaagttcagcctcggctggacatcgagtttgtaccgggaaacagcttggtagtataaccactgaagatggtcagtgggaggccgcatggtgaattggactcatggttcaagagcctcatggtgacctctagcagcgagagggggcacgctgggagtggtggtccagcgctaatattaacaggatggaaggaccttccgatggagctcctggtggggataatatccacagttggagatgataggatggttatcgtgggggtctgggggtttcgaaaagctggaggtaaagaaaacaagcatggggctccccccccccccctgggtgccccgggggcgaaattgggggtgaaatatactttattggaattttttgggtctatggggttctaaaaggtttgtagtgttttgtactctttcgggggaaaacagaccccctcaatttgaaaacaaaagaggccgcttaaagcgccctgaaggttaatcttgagtggttatacactccgcgcgggaggtttgaaaactcctcactaaaaacatttctcgccataattgcaccccgttcttttttcaccgcccgctgctccgcgcgtatcgcccccggcttttttataactctaaacacctcagattatgtaatatcccccccaaccactatactcttgtatattttaacccccctctcatccgcattttttatataccacaacggatgtatttaatttgttt

SEQ ID NO: 47057 - protein, 107 aa, Zea mays
  misc_feature: Ceres CLONE 1453802-F
MVSGRPHGELDSWFKSLMVTSSSERGHAGSGGPALILTGWKDLPMELLVGIISTVGDDRMVIVGVWGFRKAGGKENKHGAPPPPLGAPGAKLGVKYTLLEFFGSMGF

SEQ ID NO: 47058 - DNA, 760 bp, Zea mays
  misc_feature: Ceres CLONE 1453804-F
  misc_feature: Encodes the peptide sequence at SEQ ID NO. 47059
  misc_feature (315)..(315): n is a, c, t, g, unknown, or other
  misc_feature (330)..(330): n is a, c, t, g, unknown, or other
  misc_feature (336)..(336): n is a, c, t, g, unknown, or other
  misc_feature (383)..(383): n is a, c, t, g, unknown, or other
ggagctccccgcggtggcggccgctctagaactagtggatcccccgggctgcaggaattcgcacgagaccattacctagaacatcctaatcgaaaaacacgaagccttcgcattcctgtccggcggaaccgctgaaggaagggagccgaacgagcaagcaagccaccaacgaaggttgctagggccggagtggatggggttcatgctgcgggtgaggctcgcctccttcttcgtcggcgcggctgccgccgccgcgggcgggggctacttcctctacaaggactacaagctcgccaacgactctctggccctcanggtgaaatgtctccnagactncactgacactcgctacgaagccctttgaaagcgactcgctgctttgnaaggtctgcaaagtcctgaagctgccaccgaatgtggaaacgccatcggattaggctgttcccctacaaactttgatttcccgccggttttccttggccccagttgtctttcccttttgaagcaagtccctgaacaacaaacaaaaattcaggaggcttctttttacccgaaaaggctcgagggagaaatctccccctacatttccggcccaaaaacccccttgacctccaaacttttttttcccgggtatccttgaaagggcccaaaggggcggacccccccaacccccttggaaaaaaaaacggcgccggggtttttcccccccccctcccccccaaaaaaaaaaaaaaaactctttctcccccgcccccccggg

SEQ ID NO: 47059 - protein, 56 aa, Zea mays
  misc_feature: Ceres CLONE 1453804-F
  misc_feature (41)..(41): Xaa is any aa, unknown, or other
  misc_feature (46)..(46): Xaa is any aa, unknown, or other
  misc_feature (48)..(48): Xaa is any aa, unknown, or other
MGFMLRVRLASFFVGAAAAAAGGGYFLYKDYKLANDSLALXVKCLXDXTDTRYEAL

SEQ ID NO: 47060 - DNA, 724 bp, Zea mays
  misc_feature: Ceres CLONE 1453805-F
  misc_feature: Encodes the peptide sequence at SEQ ID NO. 47061
  misc_feature (373)..(373): n is a, c, t, g, unknown, or other
  misc_feature (405)..(405): n is a, c, t, g, unknown, or other
ctggagctccccgcggtggcggccgctctagaactagtggatcccccgggctgcaggaattcgcacgagaccattacctagaacatcctaatcgaaaaaataatagttcggtgcctttttctagcggggaggaggcaggcggcgcgatctggcaccggccatcacgttccctcccgccgcttccccctccctgccctcccgttccccagatccgaagccattaaaaccagcggatctcacctcggggcgcgtccgcggcatctgggcaagcgagtggtagagccagcagccatgagatggtatgcatcggtagcctcctgagggcgctggtcctgagtgcggcggcgtctgcgggcaggtgccgggggcccanaatcctgtgtggccacgaggcggatgtacgcnccccccctcggcacggacacggctggcgcggattccgggcagtcacgggaaggatgatgctggactcctctgactgtgcctctgctgccgccgccgcggaggcggggcaggtgcagccgcagcgccgcgcggtgggggccgtgcccctggcgcacgacggccgctaccccagcggcggaagggagaagtaatgtatgtgcgtgtggtttgagaggctccaggaaagtaacctgtcggcacttgcatgtcgtggtgcggaacggggcatgggaacccggtaaaaggctgcattttgggtgcaatttttgcatggggtttt

SEQ ID NO: 47061 - protein, 99 aa, Zea mays
  misc_feature: Ceres CLONE 1453805-F
  misc_feature (26)..(26): Xaa is any aa, unknown, or other
  misc_feature (37)..(37): Xaa is any aa, unknown, or other
MVCIGSLLRALVLSAAASAGRCRGPXILCGHEADVRXPPRHGHGWRGFRAVTGRMMLDSSDCASAAAAAEAGQVQPQRRAVGAVPLAHDGRYPSGGREK

SEQ ID NO: 47062 - DNA, 759 bp, Zea mays
  misc_feature: Ceres CLONE 1453806-F
  misc_feature: Translation starting site: 258
aagctggagctccccgcggtggcggccgctctataactagtggatcccccgggctgcaggaattcgcacgagaccattacctagaacatcctaatcgaaaaaggacaggttgcatttgcatctgagttcctgatcgttgtattccagtttcttccgtgagttttgtgggatcgcgaggacgaaggatgtcgtgctgcggaggcaactgcgggtgctgagccagctgcaggtgcggcagcggctgcggagggtgcaagatgtacccggacatggctgagcaggtgaccaccacccagactctcatcatgggtgttgcaccatccgaggtcgggttcgtggcggccgccggagctgataacggcgggtgcatagtgcggcaccatctgcacctgcgacccctgcacctgcaagcgccaccacagcggcgatgacgctgcacggcgtgatgggggccctcggaaggactctttatctctagctaataaataagctctagtatatactattgtggcagtgtcgttttttgtggctttggttcgatcagtcagaaagtcatgccggggggggcctgggccatgggataaactgcctcgctttttctgctccatcgcccttgttctatcggatgtgacggatgggggcaaccaataattctcaccgatttgttgggggttgtaccctagacgaggcattccggggggtctatgtaacccctaagggggagaccgcggctgggatttgccttccgcggataccgac

SEQ ID NO: 47063 - DNA, 776 bp, Zea mays
  misc_feature: Ceres CLONE 1453809-F
  misc_feature: Encodes the peptide sequence at SEQ ID NO. 47064
ggcggccgctctattctagtggatcccccgggctgcaggaattctcacgagaccattacctagaacatcctaatcgaaaaagatgccaccacgaaggatacactactgcttttgctagatacttgtgcgagaagagagagctgcacggcgatagatatggggcatatcacgtgcgaaatcaagcgcgggagggcctctaccaaggtggcctgctacgacgagatgctgcggacagggctcttccagggcactccgatggagggaggcgagatcccctagtcccaggccgtagaccgcttcgccgcgtgccgacgcgatgcagataccccgtactcttctgaaaaggaaggattatacgaccaacccaccacaaagcaatgtctggttctgagaaagagatgtcccccacctgaccgtgagttggaggtgtgtgaaagcagaaaaccttgctccccccctaagaccaaacaagacatgtaggggggaggtcgacccgaatgtaccgccgggcgtaaacgagtttgttatgatgccacccggcccccggcttagcgattccgcctcaagaggggaccccaggatctacctactatatctccttgatcctggtccgatggcttctctcgccagttgttcttactcctgatagggaggctcggcttgtcccttacctttatttgctgaatttgccataacttattcaaccttcactctgccagtttgtgtaggctgttccataaactcagtttatatgaacctttttccgctcgtgtggg

SEQ ID NO: 47064 - protein, 40 aa, Zea mays
  misc_feature: Ceres CLONE 1453809-F
MGHITCEIKRGRASTKVACYDEMLRTGLFQGTPMEGGEIP

SEQ ID NO: 47065 - DNA, 778 bp, Zea mays
  misc_feature: Ceres CLONE 1453813-F
  misc_feature (383)..(383): n is a, c, t, g, unknown, or other
aagctggagctccccgcggtggcggccgctctatactagtggatcccccgggctgcaggaattcgcacgagaccattacctagaacatcctaatcgaaaagtcgatggccctcatgaaaatcacaaattgagagagagggagaagggggtgggggttacgtaacacggcgattcaggaggggatagcatcgtcatcgcaaaatgcaggctctcctgctctccgcgcgggccgcgccgccgacgccggcgatgcttcggcagcgtgcggtttctgcctccgcgtgtgcgtcgcaggtctgccgccccctattcggtgccgccaattgcatctcctgtggggtctacggaagcgttcggcggcacctcacagtggcggtgggcgngggccccgccttcgcctcgtccccacctttccttcggaccgttcttacccgacgcctccaccaaccaacaagaagggggaaagggccaagcttcgagccggtttttggggaaacctaaaaaaaaacccaagggtttttccagaattttgggaccccccgggggttcctggtcccccattgggggtccccaatttattcctcgcggaaatttgtgtttcccttcctttttaaagggggaaagggaacccccccttttatttttccacccaccgccccgggggatatcccgctgttttttttccccccccgtcgaatataggggccccaccctcctcccctaaagggttttaaacaacaaacaaacacccgtgtggagccccccccctcgtggttgt

SEQ ID NO: 47066 - DNA, 727 bp, Zea mays
  misc_feature: Ceres CLONE 1453815-F
  misc_feature: Encodes the peptide sequence at SEQ ID NO. 47067
ctggagctccccgcggtggcggccgctctagaactagtggatcccccgggctgcaggaattcgcacgagaccattacctagaacatcctaatcgaaaacttagggcaaagcatagcaacggcggctgcgcagcaagcagttcagctcagcacctcgccggacgccggctcacccatccggccatcccctgccggccgactctccctggtccccagcgcagcaagcagttcaccggagccggcgcagcaagtagtcagcagtcatcaatgcaaaatcaaccacaaaaggttctagttcaagagagagtgagtttgttccacataaaaatacttgtttggtggatgaggaggaggatgaggttgatcttgatgagttgtatgcaacaacaagcaatgaccagaaggtgccacagcttagatttgtatatgagcgaagacctagtgaaggtcaatgacaatgaaagcacatttggaatcctatcatggtggaaaaggcaagtcccaaatttcccaattcttccaccccttgcccgggaggggtgcctatgcaggggccaccggttgctcaaaaacctcctttaattcgggggaaccctttgtgaaaaattccgtttaaaacccaacccaaattttttgggccttttgttttttctaaaaattaaaaaattctcccaaaaaaattggaaattaaaaaaaacccccgaggaaactttaaaggcctttcttgg

SEQ ID NO: 47067 - protein, 75 aa, Zea mays
  misc_feature: Ceres CLONE 1453815-F
MRLILMSCMQQQAMTRRCHSLDLYMSEDLVKVNDNESTFGILSWWKRQVPNFPILPPLAREGCLCRGHRLLKNLL

SEQ ID NO: 47068 - DNA, 744 bp, Zea mays
  misc_feature: Ceres CLONE 1453817-F
  misc_feature: Encodes the peptide sequence at SEQ ID NO. 47069
  misc_feature (346)..(346): n is a, c, t, g, unknown, or other
  misc_feature (370)..(370): n is a, c, t, g, unknown, or other
  misc_feature (387)..(387): n is a, c, t, g, unknown, or other
  misc_feature (389)..(389): n is a, c, t, g, unknown, or other
  misc_feature (406)..(406): n is a, c, t, g, unknown, or other
tggagctccccgcggtggcggccgctctagaactagtggatcccccgggctgcaggaattcgcacgagaccattacctagaacatcctaatcgaaaaactcctgacttcgccatccggcgatcgccacagccctagctccggcgtctctagcgatccccaaaacccactccgccgcatttctgccgacttggccggattggtcgcttattgagatggctacgccacttatagcaggacttgcagttgcagcaactgctcttgctggtcgatatggcgtccaagcttggcaagcttataaggcaaggcctatagttccaaggatgcgcaaattctatgaaggtggcntttcaccctacatgaaccgaaggnaaagctgcattatcctngntgtcagggaaactgccnacgcaaaagaaggtaaaagaagcgcaccagaggggtatgggtcgcccaacattccagatgctggtggaagtcattaccttgcctccaaaaattaatgaggcaaaggattggttttcagggaacaaacaaaggagggggggccgggcctttggattggaaaatataaaaggccctccctgcgaaaagggaaatttttggcccccaattttcccataaaaaaaaccgggaccccccctttttcttggggttttgaaaaatttttgggaaaaaaaatttgggccccttgtgggaaaacccccgggtgtataaaaccccccgggggggccgcctaaaaaaaa

SEQ ID NO: 47069 - protein, 95 aa, Zea mays
  misc_feature: Ceres CLONE 1453817-F
  misc_feature (45)..(45): Xaa is any aa, unknown, or other
  misc_feature (53)..(53): Xaa is any aa, unknown, or other
  misc_feature (59)..(59): Xaa is any aa, unknown, or other
  misc_feature (65)..(65): Xaa is any aa, unknown, or other
MATPLIAGLAVAATALAGRYGVQAWQAYKARPIVPRMRKFYEGGXSPYMNRRXSCIILXVRETAXAKEGKRSAPEGYGSPNIPDAGGSHYLASKN

SEQ ID NO: 47070 - DNA, 749 bp, Zea mays
  misc_feature: Ceres CLONE 1453819-F
  misc_feature: Encodes the peptide sequence at SEQ ID NO. 47071
  misc_feature (331)..(331): n is a, c, t, g, unknown, or other
tggagctccccgcggtggcggccgctctagaactagtggatcccccgggctgcaggaattcgcacgagaccattacctagaacatcctaatcgaaaaaagccaccgcagccctagcgcgccgccaccttcaccttcgcagccctagccgccgccgccgcctccattgctgctatacccgcaaccatgggtcccgtgctgaagcgcccgaccccgggcacagtgcagtgtttcgggcgcaagaagacggccgtggccgtggcctacacgaagccaggccgagggatgatcaaggtgaacggcgtcccgatcgagctgctccgtcccgagatngctgcgctcaaggccatggagcccgtgctgctggcggggcgttccagttcaggacatcgactgcggatccgcccgcccggcggcgggaaaaacctccaaattaccccatcccccaggccgtcccaaagggcccggggaaactaccaaaaaaaccccaaaaagggggcaaaaaaggaataaagggaaattttttggggcttaaaagggaccccctcttttcccaaaacccccccgtggaaaacaaaaaaattgtggggccccggccccccgctgcctttttcaaaaactccccccctaaaacccccccccccgcaaaaacacgggggggggccccttttttccccccttttaaaaaacatgtaaaaaaaaggggggggggaaaacacacccccccccccctcttttatttatttttatt

SEQ ID NO: 47071 - protein, 108 aa, Zea mays
  misc_feature: Ceres CLONE 1453819-F
  misc_feature (17)..(107): Pfam Name: Ribosomal_S9 Pfam Description: Ribosomal protein S9/S16
  misc_feature (49)..(49): Xaa is any aa, unknown, or other
MGPVLKRPTPGTVQCFGRKKTAVAVAYTKPGRGMIKVNGVPIELLRPEXAALKAMEPVLLAGRSSSGHRLRIRPPGGGKNLQITPSPRPSQRARGNYQKNPKKGAKKE

SEQ ID NO: 47072 - DNA, 720 bp, Zea mays
  misc_feature: Ceres CLONE 1453821-F
  misc_feature: Encodes the peptide sequence at SEQ ID NO. 47073
tggagctccccgcggtggcggccgctctagaactagtggatcccccgggctgcaggaattcgcacgagaccattacctagaacatcctaatcgaaaaaggctctcagccttatccccttcgtacaacactgtcaccaggaattcccttgcctttgctcgttctcatggccgagcacaagtcttcctcaagcgtcgcctgctgtaccagtgtcgagctccccacgcccaccgctactcctagcccctctcctccctggatttcgcccagtctccatctctctttctagccatggacggcgacctctcctgcctacagcaggtcagcgccccatctcctcaacatctcggctccctgtcccatctctctcacgagccactcttctcgttctccatggcgtcgacatggggctcgcccctgcaacctcgcctcgctgggtttcctcagggcgccgggatgctgcttcctatacatcgtgcgactccctggtgcttgctctcgccctagtccatggagcagtagcagccacgacactccttcgtgtcgcgccctcgacgtgttcgatgaaatactgcagcgagctccaactcgatctgcacagcccctgcgcgatgtcacaaactccgctcgttgtcgatgtcgtgcttcgggcatcgcgtgttcgacgaaaatcccaagtccatggacagcacatgcacaactcaaatccgatcggccaggtt

SEQ ID NO: 47073 - protein, 106 aa, Zea mays
  misc_feature: Ceres CLONE 1453821-F
MGLAPATSPRWVSSGRRDAASYTSCDSLVLALALVHGAVAATTLLRVAPSTCSMKYCSELQLDLHSPCAMSQTPLVVDVVLRASRVRRKSQVHGQHMHNSNPIGQV

SEQ ID NO: 47074 - DNA, 816 bp, Zea mays
  misc_feature: Ceres CLONE 1453822-F
  misc_feature: Encodes the peptide sequence at SEQ ID NO. 47075
  misc_feature (572)..(572): n is a, c, t, g, unknown, or other
aaagctggagctccccgcggtggcggccgctctataactagtggatcccccgggctgcaggaattcgcacgagaccattcctaaaacattctaattcaaaaaagggacatccactcccagtcttatcacccaagaggagcgacgaggaatcatgccttcggttaaaaaaccatccccatcgtcggtagatagccacgctgcttggttcgatccggccgatcgatccactgccacagctactgatgccccctctcctccctggattacatccaggctgcttctcgcttagtagcaagggatcgtcacctctcggggctactgcaggtgggagcgccctcgtcctcaggtggcgccgtcgttgtgctgtttgtcacaagaccccagtcttctcgtcctccatggtcagggggccccccccccccccctttggatctcggcttccgttggttttccgtaaaggtccccggaaaggcgggttttataaagccaccctgcaaaatgccttgcttggggtggtaatgggccctaggggctttgtaactttataaactccccaaaaacctcccctttgnaaaagcggcctctcccagggggttctttataaaaggggtgggaaacagagtttccaattcgaaaaaaatcaccccccgggggccgaatgttagaaaaatttttccgtattatacaaatatgaaaatctcccggtcaggaggggggtttgcagaaagagaatactttccgcggggcagcaggggtggacgaatataatagcgccgagctccccaggaataaaaaggggtcggtcataaaacgggg

SEQ ID NO: 47075 - protein, 49 aa, Zea mays
  misc_feature: Ceres CLONE 1453822-F
MVRGPPPPPFGSRLPLVFRKGPRKGGFYKATLQNALLGVVMGPRGFVTL

SEQ ID NO: 47076 - DNA, 799 bp, Zea mays
  misc_feature: Ceres CLONE 1453823-F
  misc_feature: Encodes the peptide sequence at SEQ ID NO. 47077
  misc_feature (373)..(373): n is a, c, t, g, unknown, or other
  misc_feature (409)..(409): n is a, c, t, g, unknown, or other
ggagctccccgcggtggcggccgctctataactagtggatcccccgggctgcaggaattcgcacgagaccattacctagaacatcctaatcgaaaaaaaccataagagcttctgagtctagacactagatacagtaagccttagcaccaacagaggttagtatctcaacaaggatacttcaaatatgtccgcctcacgcagctcctctcccaactccatctcacagtggagccagaaagagaacaagatgtttgaagaggcactcgcatactacggcgagggcacatccaaccggtgggacaaggtgtccagagccatgggaggcatcaagtctgctgaggaggtgcgctgccactatgaagatcttgaccangacgtcaagatgattgaatcagggctagtgattgancctttcccccaaaaacatggattccggaactgaagttggaatggttggagggcccagggagggcgaaaacaaagctctttgaaactaagaagggacccagggttttaaagggaagcaaagaaatccccccccggggttgaaaaaataaaaggaagaacaggggggcaattgcaaaaaaaagggtttagacccaggttaagtggtacccggggggtggcggggtcttaaaaaaaaaaaaaaaaaaattgtttagtataccgcccaccctcgagggggggcgcgccggacacccctttccgcccataaagagagacaaaaataccggttccccaggggggcggacgttttacaaacgctcggtgtgggcggaaacatctcggtgtgttatcc

SEQ ID NO: 47077 - protein, 85 aa, Zea mays
  misc_feature: Ceres CLONE 1453823-F
  misc_feature: The sequence is a functional homolog of SEQ ID NO 510 in the 10/666,642 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature (63)..(63): Xaa is any aa, unknown, or other
  misc_feature (75)..(75): Xaa is any aa, unknown, or other
MSASRSSSPNSISQWSQKENKMFEEALAYYGEGTSNRWDKVSRAMGGIKSAEEVRCHYEDLDXDVKMIESGLVIXPFPQKHGFRN

SEQ ID NO: 47078 - DNA, 676 bp, Zea mays
  misc_feature: Ceres CLONE 1453827-F
  misc_feature (607)..(607): n is a, c, t, g, unknown, or other
aagctggagctccccgcggtggcggccgctctagaactagtggatcccccgggctgcaggaattcgcacgagaccattacctagaacatcctaatcgaaaaaaaaatagccgaatccgtatcgaaaaaacgggaatatccgtctctgtctctagtacccgagtacacccgacccacccaaactgtgttgcgtggcatgatccgtgtgaaacaccttcgagtcttcgatcttcttgtgcgtcgccaacgcgccggcgccctcctcccctgcgcctcagcctggtaccgtgcctgcgccgccctgtgctccggtcctccgccctccgcatctgcctggtaccgtgctagtgccgccttcgcatccgtcctccgcctgggtctccgccctccgcggctccgccttgcgactttaccctgcacggcccgccgccggccggtcgcccgtccggagccactgacccgagtttccgtccagcactccagggaccagcgcctgttcgtccagagtaccaacagatctcgtcaaagagtctgaaggatgaggaagggactgcatcctcgatggcatggatttcatatgtgacgcaagtggtaggctgatcatatcntgatgaccaggtgaacctacttgcaaaggtaccacatgaaggccaaacggaaatggtcaaaaccccgcc

SEQ ID NO: 47079 - DNA, 798 bp, Zea mays
  misc_feature: Ceres CLONE 1453828-F
  misc_feature: Encodes the peptide sequence at SEQ ID NO. 47080
  misc_feature (347)..(347): n is a, c, t, g, unknown, or other
ggagctccccgcggtggcggccgctctagaactagtggatcccccgggctgcaggaattcgcacgagaccattacctagaacatcctaatcgaaaaaccaaacaaactgaaccactgtccgctgcgtgctttccttcctctcaacgccagccttgccgagagcccgagaccaatcgccgccatctcccggaatgacggggtgacgaaaccgcgccgcaccagacaagacagaggagccgccgccgcgacccacaggccaccgggtcgccgaggaggggatccagcgagccatgtcgaccgacgtgcccatgagccccgagctcgagcaggtggacggcgagatccangacatcttccgcgcgctccagaatgggtccagaaaaatgaacaaatcaaggactccccccccccccccaagcagctgggagaatctccgggccaaaatgaaagaaggcaagcgcttgaaccaaaagtttgaccggttactccaggagagggaaaaaaagaaccccccgggatgccaacagccgctccaggaaaagaacccgtcccgggccaaagaaacccccctccctgggggcccttaggggaaacgcccccaaaccacccctgggggaaaaaagggccaaaactttcccaaccgggaaagagacccggggggagaaagaaccccccctcaaaggggcccccaaaggggaaaaacaaaaacctttttccccgcggaggaaaaaaagggcgcaccaccgtgtcgcctcgtggggggcccaaaagtggtggcgtcaccccagcggggtgggg

SEQ ID NO: 47080 - protein, 98 aa, Zea mays
  misc_feature: Ceres CLONE 1453828-F
  misc_feature (19)..(19): Xaa is any aa, unknown, or other
MSTDVPMSPELEQVDGEIXDIFRALQNGSRKMNKSRTPPPPPSSWENLRAKMKEGKRLNQKFDRLLQEREKKNPPGCQQPLQEKNPSRAKETPLPGGP

SEQ ID NO: 47081 - DNA, 756 bp, Zea mays
  misc_feature: Ceres CLONE 1453832-F
  misc_feature: Encodes the peptide sequence at SEQ ID NO. 47082
  misc_feature (655)..(655): n is a, c, t, g, unknown, or other
  misc_feature (756)..(756): n is a, c, t, g, unknown, or other
acccgcggtggcggccgctctagaactagtggatcccccgggctgcaggaattcgcacgagaccattacctagaacatcctaatcgaaaaacggagtaccattcatcatcagagctagcaagctcaaagaaaactgagctcgtgtgtggtgagcagcgagtgagtgagggactggtgaccatttcaagaacagcgccgcagcagggagctaattcgttcgttcatcgtcgcatcatcagtttgtgatccttcgcccccgtagcttcctgcaacttcgagctcactaaacaaccatgggaggaggcacgctggagtacctgtcggatctgctaggcggcggcggcggccggcgccggtacaagaagaggaagcagttccagacggtggagctcaaggtgcgcatggactgcgacggctgcgagatgaaagtcaggaacgcgctctccagcatgaaaggggtgcactccgtggagatcaaccgcaagcagtacaaggtgacggtgcaggggtacgttgagccgcacaaggtggtgaagcgggtgcaggccacggtgaagaaggccgagatctggccctacgtgccctacagcctcgtcgcgcacccttacgccgcgccggcctacgacaagaaggcgccgccgggctacgtgcgcanggtcgacgccgtcatgcccgtctcctccacctacgcgggcccgcggcggcgggcggggccgcgcatgaagagcggctcgcccacatgttcagcgacgacan

SEQ ID NO: 47082 - protein, 154 aa, Zea mays
  misc_feature: Ceres CLONE 1453832-F
  misc_feature (32)..(92): Pfam Name: HMA Pfam Description: Heavy-metal-associated domain
  misc_feature: SWISSPROT Homolog: EC 3.6.3.4 Copper-exporting ATPase
  misc_feature (121)..(121): Xaa is any aa, unknown, or other
MGGGTLEYLSDLLGGGGGRRRYKKRKQFQTVELKVRMDCDGCEMKVRNALSSMKGVHSVEINRKQYKVTVQGYVEPHKVVKRVQATVKKAEIWPYVPYSLVAHPYAAPAYDKKAPPGYVRXVDAVMPVSSTYAGPRRRAGPRMKSGSPTCSATT

SEQ ID NO: 47083 - DNA, 769 bp, Zea mays
  misc_feature: Ceres CLONE 1453835-F
  misc_feature: Translation starting site: 178
tccccgcggtggcggccgctctagaactagtggatcccccgggctgcaggaattcgcacgagaccattacctagaacatcctaatcgaaaagtgttgaggcgagtggaagcttcgagtttttttttcttccttttggcttactgcgcaagaagaagggtaacaagaggacggcggcgatggcgaagaggctgctcccatctctgaaccgggtgctggttgagaagctggtgcagcccaagaagaccgccggcggcatcctcctcccggaacatccaagcagctgaatgctgctaaagtggtggctggtggccctggtgagcgcgacaaggcagcaatctgatcccagttgctctgaaggaaggtgacactggtctcctggcaaaagtatggggaacctgaattttaacttgcacctgaataaaaatacctcctcttcaaaaaacacgaacttttgggccaccttggggatggattcaaaactccccaaccccggcccaaggcggtgggtccaaacttccgggggggagaagggaaatacaaattcgggggaaaaaaccccaaaaacctggaaaggggggggggccaaaaattttggggaaaaacaccaaaattggccccttttttgtggaaaccaaaattttgggtaaagagggcccccctaaagggggtcccccccccccccgggggggagaaaaaaaaaaaaaaaaatttttttctccccccccccccgggggggggggccgggcccccctcccctcctagggaggg

SEQ ID NO: 47084 - DNA, 692 bp, Zea mays
  misc_feature: Ceres CLONE 1453838-F
  misc_feature: Translation starting site: 165
  misc_feature (244)..(244): n is a, c, t, g, unknown, or other
  misc_feature (245)..(245): n is a, c, t, g, unknown, or other
  misc_feature (270)..(270): n is a, c, t, g, unknown, or other
  misc_feature (312)..(312): n is a, c, t, g, unknown, or other
  misc_feature (313)..(313): n is a, c, t, g, unknown, or other
  misc_feature (384)..(384): n is a, c, t, g, unknown, or other
  misc_feature (385)..(385): n is a, c, t, g, unknown, or other
  misc_feature (466)..(466): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (476)..(476): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (494)..(494): n is a, c, t, g, unknown, or other
  misc_feature (495)..(495): n is a, c, t, g, unknown, or other
  misc_feature (503)..(503): n is a, c, t, g, unknown, or other
  misc_feature (524)..(524): n is a, c, t, g, unknown, or other
  misc_feature (525)..(525): n is a, c, t, g, unknown, or other
  misc_feature (541)..(541): n is a, c, t, g, unknown, or other
  misc_feature (548)..(548): n is a, c, t, g, unknown, or other
  misc_feature (560)..(560): n is a, c, t, g, unknown, or other
  misc_feature (561)..(561): n is a, c, t, g, unknown, or other
  misc_feature (568)..(568): n is a, c, t, g, unknown, or other
  misc_feature (605)..(605): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (647)..(647): n is a, c, t, g, unknown, or other
  misc_feature (670)..(670): n is a, c, t, g, unknown, or other
  misc_feature (671)..(671): n is a, c, t, g, unknown, or other
  misc_feature (678)..(678): n is a, c, t, g, unknown, or other
  misc_feature (679)..(679): n is a, c, t, g, unknown, or other
  misc_feature (681)..(681): n is a, c, t, g, unknown, or other
  misc_feature (682)..(682): n is a, c, t, g, unknown, or other
agagctggagctccccgcggtggcggccgctctagaactagtggatcccccgggctgcaggaattcgcacgagaccattacctagaacatcctaatcgaaaaacaggcaccacagctgagagacgatagaagcacgcagcagctgaaagggaggggaactaggaatgaaggggagcaaggtccacgagcacgaggcagacgtccccgcctccgacctctgggcgatctacggctccctccgcgnnccgcggaaactcctgccggagctgnctcccgcacgtgcttgccaaggtgggagctcgtcagccgggnngaaaccggccggtggtttgggtaacccattctttggcagcctaataaatttcccctctcccggggggaatnntttcccctgggggggcttttcccggggagggttttccaaaaggggaaaaaaaatttttccccccaaaaaaaattttagaanaannnnnaanaacannnnaacaaaaaannagacaccncaccccgcggggcaccccgannggttcagcagactganttggggngccggctagggnnaggaaanacaatagttatgaagcacttatagatgtaaggaaggngacccctcctctaagtccatgtggaggtgnnnttagaaaggngattagataaataattacaaaannaaccaanntnnttcaacctac

SEQ ID NO: 47085 - DNA, 750 bp, Zea mays
  misc_feature: Ceres CLONE 1453839-F
  misc_feature: Encodes the peptide sequence at SEQ ID NO. 47086
  misc_feature (572)..(572): n is a, c, t, g, unknown, or other
  misc_feature (630)..(630): n is a, c, t, g, unknown, or other
tggagctccccgcggtggcggccgctctagaactagtggatcccccgggctgcaggaattcgcacgagaccattacctagaacatcctaatcgaaaaattttacgcgaggacggataggacattcggcgttcctaggtaccccgctgcttccgtgctcacctcgcctgcagggccgcagccgctggaagaacacgaagacgacgggagtgcggggtggcgtcgccgctggagcaccagctgtagccgccggctaggcctccgcgccgctctccgtggccaacgcgccgtcatgcttgcggcgtcggcgcggcggctgtccgccgccgcctcgttttcctcttcttccatgcgctccagccagctcgccgccgtactgaaccaacagaggtggatgcacgacaggaacaagaaggcgatggagctggtggccaagggatggagtgcgctccaggaggtcgaccgcgtcatcgactacgccgatctcaacgacaagcgcctcatcccgcttctaaggggcgctaaggaaaactttgagctggctttggagattgacaatggtaatacacatgcngaggtatttggctggggaaaaatgccatttcaagtatcattgttcctggtggcttgcnaggcagttgggtgctgctttgttgggttgaagctgcaaatatggggggatccaagatgcacagtatggaactgggaggccgactaagaattgaaaaatgactatgttcccgccggaacaa

SEQ ID NO: 47086 - protein, 141 aa, Zea mays
  misc_feature: Ceres CLONE 1453839-F
  misc_feature (114)..(114): Xaa is any aa, unknown, or other
MLAASARRLSAAASFSSSSMRSSQLAAVLNQQRWMHDRNKKAMELVAKGWSALQEVDRVIDYADLNDKRLIPLLRGAKENFELALEIDNGNTHAEVFGWGKMPFQVSLFLVACXAVGCCFVGLKLQIWGDPRCTVWNWEAD

SEQ ID NO: 47087 - DNA, 727 bp, Zea mays
  misc_feature: Ceres CLONE 1453840-F
  misc_feature: Translation starting site: 436
  misc_feature: Pfam Name: FTHFS Pfam Description: Formate--tetrahydrofolate ligase
  misc_feature: SWISSPROT Homolog: EC 6.3.4.3 Formate--tetrahydrofolate ligase
caaagctggagctccccgcggtggcggccgctctataactagtggatcccccgggctgcaggaattcgcacgagaccattacctagaacatcctaatcgaaaatgtgaccaaaaatgtggcccttgttgaagctggatgtattaatcttgctaaacatatatcaaacacgaggagttatggagttaatgttgtacttgcaatccacaaatttccatcatatactgaggcagaaatgaaggcagtgcacactgcagctatggctgctggtgcttttgacgctgttgtctgcacacaccatgcccatggtggtaaaggagcggttgatcttggacttgctgttcaaccagcatgccaaagccaggcaaaacctctgaagtttttgtatcccttggaatctagcataaaggacaagattgagtcaattgctaagttctatggtgctactgccgttgaatattccacagcaggctgagaagcacattgatatgtacaccaagcaagggttctccagcctccccatttgcatggccaagacccagtactcgttctcacatgtcccgtccatgaagggcgccccgaccggctttgttctgcctataagagacgtgagggccagcatctccgcttggttcatctacccgctcgtgagcaccatgagcacaatgcctggtcttcccaccagaccctgcttctaccagatcgacgtcgacactgccaccgggaagg

SEQ ID NO: 47088 - DNA, 793 bp, Zea mays
  misc_feature: Ceres CLONE 1453842-F
  misc_feature: Translation starting site: 248
  misc_feature (228)..(228): n is a, c, t, g, unknown, or other
  misc_feature (294)..(294): n is a, c, t, g, unknown, or other
  misc_feature (342)..(342): n is a, c, t, g, unknown, or other
  misc_feature (435)..(435): n is a, c, t, g, unknown, or other
  misc_feature (445)..(445): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaatcgaaaaccgggttctggctcgccaaaccctagccgccgagtgccgcccaccgcccgcccgccctccgccgcgcgtcggacggtgtcgagggaagaggcaccatgaggttggagaagtgctggttctgctccntctaccatctaccccggccatggaatccagttcgtccgcaacgacgccaaggtcttccgcttttgnccggtcaaagtgccataaaaacttcaagatgaagaggaaccctcgtanggttaagtggacaaaagcatacaggcatttgcatgggcaggacatgacccaggatacaacctttgagttttgagagaagaggaacaggcccgnagcgcctacnaccgcaattttgacggaagcaaactcttgaaggctttccccccttattgcaaagattaggcctgacccgtatggaaaacccattctaaaacgaacttaaactgggtaaancccaggaaaatggaaaaggcccccggggagctgggaacgggattccgctttgccccaaaaaagcttttttccccccttcccgggcttaaaaaacaaagggcagggtttaatttttccccccccaaaaaaataaacccttagaaaaaaacggggggctttttgggggctggtgttttccggggggagaaactcttttttttttttcaaaaaacttttgtgttgaaaaattttttttttt

SEQ ID NO: 47089 - DNA, 769 bp, Zea mays
  misc_feature: Ceres CLONE 1453845-F
  misc_feature: Encodes the peptide sequence at SEQ ID NO. 47090
  misc_feature (635)..(635): n is a, c, t, g, unknown, or other
  misc_feature (653)..(653): n is a, c, t, g, unknown, or other
  misc_feature (679)..(679): n is a, c, t, g, unknown, or other
aaagctggagctccccgcggtggcggccgctctagaactagtggatcccccgggctgcaggaattcgcacgagaccattacctagaacatcctaatcgaaaagcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacaccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattattataagctaaataaagtatagcggcgtcgctgtgtgtgtttcgagtcagtcagtcagttagttgcgtgccatggctggcatgctctgagtctgagatgatgatgatgcctgatggcggcgtcgtgtcctgtagtcctcccctgcccccctcggcgcttctgggcgcaagcantgtgttgtgttgtggtgngtgggtgcagcacggtagcatgctangcatgtgccctgctgttgttgtgtcacatccatctataataacttatcccataccccaccaaaaaaaaaaaaaaaagctatcgatacggc

SEQ ID NO: 47090 - protein, 82 aa, Zea mays
  misc_feature: Ceres CLONE 1453845-F
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHTEGGFEAAAGAENGGCKCGGNCQCDPCNCGK

SEQ ID NO: 47091 - DNA, 754 bp, Zea mays
  misc_feature: Ceres CLONE 1453851-F
  misc_feature: Encodes the peptide sequence at SEQ ID NO. 47092
  misc_feature (373)..(373): n is a, c, t, g, unknown, or other
  misc_feature (482)..(482): n is a, c, t, g, unknown, or other
aagctggagctccccgcggtggcggccgctctatactagtggatcccccgggctgcaggaattcgcacgagaccattacctagaacatcctaatcgaaagaaggacctagcgagcggttgcggcggctgcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctanacgctacccgcggcgtgggttggggcaaggatgcccgcccgcctgaactccacgagcccaagaagaccgtcaaggaggagtagcggcgctgctgccttgcttctcgtgntgctgttcctggattggagaggtgatctgacccttccattgagttgaatgcagtagcctggaactgtggtagttcctcttttacatcttaagctgctgatagacttctaataaatcttgtccaagagaaccttccgcgagcgtacatgttgtccatcgagctgtgtaattgagcaaatcgccagactgaaacccgctgcctgccctgttccccaatgcccgctgtaccaaaaaaaaagaaaaaatcttatccctaccccccgacctccgggg

SEQ ID NO: 47092 - protein, 104 aa, Zea mays
  misc_feature: Ceres CLONE 1453851-F
  misc_feature (78)..(78): Xaa is any aa, unknown, or other
MVRKAKVEFDEQPPDNFDPKNPYADPVAMLEYREHLVREKWIQIETAKIIRERLRWCYRIEGINHHQKCRHLVDQYLXATRGVGWGKDARPPELHEPKKTVKEE

SEQ ID NO: 47093 - DNA, 823 bp, Zea mays
  misc_feature: Ceres CLONE 1453856-F
  misc_feature (335)..(335): n is a, c, t, g, unknown, or other
  misc_feature (338)..(338): n is a, c, t, g, unknown, or other
  misc_feature (394)..(394): n is a, c, t, g, unknown, or other
  misc_feature (396)..(396): n is a, c, t, g, unknown, or other
  misc_feature (407)..(407): n is a, c, t, g, unknown, or other
  misc_feature (425)..(425): n is a, c, t, g, unknown, or other
aagctggagctccccgcggtggcggccgctctagaactagtggatcccccgggctgcaggaattcgcacgagaccattacctagaacatcctaatcgaaaaaccgttgcttgctctttgaattgcctttgcccccatttgctttcctgtttcttccatcccatccgtaccagctgacggtgcccgggttccatgcccagcggccagcgccttgtgacctgatccgcggctcgtccattcctccctccgtgaatggctcctccagcagggtctggggcagcgacggagggagggccggcacggcggcgcggcaccggcaccggtaccagccccggnccngcacaagtgtgggtcgagccgccgggcaagagccaccaccagaccccgggggggtngntgcccccgccnttcgccccgggccccgtnggtgggggccaaaaaggtggccgggggggaacctaccttggccgcaacccgccatctggaaccaccccacatttaatccaggggccccctccccccccccgagggaaaggccctcccccgggaaatgggattaacccccctccaaggcgccgcgggggaaagggagttccccccaatatttcctggggtttgaaagaagaaacaaaaaaaacgctttgtgtggggaaaaattttctaaaaaaaaacagtgggtgtcccccccccgggggaaaaaaaaaattcctagagggggccaaaattttttttaacgcccccccccccctatttgagggaaaaaaagaggtgtgttcccacaccagaggggggggcgccccccccaaaaagaaaaaaaccccccc

SEQ ID NO: 47094 - DNA, 743 bp, Zea mays
  misc_feature: Ceres CLONE 1453858-F
  misc_feature: Encodes the peptide sequence at SEQ ID NO. 47095
  misc_feature (728)..(728): n is a, c, t, g, unknown, or other
ggagctccccgcggtggcggccgctctagaactagtggatcccccgggctgcaggaattcgcacgagaccattacctagaacatcctaatcgaaaagaaaaaactgagacccacccgaccaaaatcccccacccgccgcagtccacgcgcccgcaccgcaccgcgcgccgcgctcgctgccgtgccagtgtccccttcctttcccgtttccccctccctctctctttccccacgcccgacgcccccaccactctctcgatccaaagccagatcggcacgacgagcagaggccccccccggagcggcgcggagcaatggcggcgggataccgggcggaggacgactacgactacctcttcaaggttgtactgatcggcgactccggcgtcggcaagtccaatctgctctcacgcttcacgcgcaacgagttcagccttgagtccaagtccaccatcggcgtcgagttcgccacccgctctctccaggcctggcaagggcgagaagattaacataaaggatgatgtttcggcggtgaagaagggtggctgctgctctagctgagctgccctgctgtattttttggagttgtggtgatgtagcttatggtacggcatttccagcgaccgagaactggtagtggcattagcagcttctatgttacctagagagtttattgtcaaactggggaaaaaaaactgaaggttagatcggtgtagatctttctggtnactgtatgtgtatcc

SEQ ID NO: 47095 - protein, 64 aa, Zea mays
  misc_feature: Ceres CLONE 1453858-F
MAAGYRAEDDYDYLFKVVLIGDSGVGKSNLLSRFTRNEFSLESKSTIGVEFATRSLQAWQGRED

SEQ ID NO: 47096 - DNA, 776 bp, Zea mays
  misc_feature: Ceres CLONE 1453860-F
  misc_feature: Encodes the peptide sequence at SEQ ID NO. 47097
  misc_feature (723)..(723): n is a, c, t, g, unknown, or other
ctggagctccccgcggtggcggccgctctagaactagtggtcccccgggctgcaggattcgcacgagaccattacctagaacatcctaatcgaaaaaaaaaccatatacgaggccacccagggtacggcggcgctcggttccgtggcggggagtgttttccaggcggcggcgcggtatcgtgaaaccgggcgaccgagcaagcgacggccatggcgttctggcaaacccgcgattttctcttctgtgggatatgcggcaccctcctcaccttcgactccgtccgctccgcctcctgccctctatgcggcttcaagcgcgatgcctaagaagttgaagggaaagaaataccgtacactatgaccgccgaggatattcgaagagggttaaagacactaacggaggacgttgttgggcaaagaccagtgacaaataacgcctgtccaaaatgcgaccatccaaaagctgaattttacaacatacagatgcgttcagcagatgagggagagacgacgttctacatgtgtaaaggatgcggctgtaatttcaaagacgaatgaggagttatcctaccacttctacggatatatggcattggtgccgaagagatttccagcgttgacagactagtactccctccgcccttcttttatttatcatcgtctaggtcacaaatgagcggccgataaatattcgagaattgcaatctactcccttgacattgntacattacatggatgcgcaaatccatgcgctgtgcaacctttcttttgatgga

SEQ ID NO: 47097 - protein, 38 aa, Zea mays
  misc_feature: Ceres CLONE 1453860-F
MAFWQTRDFLFCGICGTLLTFDSVRSASCPLCGFKRDA

SEQ ID NO: 47098 - DNA, 755 bp, Zea mays
  misc_feature: Ceres CLONE 1453867-F
  misc_feature: Encodes the peptide sequence at SEQ ID NO. 47099
aagctggagctccccgcggtggcggccgctctagaactagtggatcccccgggctgcaggaattcgcacgagaccattacctagaacatcctaatcgaaaaacgagaggagatcgaaggagactccaattccagtcgcccccatccgttcctcatctcaccagaagcgaagccggaggagggaggaaggagatcgcgagcagccggagccggaggccgagaggatgaagacgttcgacccgtggccggtcttcttccgccgggagtggaagcgcaactggccctttctcacggggttcgccatcaccggcttcatcatcaccaagatgacggccaacttcaccgaggaagacctcaagaactccaagttcgtccaggaacacaagaagcgctgaccaaccgggtggagtcgtccgaatcgcctgcggatgaaaaattagccccctatttttcttgtcttttttttatctagatgcgtgcactctattgtaataatgtaataagaggcaattggattgatccaacagcaaccggcttctgattttgatccgcttcgctgacatatgcatgcagcaaacgaatatgtgccttttttttttcttgatgttggattgcatctaatcctgttgaattggtgagctgggtcctctgtgatttcatctttccctgataaagtcctgaagatagattaaaaaaaaaaaaaaaaagcttatcgataccgtcgacctcgagggggggcccggtaccccattcgcc

SEQ ID NO: 47099 - protein, 56 aa, Zea mays; identical to SEQ ID NO: 5462
  misc_feature: Ceres CLONE 1453867-F

SEQ ID NO: 47100 - DNA, 738 bp, Zea mays
  misc_feature: Ceres CLONE 1453871-F
  misc_feature: Encodes the peptide sequence at SEQ ID NO. 47101
aagctggagctccccgcggtggcggccgctctataactagtggatcccccgggctgcaggaattcgcacgagaccattacctagaacatcctaatcgaaaaaaataaaaacacgccgccaccatctccggcgatgtcgcgcttcgggcgctccgggcagccggagaaccgcgaatctttctccctcctcgtcctcaacgtctccttccgcactacggctgacgacctcttcccgctcttcgatcgctacggcaaggtcttagacatctacatcccgcgcgaccacaggactggggatccgcgagggttcgcgttcgtgaggtacaattacgaggatgaggcgcaggatgccattgacgggcttgatgggatgaggtttgatgggcgtgcgctcatggtgcagtttgccaaatacggacccaatgctgaaaagattcataggggtagaattacagaagaaaatccaaagccaaggggtcgttgcagaagccgcagtccaagacagaggtatcgagaggattattgggatagagactatagaaggcgaagccagagcagaagtagggagcgatatgaacaggccgggtacagagatggtgatcatcgtcgccataggactcacagtattagtcctgattatgacaggaaacgtaacagacacagggcacctcatgaaggaatacctagcaagcccagagatggccgcgctgcatgttctggaagcccttgaccctgagcc

SEQ ID NO: 47101 - protein, 198 aa, Zea mays
  misc_feature: Ceres CLONE 1453871-F
  misc_feature (18)..(89): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSRFGRSGQPENRESFSLLVLNVSFRTTADDLFPLFDRYGKVLDIYIPRDHRTGDPRGFAFVRYNYEDEAQDAIDGLDGMRFDGRALMVQFAKYGPNAEKIHRGRITEENPKPRGRCRSRSPRQRYREDYWDRDYRRRSQSRSRERYEQAGYRDGDHRRHRTHSISPDYDRKRNRHRAPHEGIPSKPRDGRAACSGSP

SEQ ID NO: 47102 - DNA, 559 bp, Zea mays
  misc_feature: Ceres CLONE 1453872-F
  misc_feature (186)..(186): n is a, c, t, g, unknown, or other
  misc_feature (188)..(188): n is a, c, t, g, unknown, or other
  misc_feature (501)..(501): n is a, c, t, g, unknown, or other
  misc_feature (502)..(502): n is a, c, t, g, unknown, or other
tggagctccccgcggtggcggccgctctagaactagtggatcccccgggctgcaggaattcgcacgagaccattacctagaacatcctaatcgaaaaatattccctgcctctcgctagcgccttccctccgcaaacggaaggctctcgtgaccaccgggatgtccgccatggagaccgacatcaangngccgccggccgcccgccccaggtgggggagggatcctcctgcgggccgggccggtcctccctccccgaaaggcccaaaaaaggcctttttgaaaaataaaaaaggggaacccccccccccccctcttggggatggggaaaatatattttttttaaaaaaaatggggtttatttttgcccccaaccacctctcttgggggtttttttatttttcccccgggggggcgcgcgggaaaaaaacccacccccccccccgctccccccccccccccccagaaaaagcacccccttttttttttttttgggggggaaannaaaaaaaaaaaaactttttttttttttcccccccccccgccgccaaaccccgggggg

SEQ ID NO: 47103 - DNA, 758 bp, Zea mays
  misc_feature: Ceres CLONE 1453874-F
  misc_feature: Encodes the peptide sequence at SEQ ID NO. 47104
caaagctggagctccccgcggtggcggccgctctagaactagtggatcccccgggctgcaggaattcgcacgagaccattacctagaacatcctaatcgaaaaaaaagattcccacgggctcgccgctcgcatctcgccagcgcgaacgcagcctccgtgcatatcaccagcctcctcgcgcactcggtcccgcttgcctttccccacctactcgccgtcgcggtgccgtgcgccggtgctgttcagtctagggtttcggccctcgcccgccgatccgtccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgtggctgtgagacaatgttgcctcttgtattccgtgtttcgcggtgttccagttggtttgcttgatccgaagatgtttcagcctctcaaaaaaaaaaaaaaaaacttatcgataccgtcgacctcgagggggggcccggtacccaattcgccctatagtgagtcgtattacgcgcgctcactggccgtcgt

SEQ ID NO: 47104 - protein, 62 aa, Zea mays; identical to SEQ ID NO: 43286
  misc_feature: Ceres CLONE 1453874-F
  misc_feature (1)..(62): Pfam Name: TMA7 Pfam Description: Translation machinery associated TMA7

SEQ ID NO: 47105 - DNA, 731 bp, Zea mays
  misc_feature: Ceres CLONE 1453881-F
  misc_feature: Encodes the peptide sequence at SEQ ID NO. 47106
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaaagcagggcaggggttgcgtctcagttcctggttgtgttgttgtaagctcccaggtttcttctcttcgcgtgagctagctagactagagtgggatcgcgaggaagaaggatgtcgtgctgcggaggaaactgcgggtgcggcagcggatgcaagtgcggcagcgggtgcggagggtgcaagatgtacccggacatggctgagcaggtgaccaccaccaccaccatcatgggtgttgcaccatccaagggcgggttcgaggcggccgccggagctgagaacggcgggtgcaagtgcggcgccgccagctgcacctgcgacccctgcacctgcaagtgaggatgaccgggtgcagcatgcaggccgtgacgatggaggtagtagatcggaacgacacccttcagtatctctagctaaatcaagctctgagagtatgttgtagcaacgtcgtctgtgtttgccgcatgcgtagctagctagctagtgttggtaaacgaatacttgtcctggtcttcttccntctcggcccctgcagtgttgcgtcctgtgggccggccggttgcatgacagcaccaggcatgcccgttgcttgttattgcttcacccataacatcgtaacccgggtgttacgc

SEQ ID NO: 47106 - protein, 75 aa, Zea mays; identical to SEQ ID NO: 45247
  misc_feature: Ceres CLONE 1453881-F
  misc_feature (1)..(74): Pfam Name: Metallothio_2 Pfam Description: Metallothionein

SEQ ID NO: 47107 - DNA, 759 bp, Zea mays
  misc_feature: Ceres CLONE 1453882-F
  misc_feature: SWISSPROT Homolog: EC 5.3.4.1 Protein disulfide-isomerase
aagctggagctccccgcggtggcggccgctctagatctagtggatcccccgggctgcaggaattctctgcaccctgttgcctaaactgtcctaatctggaacccatcttggacgatgtcctcctcctctccacatcgactatgacatcttgattgctaacatggacgcgactgccaatgacgttcccagtgagtttgaagtctgatgctacccgaccttgttcttctggacccccagcgggaaggtgacatcctacgacaacggcaggacggcggaccacatcctctacttcatcaagaagagcaaggagaccgcatccgccgccgccaccacctcccacgtgccaccggcatcctataatgcagccgccgccgaacccgtcaaggacgatctgtgagcatccaaggtgtggacggccgtagctgcgtatgccggaggaaaacctgtctctaacgtgcctccaacgcctactttttgcctgcgaccacatggatagagagagagggacagacttttacagagaggggatctgcgacttgttatgctctgcggcagcatgttgtctatcccattgaggatatgtacacaattacaccgcgaccggtgagtgtctttttagttcattatctcacgtgaccgcacacatgaacacactgtgatgaggttgaatggatgcataaatcactagtcggcccagaaaatatagaaataatgcttatccataccgtcaacttctagggagggtccggtaccctatcc

SEQ ID NO: 47108 - DNA, 754 bp, Zea mays
  misc_feature: Ceres CLONE 1453885-F
  misc_feature: Encodes the peptide sequence at SEQ ID NO. 47109
aagctggagctccccgcggtggcggccgctctagaactagtggatcccccgggctgcaggaattcgcacgagaccattacctagaacatcctaatcgaaaacccgctatcgcgccgcttccgcccgctggccgctgagctctcgcgctaccggctgcgggataaggcaagcttgtcgctcgccttggtggtgcttccagttccagttccagccaccagcgctagcttcctctgcgttgcacgtcggaaatggattcctctagcagaggcatccgcttcctcgtccaccgccgcgcgctgctgctgctgctgctcgtcgcgtcatcgtccctcatcggcacgtcgcgtggcagggaggcgcagccgctgcccgcggcggcggccacggccccggccctcggcagcaggcgaacaccggagcggcacggcctggcgctggacttctacaccaggacgtgccccgctgtcgaccagatcgtcgccaacttcaccgccgcccagtacagggacttccccgccgcctgacccgccgtgctccgcctcttccaccacgactgcttcgtggaagggtgtgacgcgtccattttgatcgcgccgacagccgactcggccgcgaccacacccgcacggccgtcgtcacccagagtggtacgcgacatgcaggataacaggtacctgccacaagacgcgttctacacgtggagctcgccacgctgccgtggagagcagtgccccgggatcagtctctgcgccga

SEQ ID NO: 47109 - protein, 91 aa, Zea mays
  misc_feature: Ceres CLONE 1453885-F
MDSSSRGIRFLVHRRALLLLLLVASSSLIGTSRGREAQPLPAAAATAPALGSRRTPERHGLALDFYTRTCPAVDQIVANFTAAQYRDFPAA

SEQ ID NO: 47110 - DNA, 761 bp, Zea mays
  misc_feature: Ceres CLONE 1453891-F
  misc_feature: Encodes the peptide sequence at SEQ ID NO. 47111
aagctggagctccccgcggtggcggccgctctagaactagtggatcccccgggctgcaggaattcgcacgagaccattacctagaacatcctaatcgaaaaatcgccaggtaatcaactcgtcctcctgtccttcttccccacacccgccgcgcgaaattcggcgcgattcgggcgggattcgttggaattcccctgagaatcggagcgttcttttggacttggtagattggtatatcgatcgattgatcggtggcggaggaaggggaggacggggggcagatggcggcgtgccggggcttcttcgagtgcctgctcaggctgctcaacttcatcctcaccgtcgccggcctcgctatggttggttacgggatctacctgctcgtcgagtggatgaagatatccgaggacggcatcggcggggcttcgacggcggaggtgctcgtctctggccggccgttgttgggggctgtcattctcggtgacagcttcctcgacaatctacccaaagcatggtgagatggtttccttgcctgtggacttttttttctgatgtatcaatactggtttcgtccatgtgatgtcgccattgattatgattttggattgagaggaactgcaaggtttgcttagtaggggtggcaatcacaactgtgaatgtgtgaaatatgcaattgatagccaaaacacgcagttccaaattgcagtctgaaaaaaaaaaaaaaaagcttatcgataccgtcgacctcgagggggggcccg

SEQ ID NO: 47111 - protein, 78 aa, Zea mays
  misc_feature: Ceres CLONE 1453891-F
MAACRGFFECLLRLLNFILTVAGLAMVGYGIYLLVEWMKISEDGIGGASTAEVLVSGRPLLGAVILGDSFLDNLPKAW

SEQ ID NO: 47112 - DNA, 825 bp, Zea mays
  misc_feature: Ceres CLONE 1453897-F
  misc_feature: Encodes the peptide sequence at SEQ ID NO. 47113
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (376)..(376): n is a, c, t, g, unknown, or other
ggagctccccgcggtggcggccgctctagaactagtggatcccccgggctgcaggaattcgcacgagaccattacctagaacatcctaatcgaaaaacctgtacacagttacaaagcttggcacttcgcagttcgcactcgcatgctcttcgcccctcgcgcttaccgctgccgcgcctcccgacttgccgcctccgcctagctccgggctctccaatggcctccatgctcgccatcctcaggccctccgcgccggccccgctcgcggggcgccgggccagggctgccgcgccggcgaccgcgagggtggcgctatctttaagatctaggtatcctccggccagggtgccgttcgggtccgaagttttaannnncncccaaacccgttcttcccctaataaaaccccgcccacccacttcctcttccccgggacaggggggccccaacccggttggaatgggggcccaaaaaccccaaaggggttcccgcgcgcctcccaaattggtcacacccaaaatggaactggcggggaccctctgcccccaggggggccaaaaagaaaaacactggacccaaacaatatgccttcccgcccccggtatatagtcccccccccctccccggcaaaaaaaggtctccacctccccccccttgagggcgccaagaggggcaaccacctccaagaatgtcgcgggggcgcccgcgtggggaaaaaaaccctcctcgttatatggcggggcttttttctgaggaggcgcggacgctctcgcagaagaaaaagaacagtgcgaactgcccaagcccccctgggggggtggggtggt

SEQ ID NO: 47113 - protein, 203 aa, Zea mays
  misc_feature: Ceres CLONE 1453897-F
  misc_feature (52)..(52): Xaa is any aa, unknown, or other
  misc_feature (53)..(53): Xaa is any aa, unknown, or other
  misc_feature (54)..(54): Xaa is any aa, unknown, or other
MASMLAILRPSAPAPLAGRRARAAAPATARVALSLRSRYPPARVPFGSEVLXXXQTRSSPNKTPPTHFLFPGTGGPQPGWNGGPKTPKGFPRASQIGHTQNGTGGDPLPPGGPKRKTLDPNNMPSRPRYIVPPPSPAKKGLHLPPLEGAKRGNHLQECRGGARVGKKTLLVIWRGFFLRRRGRSRRRKRTVRTAQAPLGGWGG

SEQ ID NO: 47114 - DNA, 806 bp, Zea mays
  misc_feature: Ceres CLONE 1453899-F
  misc_feature: Encodes the peptide sequence at SEQ ID NO. 47115
ggagctccccgcggtggcggccgctctataactagtggatcccccgggctgcaggaattcgcacgagaccattacctagaacatcctaatcgaaaaatcggatcgatggagggctgggacaaggggaccaagagcacggtgggcgagatcccgctgctgtcgacgcgcgcgggtccgcgggacggcgaggcgtggcggcagcggctcaaggaggagtaccgcgcgctcatcgcctacacctcggtgaacaaggccaaggacaacgactggttccgcatcgccgccgcccacccggaggggacccgctgggaggggacctgctggtacgtccaccacctccgccgctatgagttccctctccagttaaacacccccgccgcccacccccaggtagcccccgagattaacccccccccctccgacggaaaaacccccaaaaggtccccgggggggaaaatcggccccccccgtgcctttccagcccgttggggggccaaaaccggccccagggttcggcctccggaacccgcttttgcctgggcccccccccccggggtctgggggggagggtcccgatttgcgggcccctcgggcgtgggggaaccccccggattaagaggggggcccccgggtaggggatcgggcctgggggtccccccccaaggaggtccccttctcacacaccttgggtccgctggcactctgggggaaataataaatatctccggcgggggactttccgcccctcgaaagagggagcccgcgcactttttaactcggcgggagatatcgtccccctctggggg

SEQ ID NO: 47115 - protein, 233 aa, Zea mays
  misc_feature: Ceres CLONE 1453899-F
MEGWDKGTKSTVGEIPLLSTRAGPRDGEAWRQRLKEEYRALIAYTSVNKAKDNDWFRIAAAHPEGTRWEGTCWYVHHLRRYEFPLQLNTPAAHPQVAPEINPPPSDGKTPKRSPGGKIGPPRAFPARWGAKTGPRVRPPEPAFAWAPPPGVWGGGSRFAGPSGVGEPPGLRGGPPGRGSGLGVPPQGGPLLTHLGSAGTLGEIINISGGGLSAPRKREPAHFLTRREISSPSG

SEQ ID NO: 47116 - DNA, 740 bp, Zea mays
  misc_feature: Ceres CLONE 1453902-F
  misc_feature: Translation starting site: 321
  misc_feature (180)..(180): n is a, c, t, g, unknown, or other
  misc_feature (189)..(189): n is a, c, t, g, unknown, or other
  misc_feature (239)..(239): n is a, c, t, g, unknown, or other
  misc_feature (347)..(347): n is a, c, t, g, unknown, or other
tggagctccccgcggtggcggccgctctagaactagtggatcccccgggctgcaggaattcgcacgagaccattacctagaacatcctaatcgaaaaacacctcgacgcctctctctctttccccgagctctcgaaaccctaggtgcgtgccgaccggcggcggcggcgaagtgatggcnatggacccnggacgcgtggcgaaagccttcggagcactactaccggacgttcgacaccnacccgcgcgcgctggtggggctgtatcaagagacctccctgctcaccttcgagggccagaagtccagggcccattcggcccatggcgggaaggtcggattccttcccnttcagggctggcaaggacccaaattttcaccttaaatccaacccgtgggggccccgggaaggaaggcctttttttcttcccgggttcttcccccccggccccgaggagaccccccccaattttttccggggttttccttttggcgggcgggggggggcccttttctcgcaaaaaagaagttccccccccaaaatttgggtaaaaaaaccccccaaaccttgggaaagaaaaatttttgggggcggctctttgtgaaaaaaaaaaaaaagggggggcccccccacccccacccccttttccccccccgggggggggggaaattgttataacaaaagagggggggggtgtttttttcctcccttaaaaaaaaaaaaagggtggggggcccgcccc

SEQ ID NO: 47117 - DNA, 797 bp, Zea mays
  misc_feature: Ceres CLONE 1453905-F
  misc_feature (372)..(372): n is a, c, t, g, unknown, or other
  misc_feature (430)..(430): n is a, c, t, g, unknown, or other
ggagctccccgcggtggcggccgctcttgaactagtggatcccccgggctgcaggaattcgcacgagaccattacctagaacatcctaatcgaaaaatctatactggaaaaagttcaggcaaagcaatttgaggcactggcctcagttgaggacaagatactcagaaaaatacgggacaaagaggcggaagtggagaccataaacaaaaggaactctgaactagaggaccagattaagcatttgggagtggaagttggtgcttggcagcatagggctaagtacaatgaaagcatgatcaatgcactcaagtacaacttggaacaggtttgtgctcaccagagcaaggatttcaaggaagggtgctgtgttancaaggtagatgacactgtcttcctgtttgattgccccccctgtcaccccccaactaantcccaaggaaaacagacaaccgaaggatttcacggcttgcaagggcctgcaaatcaggtgagggaatccacgcctcttggctcgccctgaccaccccccttccccaagccccgctgtgcccagagccaaccgaggcctcctgccccctggtgggcgcccctctaaggagactttggctcgcacaactctctaccggggaacaatagcatttctctctttagcaactttgtctcccgccagcacaaaacagccatcggggggtacaaatctcggcctctgggccaaggctttgaaacaacggcggcggcctccctcacgtattctctagccaccgtgggttccaagctaacacggcctgggtagtggt

SEQ ID NO: 47118 - DNA, 742 bp, Zea mays
  misc_feature: Ceres CLONE 1453907-F
  misc_feature: Encodes the peptide sequence at SEQ ID NO. 47119
  misc_feature (639)..(639): n is a, c, t, g, unknown, or other
  misc_feature (742)..(742): n is a, c, t, g, unknown, or other
gctctacaactagtggatcccccgggctgcaggaattctcacgagaccattacctcctacatcctaatctaaaaaaaacatggagcgctacatccgggccagcagtttccatttgcaatccgaccccatcttcatcccgttgtgtcaccagcacgcgtccatgcaccgatggacggtggaaagaagagccggaacccggacaagggctccgcggactaccgcagcgaccgcaagtcagcctccgggatgagcggcgaccccaagaagggcggccgcggcggcaagttcacctgggagggcgccgacaactacggctacggctacgccgacgaggacctggggctgatctccaaaaaaggcaacatcgacaggggacgtggtagccagtcccacccagggccccgcccctaataaggacgaccacgagtaggcctcgccgccaccgctcgcccgtccggtaccgtctatcgtcaggaagaaccaacaggcccttcgggctgtctaattccagtgtcgggcccatatctcaagggtgaataatctggacgagggggtttgacgtgctgggccaccatgggggtgctggaccctcctggtgcacggaggatccccccgcgtccattgtgccgttggagggtnaggggattggacagtcaaataccacctcccatagggtcaaccacgccacccttgcacgtgtcgcgcaaccctccctcgaccggagtcccacgaaaaaacaaan

SEQ ID NO: 47119 - protein, 80 aa, Zea mays
  misc_feature: Ceres CLONE 1453907-F
MDGGKKSRNPDKGSADYRSDRKSASGMSGDPKKGGRGGKFTWEGADNYGYGYADEDLGLISKKGNIDRGRGSQSHPGPRP

SEQ ID NO: 47120 - DNA, 741 bp, Zea mays
  misc_feature: Ceres CLONE 1453920-F
  misc_feature: Encodes the peptide sequence at SEQ ID NO. 47121
aagctggagctccccgcggtggcggccgctctagaactagtggatcccccgggctgcaggaattcgcacgagaccattacctagaacatcctaatcgaaaaaacgcgcacctccctttccccaactcgatctcgcacctagggtttcgtctcgtcgctctcgtcctccgcgaagatgccgaagaacatgggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggcctggatcgcggctggggacatcttcctcgcccccctccgcgactaccaggacgacaaggccgacgttatcctcaagtacctgaacgacgaggcgcgcctgctcaaggcctacggggagcttcctgacacgctcaggttcaacgagggcgtcaacttccatgggccccaagaaggccaggaaggcatcaactacctccagttcgaggaccaggacttctccaagatctaagaaatctgtctctgcttccggctacctgaattgttacctgcacggttccttccgattctgctggcggctccctttatcgaagcggggccggcactgctctcgctgtgggaaagccaacccccgcctttattt

SEQ ID NO: 47121 - protein, 144 aa, Zea mays
  misc_feature: Ceres CLONE 1453920-F
  misc_feature (30)..(94): Pfam Name: eIF-1a Pfam Description: Translation initiation factor 1A / IF-1
MPKNMGKGGKNRKRGKNEADDDKRELVFKEDGQEYAQVTRMLGNGRCEAICVDGTRRLCHIRGKMHKKAWIAAGDIFLAPLRDYQDDKADVILKYLNDEARLLKAYGELPDTLRFNEGVNFHGPQEGQEGINYLQFEDQDFSKI

SEQ ID NO: 47122 - DNA, 828 bp, Zea mays
  misc_feature: Ceres CLONE 1453926-F
  misc_feature: Encodes the peptide sequence at SEQ ID NO. 47123
  misc_feature (370)..(370): n is a, c, t, g, unknown, or other
  misc_feature (409)..(409): n is a, c, t, g, unknown, or other
tggagctccccgcggtggcggccgctctttcctagtggatcccccgggctgcaggatttcgcacgagaccattacctacaacatcctaatcgaaaaactcctctccctccctcactcactaagccaaagctgacggcagcatacaagcaccagcagagctcttgccgatggcggtggccaagcccccgcttcagacgggcgcggtcctcctcctcctcctcctggtcgtcgcggccgcgtcgtggctccagaccgtcgacgccgcttcagggttctgctcgagcaagtgcatcgtccggtgcggtcgggcggcgagcgcgcgggcgcggggcgcgtgcatgaggtcctgcggcctctgctgagaggaaangaaatgattggccaagcggccgtgttgggatgtccacancaccccctgcaaccgcaaaaggcccccccccggccccaggaaaaagcccaattgcccccggaggccggttaaaccggggggaaaccccaaaacccgggtccctgggatcggcaatggttttgctgtgaagtgggtatcctatcctgtgggggggccggggaccccgggtttggctcccccgccccccacacatcaaatatttgggtccagccctctctctttaatggcacacgcgccccgggggccccaaaaaaaaataaactgccccccccgcgccccccaaacacactgttcacgttttatcacgcgcactacaaaacagagagacccactcccccctcattccacacaaaacaagggtggccactccacacaaaagtaggacggcagcgtgagacgtccacacctccacaacaaga

SEQ ID NO: 47123 - protein, 64 aa, Zea mays
  misc_feature: Ceres CLONE 1453926-F
MAVAKPPLQTGAVLLLLLLVVAAASWLQTVDAASGFCSSKCIVRCGRAASARARGACMRSCGLC

SEQ ID NO: 47124 - DNA, 718 bp, Zea mays
  misc_feature: Ceres CLONE 1453930-F
  misc_feature: Encodes the peptide sequence at SEQ ID NO. 47125
caaagctggagctccccgcggtggcggccgctctagaactagtggatcccccgggctgcaggaattctcacgagacctttacctacaacatcctgatcgaaaatgaacgcgggtcgcggcatcgggatatcggtcgtcgacaaggggggccggagcactctctgcttctccccgtacttcccctacgtaccaggaagctaccactcccccagagtgaaggaagagagagctctccgcctctctcctccgccttagagcgacgtcgctgccggagctcgatacctatgggtggcttcgggacctcgcgccctgcctccgtcgccctctgcgccttcctcaccttcctcaacctcttcgccgtccttctcgccgtcggcgccgagcgccgccgcaccaccgggaaggtgatgccggacgagtacgacgagcagtcctactgcctctacgacactgacgcctccacggtgtacggggtctccgcttttcttcgggctccgggctccagcaggccatttggcacggtcgccccggggggcctctgtttcggaccccggctccctctccgggggtggggcgcaaacggaaattcccccctcccggggaaaaaaattccccccgccccaaaaaagttttgtcctccaaaaagagaaatccgggggaaggaaaatggtacaacccccccccgcggtttttttttggggggtactccccctggaaa

SEQ ID NO: 47125 - protein, 144 aa, Zea mays
  misc_feature: Ceres CLONE 1453930-F
MGGFGTSRPASVALCAFLTFLNLFAVLLAVGAERRRTTGKVMPDEYDEQSYCLYDTDASTVYGVSAFLRAPGSSRPFGTVAPGGLCFGPRLPLRGWGANGNSPLPGKKIPPAPKKFCPPKREIRGKENGTTPPRGFFLGGTPPG

SEQ ID NO: 47126 - DNA, 589 bp, Zea mays
  misc_feature: Ceres CLONE 1453933-F
  misc_feature (189)..(189): n is a, c, t, g, unknown, or other
  misc_feature (463)..(463): n is a, c, t, g, unknown, or other
ggagctccccgcggtggcggccgctctagaactagtggatcccccgggctgcaggaattcgcacgagaccattacctagaacatcctaatcgaaaaaagaacaaaccattggttggacgcgttcccctcctgcacgcaacctcatctcgtcctccagatccaggatggccgtcctccttgagaccttgncctccccgagtgctctcggtggaacttacttttgtttccaattttatccaggaaatcccttttgcttccttgtttggggagggctcaattctgaattggctgggaatccgcgaaaccccgccttggaacccccggaccggtaaaaccccttccccccaaagggccccggggggtttttgtttttggggggggaaaaaaaccctccaatttttttctttctttgggccccaaatttgggaaaaaccccgaaattctcccctcttttttttttttnggggattttttttgggccaaaaaattatgggggggggggggggaattctttttggggggcacccgcccccccccccccaagaaaaaagaccccccccccaaaaaaatttttgtgcgccctctttca

SEQ ID NO: 47127 - DNA, 752 bp, Zea mays
  misc_feature: Ceres CLONE 1453936-F
  misc_feature: Encodes the peptide sequence at SEQ ID NO. 47128
tggagctccccgcggtggcggccgctctagaactagtggatcccccgggctgcaggaattcgcacgagaccattacctagaacatcctaatcgaaaaagaaagcagagagagccggcaacatcgcagagagagagagagagagagagaggcaaactggagaggccgagggtgatggtttccaaggagcagaataagcgaggagctttgcatgagaagctcaagattctccgcagcgttactcactctcatgcgggtgataaagtgtcgataatagcggacgcgtcatcgtacatcaaggaactaaagcagaagatcgcgaagctaagccaagagatggcatcgtcgtctccgcagcacgccactagtgtctgccaacaacaaccgtcgtcgtcgtcggtgagtgtgggacccctgctggacaagaagggccgtttcctcgtcagtgtgttcatggacgagagctgcggcccgccgccggccgggctactcgcttccgtcctcgaggccttcgacgagatcggactcacggtgcttgaggctagggctacctgcgctggttcctttcggctagaagctgtaggagaggaagtagtagtagatgggggcctcatcgtcgacgcgcacgcggtggagcaagcagtagttcaggcaatcaagaattgccctggcaatcattaaactaatcgacctagtcctccaattcgatcgatcgagttgacgatgcgctgctggtggagccacaaagtcatgc

SEQ ID NO: 47128 - protein, 168 aa, Zea mays
  misc_feature: Ceres CLONE 1453936-F
MVSKEQNKRGALHEKLKILRSVTHSHAGDKVSIIADASSYIKELKQKIAKLSQEMASSSPQHATSVCQQQPSSSSVSVGPLLDKKGRFLVSVFMDESCGPPPAGLLASVLEAFDEIGLTVLEARATCAGSFRLEAVGEEVVVDGGLIVDAHAVEQAVVQAIKNCPGNH

SEQ ID NO: 47129 - DNA, 786 bp, Zea mays
  misc_feature: Ceres CLONE 1453939-F
  misc_feature: Translation starting site: 170
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (415)..(415): n is a, c, t, g, unknown, or other
  misc_feature (416)..(416): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (434)..(434): n is a, c, t, g, unknown, or other
  misc_feature (450)..(450): n is a, c, t, g, unknown, or other
  misc_feature (458)..(458): n is a, c, t, g, unknown, or other
  misc_feature (466)..(466): n is a, c, t, g, unknown, or other
  misc_feature (495)..(495): n is a, c, t, g, unknown, or other
  misc_feature (497)..(497): n is a, c, t, g, unknown, or other
  misc_feature (503)..(503): n is a, c, t, g, unknown, or other
  misc_feature (505)..(505): n is a, c, t, g, unknown, or other
  misc_feature (506)..(506): n is a, c, t, g, unknown, or other
  misc_feature (511)..(511): n is a, c, t, g, unknown, or other
  misc_feature (514)..(514): n is a, c, t, g, unknown, or other
  misc_feature (515)..(515): n is a, c, t, g, unknown, or other
  misc_feature (535)..(535): n is a, c, t, g, unknown, or other
  misc_feature (537)..(537): n is a, c, t, g, unknown, or other
  misc_feature (544)..(544): n is a, c, t, g, unknown, or other
  misc_feature (554)..(554): n is a, c, t, g, unknown, or other
  misc_feature (569)..(569): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (594)..(594): n is a, c, t, g, unknown, or other
  misc_feature (596)..(596): n is a, c, t, g, unknown, or other
  misc_feature (621)..(621): n is a, c, t, g, unknown, or other
  misc_feature (655)..(655): n is a, c, t, g, unknown, or other
  misc_feature (673)..(673): n is a, c, t, g, unknown, or other
  misc_feature (679)..(679): n is a, c, t, g, unknown, or other
  misc_feature (780)..(780): n is a, c, t, g, unknown, or other
aaagctggagctccccgcggtggcggccgctctagaactagtggatcccccgggctgcaggaattcgcacgagaccattacctacaacatcctaatctaaaaactgcgactgtgagcttcgttcgttcagttcatccgtgttcttgtttgccaggtccacagagagaggatgtcgtgctgcggaggcaactgtgggtgcggctccggctgcaagtgcggcaacggctgcggagggtgcagcaagacgtacccggacatggctgaacaggtgaccaccaccacccaggctctcatcatgggtgtcgcaccatccaaggggcacgcccagggcgggttcgaggcggccgccggagctgagatcggtgggtgtttgttgtgnnnngtattgggagtgggacccctggtgtgtgggcgnnccccttcccccnnnnttnaacttggatgggcggncgcaggangctggccnaccccccccccccacacaaagacaagcgncncccccngnnggcgnttnngagggaggcccgccccaaantngaccgcnccaggaaggnaaagcccccgactcncgaaaagnnnnnggacacctcgacngngaccaccacactccgagcacactancctccgccccacaggcaccctcccgccgcgcaanccgacgcgctcgcgcgtncttcgnggcgtggcgcacccccgcactcggcgcccgccgcctcgtgccacggatgagcgcggcgtccccgccctccgcggtctagcgaccctcgtcgcgcctgcccnccacgg

SEQ ID NO: 47130 - DNA, 756 bp, Zea mays
  misc_feature: Ceres CLONE 1453940-F
  misc_feature: Encodes the peptide sequence at SEQ ID NO. 47131
  misc_feature (414)..(414): n is a, c, t, g, unknown, or other
  misc_feature (611)..(611): n is a, c, t, g, unknown, or other
aagctggagctccccgcggtggcggccgctctagaactagtggatcccccgggctgcaggaattcgcacgagaccattacctagaacatcctaatcgaaaaacactcaccagtcaccaccacggaaccctaaccaagaatccgactcggcgctagacgaatcggacggaaggaagacgagaaggccctgaggcgagcgggggatcaaagaagaagatgaaggtccgtgcggcggtgaagcgcctgtgccggttctgcaaggtggtgaagcgccggggaatcgtcttcgtccaatgcacggccaacgccaagcacaagcagcgccagggtttctccaccatcgccgaagcagccgccgtctcgtgcgttcacctgcctccgccgccgcccgctagcggttccgcctccgccgcancgctcgcagaggcttcgaaggtggcgagacaagagatgtctatgaagttcaattggcggctgggtttagctgccctgttcaagaatggagaaaaataatgtatcaggcctactaccatacgctaacatttttaagcagatgttgaatagggccagttggtatgatgatatcaagagaagtatgtagcaaaaactggnaactgcaccatcatgtatttgcagtggaataatatgagcagatattgttactttctcttaaatgttcgattcttgattgtttaaatgtaatagcacttgcacgaaaaaaaaaaaaaaaaacttatcgataccgtcgacctcgagg

SEQ ID NO: 47131 - protein, 98 aa, Zea mays
  misc_feature: Ceres CLONE 1453940-F
  misc_feature (1)..(38): Pfam Name: Ribosomal_L36 Pfam Description: Ribosomal protein L36
  misc_feature (67)..(67): Xaa is any aa, unknown, or other
MKVRAAVKRLCRFCKVVKRRGIVFVQCTANAKHKQRQGFSTIAEAAAVSCVHLPPPPPASGSASAAXLAEASKVARQEMSMKFNWRLGLAALFKNGEK

SEQ ID NO: 47132 - DNA, 762 bp, Zea mays
  misc_feature: Ceres CLONE 1453941-F
  misc_feature: Encodes the peptide sequence at SEQ ID NO. 47133
ctggagctccccgcggtggcggccgctctagaactagtggatcccccgggctgcaggaattcgcacgagaccattacctagaacatcctaatcgaagagaggtcatcgaagaatctcttcaagcaactgtcctcttcaaagcttccaggttgtgttacagcccggatgctgtggtgtatgacggcacctttgaggatgttctgcctgtgaagaaagaggatgtacatctgagaggtttggagagtaaatgtttgtcagttgaagaagtgttgatccagcacgaggattttccagatgctggtaaattgatgatgactgcagtgattatgggcaaggcaccaatttttacagccacagaacccgtggagatggacccatgaatacccgttttagatttctatatgatagactgccaccatatcgcagtcatttcattgtaattcatccatcgggtagtttcatcatcgtaaaaatcttgtcttagcgacacggggtctgtagttttggttgtttctgttctgcgcagtcacagaaacttgattccgtagcacaagaatcagttcacgccggcttttagcatgagctatatcttctaatggttagtttggaaattaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttaccaactta

SEQ ID NO: 47133 - protein, 125 aa, Zea mays
  misc_feature: Ceres CLONE 1453941-F
GAPRGGGRSRTSGSPGLQEFARDHYLEHPNRREVIEESLQATVLFKASRLCYSPDAVVYDGTFEDVLPVKKEDVHLRGLESKCLSVEEVLIQHEDFPDAGKLMMTAVIMGKAPIFTATEPVEMDP

SEQ ID NO: 47134 - DNA, 768 bp, Zea mays
  misc_feature: Ceres CLONE 1453943-F
  misc_feature: Encodes the peptide sequence at SEQ ID NO. 47135
  misc_feature (389)..(389): n is a, c, t, g, unknown, or other
  misc_feature (390)..(390): n is a, c, t, g, unknown, or other
  misc_feature (394)..(394): n is a, c, t, g, unknown, or other
  misc_feature (401)..(401): n is a, c, t, g, unknown, or other
ctccccgcggtggcggccgctctataactagtggatcccccgggctgcaggaattcgcacgagaccattacctagaacatcctaatcgaaaatcaatctacaaagctcaagcatctgctcttgaagctcatgcagcccccaactgcaaggttttggttgttgccaacccagcaaacaccaatgctctcatcctgaaggagtttgctccatctatccctgagaagaacatcagttgtttgacccgcctagaccacaacagggcactcggtcagatttctgagagacttggtgtccaagtttctgacgtgaagaatgctattatctgggggaatcactcgttcagtcagtttttttgatggtaagaattccacagaggagagttccactcnnaaanaatcctnttcccccaccttgtttcaagatgaaagaacgcctaaccggggagctcattgcgcctggccccacagtgtgggtctggaatcatcaagagcaagaaacctctcccagtgctccctccggctagcaacatagctctcgaacctactagtagaaggaggtcccgcgaaccgccctaaggcacactttgttctcccaccgctctgtcaccctgattgtttaactcctgagagcttggcgggtatcaatctatcctccacacccccaccgacccacacgtctcaataccaaaagcctgggccctggcgtcaccccctctcttcggtccttccagaggataatatagggtctgctgcctcccaaaacactctt

SEQ ID NO: 47135 - protein, 117 aa, Zea mays
  misc_feature: Ceres CLONE 1453943-F
  misc_feature: SWISSPROT Homolog: EC 1.1.1.37 Malate dehydrogenase
PRGGGRSITSGSPGLQEFARDHYLEHPNRKSIYKAQASALEAHAAPNCKVLVVANPANTNALILKEFAPSIPEKNISCLTRLDHNRALGQISERLGVQVSDVKNAIIWGNHSFSQFF

SEQ ID NO: 47136 - DNA, 760 bp, Zea mays
  misc_feature: Ceres CLONE 1453944-F
  misc_feature: Encodes the peptide sequence at SEQ ID NO. 47137
  misc_feature (740)..(740): n is a, c, t, g, unknown, or other
aaagctggagctccccgcggtggcggccgctctagaactagtggatcccccgggctgcaggaattcgcacgagaccattacctagaacatcctaatcgaaaaacgacaggctgcactgagggtcagttcagtagtgtagttagttgtaggttgcgatggcgaggcggctgctggcggcgctcgccatagccgtcgtggccgccgcgctcgcgggcggcgcgggcgcgcagctctcggcggggttctactcgtcgagctgccccgccgtacacagcatcgtgcgccaggccatgtcgcaggccgtcacgaacaacacgcgcagcgccgccgccgtgctccgcgtcttcttccacgactgcttcgtcaatggctgcgacgcctcgctgctgctggacgacacgcccacgacgcccggcgagaagggcgccggccccaacgccggcggctccaccgtcggcttcgacctcatcgacaccatcaaggcgcaggtcgaggccgcctgccccgccaccgtctcctgcgccgacatcctggcgctcaccgcgcgcgacggcgtcaacctgctcggcggcccgagctgggcagtgccgctgggccggcgcgacgcgacgttccccaacagcacgggcgcggcgacggacctcccgggcccggactccgacctggccggcctggtggccgggttcgccgccaagggcctgagcccgcgcgacctcgcggcgctgtcgggcgcgcacacngtggggatggcgcgctgcgc

SEQ ID NO: 47137 - protein, 201 aa, Zea mays
  misc_feature: Ceres CLONE 1453944-F
  misc_feature (42)..(200): Pfam Name: peroxidase Pfam Description: Peroxidase
  misc_feature: SWISSPROT Homolog: EC 1.11.1.7 Peroxidase
MARRLLAALAIAVVAAALAGGAGAQLSAGFYSSSCPAVHSIVRQAMSQAVTNNTRSAAAVLRVFFHDCFVNGCDASLLLDDTPTTPGEKGAGPNAGGSTVGFDLIDTIKAQVEAACPATVSCADILALTARDGVNLLGGPSWAVPLGRRDATFPNSTGAATDLPGPDSDLAGLVAGFAAKGLSPRDLAALSGAHTVGMARC

SEQ ID NO: 47138 - DNA, 771 bp, Zea mays
  misc_feature: Ceres CLONE 1453945-F
  misc_feature: Encodes the peptide sequence at SEQ ID NO. 47139
  misc_feature (682)..(682): n is a, c, t, g, unknown, or other
  misc_feature (740)..(740): n is a, c, t, g, unknown, or other
  misc_feature (741)..(741): n is a, c, t, g, unknown, or other
aaagctggagctccccgcggtggcggccgctctagaactagtggatcccccgggctgcaggaattcgcacgagaccattacctagaacatcctaatcgaaaatgaaggatgttataaatctcatatttgagaaggcagtttttgagcccactttctgtcctatgtatgctcaactttgttccgatctcaatgaaaagctcccgacattccctcctgaagagccaggtggcaaagagatcacattcaagcgtgtactattgaacaattgtcaggaagcctttgaaggtgctagcagcttaagagctgatattgctaaattaactggccctgaccaagagatggagagaagggacaaagaacggttggtcaaacttagaacacttggaaatattcggctaattggtgagctactcaagcaaagaatggttcctgagaagatagttcatcacattgttatggagctattggggtctgggccagataaaaaaacatgccctgaagaggaagatgttgaggccatctgtcatttcttcaatacgattggtaaacagcttgatgaaaacccaaagtctcggcggatcaatgatacctactttatccagatgaaggagctaacaatgaatccccttcatttcacttgctcccaaacaagccctagatgtccaaggaacgcagtaccaangatgcgaggaaacagcagttttgggctgtataattttgcgagatcagatgagtgtaannttattagtattattattggtttggaccaga

SEQ ID NO: 47139 - protein, 223 aa, Zea mays
  misc_feature: Ceres CLONE 1453945-F
  misc_feature (1)..(196): Pfam Name: MIF4G Pfam Description: MIF4G domain
  misc_feature (194)..(194): Xaa is any aa, unknown, or other
  misc_feature (213)..(213): Xaa is any aa, unknown, or other
  misc_feature (214)..(214): Xaa is any aa, unknown, or other
MKDVINLIFEKAVFEPTFCPMYAQLCSDLNEKLPTFPPEEPGGKEITFKRVLLNNCQEAFEGASSLRADIAKLTGPDQEMERRDKERLVKLRTLGNIRLIGELLKQRMVPEKIVHHIVMELLGSGPDKKTCPEEEDVEAICHFFNTIGKQLDENPKSRRINDTYFIQMKELTMNPLHFTCSQTSPRCPRNAVPXMRGNSSFGLYNFARSDECXXISIIIGLDQ

SEQ ID NO: 47140 - DNA, 788 bp, Zea mays
  misc_feature: Ceres CLONE 1453946-F
  misc_feature: Translation starting site: 317
  misc_feature: Pfam Name: SRP9 Pfam Description: Signal recognition particle 9 kDa protein (SRP9)
aaagctggagctccccgcggtggcggccgctctagaactagtggatcccccgggctgcaggaattcgcacgagaccattaactagaacatcctaatcgaaaaaaaaatcacacttcgatagcaaaaaaccaatgttgaaccgtttataataataaaactccaattatagtgttcgagacactattttttagttccaaaaagctcgtcgggaagaggagcaaaacaaaccctatctaaaccgcggcggactcttcgtccagcaaggtttcccatccagatccggccacgccacttgctcctcttctccgccacaccgatggtgtacgtggattcctgggacgagttcgtggagcggtccgtgcagctcttccgcggcgaccccaacgccacccgctacgtgatgaagtaccggcactgccaagggaaagctcgcgctcaaagtcaccgacgaccgcgagtgcttgaagttcaagacagatcaagctcaagacgcaaagaagatgaaaaaccccaccaccatcttttttgccttcctgacccgtggggctcgaggttaatataggtgaattttcggggaagggaccgggctaaacaccccccaagccaaaaaaggccggggaagggaggaaatatggcggccggaccccattttgttaaagaaaatcccacccggggaagggggggttaaaattctcgtgggcttttttggcccccaaaaaaaaatttttcccggacagaccccaaaaaaaaaaaagggcccccctccaggaagagggggggggggagat

SEQ ID NO: 47141 - DNA, 931 bp, Zea mays
  misc_feature: Ceres CLONE 1453950-F
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (521)..(521): n is a, c, t, g, unknown, or other
  misc_feature (531)..(531): n is a, c, t, g, unknown, or other
  misc_feature (893)..(893): n is a, c, t, g, unknown, or other
gtttgggttctacaaactcccggtgcnnnncnacnnnnttcatactggagctccccgcggtggcgggccgctctatactagtggatcccccgggctgcagggattcgcacgagaccattacctagaacatcctaatcgaaaacggcgctggcgcctcccgcgccgcctccggcgctgcccgccgtcgcctccgacggaggcgtggcgacggcgcgcctcgacggcaaggacgtgcgcgtggaccctggcctcttctgcgacaagaagttcctcaagactgaagcgcccgggggccccagaacgcgcaccagagggatcggagtgtcggttggaacccccacttctaggggactcccccggacgcccggaccaattccgagactgccagaccccactgtgtttggtagtagcccccacacgtttcggagccagtggcgcggcccgtggagtaattttgttcccccctcgctctgcgcaccccctagtgtattgtactcgcacaaacccggccccaacaaaanaaaaaaaaanagtaaggttttgtggcgcgcgctctgggtggtgcggcgcctctagaatgtggtgcggaacggtgggtggcgccacatcactgcttcccgtacctgctattgtgagggagggtcgacaagccaccctgtctcccactcccgcgcgttagtttatagggcataacgtcaaaagtgtgtacagcccctgctgttggtgcctctgcgtccccactatacctctcagcgtgtgggctcccgctcgcggctctcgcccccatggtcggttgaagtcgattgctgtgccttaaacgcgctcgcctgttattgcatggccctcttggtgtgtgtcgccccctccattacctgcgcagcgcgctcacactncagcgttgtcgtgtatgtgatacactcatcaccatgtg

SEQ ID NO: 47142 - DNA, 756 bp, Zea mays
  misc_feature: Ceres CLONE 1453952-F
  misc_feature: Encodes the peptide sequence at SEQ ID NO. 47143
atagctggagctccccgcggtggcggccgctctagaactagtggatcccccgggctgcaggaattcgcacgagaccattacctagaacatcctaatcgaaaaagattcgcctcgcctcctcgacgcccctccctcacccttgatgccacgcccccctcccatggcgccacgcccgcgcccctccccacccgcccgagccgcgacgctgaccctcctcctcccgctcctcctcctcgcctctccgtccctcccctccgccgccgctgccccctcgccgccgacggtgcccggcacgcagcggcaggccgcgtccgcgtccgacgccccgtcccctcctccccctccggcgcagcagcacccgcggaggcaccgccaccggcactggaagcaccggccgccgcccccgcacccgccgccgccgcccaggcggcgtcggctcaacttcggggagcggctcgggatcgccttcgccggcgtggctatcgcaatgcaggtcatcctcggcgccttcctcgcgctgcgcgcgtggcagctgcggcggctcgacaaggccgaggtgtcctcctccacggccctcacctgaccaccgtctccccagccgaagctcgtcgtgtgcatcagtcaggtccgtggtttaatttgtgaactgaaccgacgctgctgataacaaaccatggtgaagtaagctgccctggccagtgttcggaaccatctttccggttctgtgaactaccctgaaaaatcagctactgcccc

SEQ ID NO: 47143 - protein, 140 aa, Zea mays
  misc_feature: Ceres CLONE 1453952-F
MAPRPRPSPPARAATLTLLLPLLLLASPSLPSAAAAPSPPTVPGTQRQAASASDAPSPPPPPAQQHPRRHRHRHWKHRPPPPHPPPPPRRRRLNFGERLGIAFAGVAIAMQVILGAFLALRAWQLRRLDKAEVSSSTALT

SEQ ID NO: 47144 - DNA, 849 bp, Zea mays
  misc_feature: Ceres CLONE 1453953-F
ggcggccgctctagaactagtggatcccccgggctgcaggaattcgcacgagaccattacctagaacatcctaatcgaaaaaaagctcaccgtggatcttttcctttgttccctttttcttttcagccgccacaccgcagctccggaaccgctggtgcccggcccattttaccaccgatccatggcggaggattcggtggcggcggtcacgtggggcgggggggaccacctcagcctgggcggccctcacctccaccgcttctttggcgtcctggcggggggagaagagcctggtgcatactttccgcgcctaactcccaccctgaaattggattgatctattgattggagaggcgaataacgggggggggacgctttctcttctttcgcggattccctttgtgtccccccccctcgccttagttagtatgggcgtccgtgcgcgccagcccccttcgcacatcacccaccccaaaaaaaatatgaataagatccacgacgggaacagaataaccaatcacggaagtaccgacccctacccgaagtcacactgactgggaagactcgtgcatctctgctcatcttcctgaacgccagatctcgcatagcactgggtcttgtgcagcctcgatgtaagcccgcgtaagtaatccactgttcgggcgcgccctcttgtaagcaccatacgcccgacattacactgttgttatgaatctcgtcggcgaggggctgtgcatgcgtgtataaggataaggtcactacctatcgtcaatacagttacaatcttacaactctcaaacctccctcctttcacgacaccctccctccgccacttccgtctgcgcccgt

SEQ ID NO: 47145 - DNA, 755 bp, Zea mays
  misc_feature: Ceres CLONE 1453954-F
  misc_feature: Encodes the peptide sequence at SEQ ID NO. 47146
  misc_feature (657)..(657): n is a, c, t, g, unknown, or other
atagctggagctccccgcggtggcggccgctctagaactagtggatcccccgggctgcaggaattcgcacgagaccattacctagaacatcctaatcgaaaaaccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtggtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcatgcggtgggcggcgggcagtgcccggccctggggtgcgcggcggacctcaacgccgggtgcccgccctcgcagcgcgtgccgggggccgggggcggcgtggtggcntgcaagggccccgcgggctacttcaaggagcggtgcccgctgacgcgcaccacgcccaccgacgtgaagcccgtgccgcagcggtgcttggcgccggg

SEQ ID NO: 47146 - protein, 203 aa, Zea mays
  misc_feature: Ceres CLONE 1453954-F
  misc_feature (34)..(203): Pfam Name: Thaumatin Pfam Description: Thaumatin family
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPHAVGGGQCPALGCAADLNAGCPPSQRVPGAGGGVVACKGPAGYFKERCPLTRTTPTDVKPVPQRCLAP

SEQ ID NO: 47147 - DNA, 772 bp, Zea mays
  misc_feature: Ceres CLONE 1453960-F
aagctggagctccccgcggtggcggccgctctataactagtggatcccccgggctgcaggaattcgcacgagaccattacctagaacatcctaatcgaaaaaatcaggtcaatttgcttactcttgtctcgtgcctgctgttttgatctgctcttgggaaacgagtacatggcattagaaaattaaagctgcagctagctgcactatatacgtgctcgagggaatcaaaagttgagcctctcccatctcaatcaaatctacaggggagtagctcttgctcttggcttcgctggctaacaatccgtgaactgaacaccttccgcctcccggcctcctccctgcccagtgctgaagaaccctgccggggtatttggcacctgaatttctgagcagcaatgcaatcacattcaaccccccacttatacagtctaggtgttataatcactgagattctgacggggcataaggaatgcaccagtgttgacaaggtgctttgaagctggacggacatgtttcagacattaggaagccatccgctactagaacaagtagaagtatgcgctgagatagcgataaattgcatgaacgatgacccgagcaacaagccctccctacaggatattacctccagtatcatgaaaacgacgatcgaagtgttacaagttcttcaccaggagggcaagtttataccatgggccggcagccaaagcagcaacagttggaagcgggtcccctggcccttctggaagctgcttcccccatagggcacata

SEQ ID NO: 47148 - DNA, 835 bp, Zea mays
  misc_feature: Ceres CLONE 1453961-F
  misc_feature: Encodes the peptide sequence at SEQ ID NO. 47149
  misc_feature (14)..(14): n is a, c, t, g, unknown, or other
  misc_feature (20)..(20): n is a, c, t, g, unknown, or other
  misc_feature (25)..(25): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
gggcctctgccacnccaacnccccntccnggggtnnnnntcaaagctggagctccccgcggtggcggccgctcttttactagtggatcccccgggctgcaggaattcgcacgagaccattacctaaaacatcctaatcgaaaaactagggtttgccagcctttgcagcgtcgcgctcgcgtctcatgcccttgcccatcgacggtagacgagagcgagcggtctgtgttcgtggagcaggggccggcgccatggagatcaacatcgtggacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggtgctttgagaaatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcagagaatttccctgtatcatttatgctaaggagttgcacacttccctagccaatggggtccttcacccggaatttaaagccacaaaaacctgcttggtggcacaaggaagaaggggtttactggagaatttgctggatcttgggaactcggttaggcgcttttcccggggccccctaaaaaaagcttccaccccacggaaatatgctgccccttttggggtcaacaacccc

SEQ ID NO: 47149 - protein, 54 aa, Zea mays
  misc_feature: Ceres CLONE 1453961-F
  misc_feature: SWISSPROT Homolog: EC 2.7.11.22 Cyclin-dependent kinase
MEINIVDKYEKLEKVGEGTYGKVYKAQDKATGQLVALKKTRLEMDEEGIPPTVL

SEQ ID NO: 47150 - DNA, 731 bp, Zea mays
  misc_feature: Ceres CLONE 1453964-F
  misc_feature: Encodes the peptide sequence at SEQ ID NO. 47151
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (497)..(497): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
aaagctggagctccccgcggtggcggccgctctagaactagtggatcccccgggctgcaggaattcgcacgagaccattacctagaacatcctaatcgaaaaaaccgagaaggaagaactagtcgcgaggtgaagaggagaacctgaggtggtcccgaatcagagacggaagaaggtgggttcaggagcaagccagcctgccgccgccatgaggcgcacctcgaagaaatcgtcgtcgtctacggcgaccgccagcgctggccctactaaagcagtttccaaggaagtagaacggattgatcaatttttctatacttacgctgataactcatctggcatgattgacccagaaggcattgaaacactctgttctcaccttgaagttccccacactgatgttaggattctaatgttagcatggaaaatgggctgtgattagcaaggttattttaccttggatgaatggaaaaccgccccccaaccctttttnnnnnngntgggnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 47151 - protein, 76 aa, Zea mays
  misc_feature: Ceres CLONE 1453964-F
MRRTSKKSSSSTATASAGPTKAVSKEVERIDQFFYTYADNSSGMIDPEGIETLCSHLEVPHTDVRILMLAWKMGCD

SEQ ID NO: 47152 - DNA, 936 bp, Zea mays
  misc_feature: Ceres CLONE 1453969-F
  misc_feature: Encodes the peptide sequence at SEQ ID NO. 47153
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (419)..(419): n is a, c, t, g, unknown, or other
  misc_feature (473)..(473): n is a, c, t, g, unknown, or other
  misc_feature (477)..(477): n is a, c, t, g, unknown, or other
  misc_feature (478)..(478): n is a, c, t, g, unknown, or other
acgtggtgtccaccnnnncnnnncaaanccaccaaannccnccaaaactggcactccccgcggtggcggccgctctttactagtggatcccccgggctgcaggaattcgcacgagaccattacctagaacatcctaatcgaaaaactccactccactccaaacctccctctctcgatctcgaccaccccccttggaccgcaagccagcccagccgtcccgctccctcggtaagcttccaagcgagtccggcggcgtcgagtcgaatggcgggcaagtcgcacacgcgcaaggcgttcctcctgtgcaactacgtcctcatgggcgccgcctccagctgcatcttcctcacgctgccgctgcgcctgctgccgtccccgtgcggcctcctcctgctcttcgtccgcgctgtggggggggncaatccccgcggacggcttgttttggatgagttgaagcagcccaacccacaaanaaannaaaagaatacaacgccgctcaaccggtgatggccccgcacctcacgcgccgatcctccaaggaaggtccgacagaggctggctaggggatccaacacgttgctctcccgaactttctctgggatgaaggtttccaatccctaaacgtgcccccaaaccatagatacagcgtcacgtggtcttcccgtcaatgattgcctcgtggggggccgcaggcaatccacccatgtgtaggatcctccctaagtgtggaccggaaggagggccctttctacttttctctccccctcccctcccgcatcattacacaaacatagaaactcaccttaagaagggtgtatcacatctgcgcaagccgctacacattcatcgagagctcgccggcattacgtagtagatcaactgttctcaccagagacggctagagtataacactcttatatacttttatattttttg

SEQ ID NO: 47153 - protein, 80 aa, Zea mays
  misc_feature: Ceres CLONE 1453969-F
  misc_feature (52)..(52): Xaa is any aa, unknown, or other
  misc_feature (70)..(70): Xaa is any aa, unknown, or other
  misc_feature (71)..(71): Xaa is any aa, unknown, or other
  misc_feature (72)..(72): Xaa is any aa, unknown, or other
MAGKSHTRKAFLLCNYVLMGAASSCIFLTLPLRLLPSPCGLLLLFVRAVGGXNPRGRLVLDELKQPNPQXXXKNTTPLNR

SEQ ID NO: 47154 - DNA, 764 bp, Zea mays
  misc_feature: Ceres CLONE 1453982-F
  misc_feature: Encodes the peptide sequence at SEQ ID NO. 47155
  misc_feature (667)..(667): n is a, c, t, g, unknown, or other
  misc_feature (711)..(711): n is a, c, t, g, unknown, or other
aaagctggagctccccgcggtggcggccgctctagaactagtggatcccccgggctgcaggaattcgcacgagaccattacctagaacatcctaatcgaaaaatataggcattcaatcattcaagcgaagcagccaccactctctccactgtgactccgtgacctgcctgccctgctgcacaagcacagcacacacaccccgcacaccgcaccagctcagcgcagctcaccaagacaatcaatcatggctcacccgcgcagtgtcgctgccgctgcccccctcctccggcggcgcgcgggtggcgctcgtcggccaggccaccgacgaagggtgctcgctggggaagcgcctgacgctggcccagctcccgcagctggcggcgcgggccgggccgaggaagggcgggatcgcgctggtgctcaccgcgcaggacgtgggcgtggacgggttctgcacgagccgctgcggcctgcacggctccgacgcccgggcccccgggaccgcgtacgtctgggtcggcaactccgccacgcagtgccccgggcagtgcgcgtggccgttccaccggcctctgtacggtccccagacgccggcgctcgtgccgccgagcggcgacgtcggcgcggacggcatggtgatcaacatcgccagcatggtcgccggcgncgtgaccaacccgttccgcgacgggttctaccagggcgacaagnacgcgccgctggaagccgccactgcctgcacaggggtctacggcagcggcgcc

SEQ ID NO: 47155 - protein, 44 aa, Zea mays
  misc_feature: Ceres CLONE 1453982-F
  misc_feature (12)..(12): Xaa is any aa, unknown, or other
  misc_feature (27)..(27): Xaa is any aa, unknown, or other
MVINIASMVAGXVTNPFRDGFYQGDKXAPLEAATACTGVYGSGA

SEQ ID NO: 47156 - DNA, 773 bp, Zea mays
  misc_feature: Ceres CLONE 1453985-F
  misc_feature: SWISSPROT Homolog: EC 2.7.1.40 Pyruvate kinase
  misc_feature (694)..(694): n is a, c, t, g, unknown, or other
  misc_feature (709)..(709): n is a, c, t, g, unknown, or other
  misc_feature (721)..(721): n is a, c, t, g, unknown, or other
  misc_feature (732)..(732): n is a, c, t, g, unknown, or other
ggagctccccgcggtggcggccgctctagaactagtggatcccccgggctgcaggaattcgcgcgagaccattacctagaacatcctaatcgaaaacaagacatgcagaggatgtgcgccaggcacgggaattcctgtcaaaattgggcgatctaagccagactctgatttttgccaaaattgagaatgtcgagggcttgaaccaatttgatgaaatactggctgaagcagatggtatcattttatcaagaaggaacctgggaattgatcttccacctgagaaggtctttttgtttcaaaaatcctgctcttcacaagtgcaacatggctggaaagcctgctgttgtcactccgtgtttggacagtatgactgacaacctcaggcctactccgagcggaggcaactgatgtggcaaatgcagtacttgatgggagtgatgccattctcccttggtgctgagactctccgaggtttatatccagttgagactatttcgacagtgggcagaatttgtgctgaggctgagaaggtattcaaccaagatttatacttcaagcaaactgtgaaatatgtcggaaaacccatgacccatttggagtccattgcttcctcagctgtgcgagctgctatcaaagttaaggcttcggtgatcatttgcttcacctctttctgggaggggctgcaggctcatcngccagtacagccccnacatgccctgtnctttcttgtgncattccctcgtctgaagacaaccacttgagaatgaatttcc

SEQ ID NO: 47157 - DNA, 721 bp, Zea mays
  misc_feature: Ceres CLONE 1453989-F
  misc_feature (463)..(463): n is a, c, t, g, unknown, or other
  misc_feature (591)..(591): n is a, c, t, g, unknown, or other
ggagctccccgcggtggcggccgctctagaatagtggatcccccgggctgcaggaattcgcacgagaccattacctagaacatcctaatcgaaaaagggcgttcctctcccgtgtggattctccccacctccgccgccgtttccccgcgtgctttctctctctctctcgatctcgagcgacgactcggttacagccgccgtcctacgccaggtcccaggtcttcgtcgggcccgtctccggcaacgagcaccaacaagatttttgtgtgtaaagatttgcgagcaccattcactttttcatcagtgtgaaattaagacacttcaagcatgagctctcaccgtgatgagtggaatgagggaccatttgtatgacattgagtcaagcaaccggtgaggcataagagtacagagccaatgaaccattatccccccatgatagatggaggatggatccttggccccnccacccttcctttcaaaaaatggtttttgaggaaaacgtgcccggcggaacccttttttaaacgcccctaaaggggggtgggtttcccccagggtttttaacttttttcaagaaggggggtggggtgngggtggggggggcccccccccaaagaaggggtgaaaaaaaaagtgccgcgccccaaaaaataataaaaggcgcccgccccccccgggggggcgccccccccccacccgcgggggggggggtgttttttct

SEQ ID NO: 47158 - DNA, 758 bp, Zea mays
  misc_feature: Ceres CLONE 1453990-F
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaaagacccctttcactgctgagtttgccgcctccctgttttgtctccggcccgctgccctcaccggtgacctctcctgctcgggccgcttgaggcccatacccccacacgatgaatcaacgatgctgcactaccattatcgccagcctcgtcttcaacgatgacgattgtcatcaccctcacgtgacctggatgctcactccctgccgtcgcgaggtcatctgattcctatggactgtgcgccctcgtcccctgcacgtttgaatgccacaaactccctctgttctctctgcggatctccccttcgtcggccgcctagattgctttcaccacatcgtcgacgatatcctcggtcacataaacgcggacgggcgactgcacaatgcctaaggctgactacgttatgattctgcatctccaccgacatgaaatgtgatggccctcagcactgtaatcatgctcctctccctcgccgctagaggggactccatcgcctcgactctagagatctgttccagctatgctgcacnaaagtagctacctgctcagaacagtggttacagatatcttctacacatattgtggctggacgcttaaggatatcgcttatgcttctaatgccgagcgcgtatttctattgtgactcggtgatctggtcgc

SEQ ID NO: 47159 - DNA, 757 bp, Zea mays
  misc_feature: Ceres CLONE 1454001-F
  misc_feature: SWISSPROT Homolog: EC 3.4.25.1 Proteasome endopeptidase complex
aagctggagctccccgcggtggcggccgctctataactagtggatcccccgggctgcaggaattcgcacgagaccattacctagaacatcctaatcgaaaaactttttggtacgggacgcggtcaaagtctcgacccctcggcgctcttgtatcgtctcctgagtgtacgtaaaatcaggtgcgttgggtccccctcggttagcttgccatgaccatacttctgtcaggaaggatgacgggctccttcggatatcccggccaaggcctggctctccttcgacctgtgccgcaggaaaacctcgctgaagaataaccggcatcaggtcccggcattcaagagcaccggcacaaccgtcgtcagtctcatctttctaaagtgcgatgttcttggctaaaacacaatggagaccgcccccccccaagatgctgataatatctgtgacaaaatccattttatggcacccaatatatcttgctgtccagcgtgaaatgttgtggaactagacggcgcctagcaattggttgagcctatctgctacagcttcatcgttatagcccgaggccgcgaatttagagttggttcggcttttacactaccgaaatcataccttctcccgtctccaggcgttgccagcgccgccgcttgtttgttgtgagaatgcaaagcccgggccacatttgatactgtgtatcacccagtcccactgatccaattcttctgcaacaagaaattgagttttttggctgagtggactt

SEQ ID NO: 47160 - DNA, 759 bp, Zea mays
  misc_feature: Ceres CLONE 1454009-F
  misc_feature: Encodes the peptide sequence at SEQ ID NO. 47161
  misc_feature (391)..(391): n is a, c, t, g, unknown, or other
  misc_feature (418)..(418): n is a, c, t, g, unknown, or other
tccccgcggtggcggccgctctagaactagtggatcccccgggctgcaggaattcgcacgagaccattacctagaacatcctaatcgaaaacacttgtcgctcgcccgcccgcgtcgtcgtctccgccggccggccggccggcctcccaaaccctagcgaggcgagcgagagagaaactagacgccatgttcgggtacaggaaggcggacccggacctcgaggccggcgggtcctcgctgctgtacccggggatgacggagagccccgaactgcggtgggcgttcgtccgcaagatctacgtcatcctcacggtccagctcgccatgacggcagccgtctcggccttcgtcgtcaaggtgcccgccgtctccaacttcttcgtctcctccnacgccgggatcgcgctctacatctccntcatcgtcctgccccttcatcgtggctgtgccttctgcactactaccaccagaagcatccgatcaatctgctgcttgctcggctttctcaccgtcggcattcagttccccgtcggaatgaaatgccctttccctagcggaaaattcattttggaggctgcattcttacggcggggggggggaaaaacttactggctaccttttcgggcctgcaaaaggggcatgaaattaatttcccgcgcccctttaaatgcggaacacgggggcccagggggtttcccaaaacaaaatttttccccgggggaaaattctggagaaaaaggggggatggccctcttttct

SEQ ID NO: 47161 - protein, 191 aa, Zea mays
  misc_feature: Ceres CLONE 1454009-F
  misc_feature (69)..(69): Xaa is any aa, unknown, or other
  misc_feature (78)..(78): Xaa is any aa, unknown, or other
MFGYRKADPDLEAGGSSLLYPGMTESPELRWAFVRKIYVILTVQLAMTAAVSAFVVKVPAVSNFFVSSXAGIALYISXIVLPLHRGCAFCTTTTRSIRSICCLLGFLTVGIQFPVGMKCPFPSGKFILEAAFLRRGGGKTYWLPFRACKRGMKLISRAPLNAEHGGPGGFPKQNFSPGENSGEKGGMALFS

SEQ ID NO: 47162 - DNA, 806 bp, Zea mays
  misc_feature: Ceres CLONE 1454010-F
  misc_feature: Encodes the peptide sequence at SEQ ID NO. 47163
  misc_feature (433)..(433): n is a, c, t, g, unknown, or other
  misc_feature (480)..(480): n is a, c, t, g, unknown, or other
  misc_feature (806)..(806): n is a, c, t, g, unknown, or other
acccgcggtggcggccgctctataactagtggatctccgggctggaggaattcccacgagaccattacctagaacatcctaatcgaaaaatccccagcccacgaccctccgccaccagccatcgtctgcatcagatctcccgcccgtccgttacatcccagggcgacgcggccgcggccatgacgccatcctcagctctcgccctcgcgcaccacgccgcggtatccccgctcccgtcctccacgccgcggccctccccaaggtccagctctctgagcctggcgcccggcctcggccgggctcgggccgcgccggctcgtcccggcgcgccccccacgggcggtctttttcttggttgtccttgaagcccgccccaagccggaagggtttttccatagaccataaaaacccctcgtgcccccccctttctatnaaaaccaatttataggtgggtaaggcccccccccgccaccctaatcncggcttagaaaagggaaaccaatcctttcccaaccaaggggtccatccccccaaacaacacgggctctcctggtggacgtctcgcgagctctgttttttcctgatgagccaaagaacctgttcattccccggtgaccccttttatactacccccgcccggggggtggttttcttccccggtggggttcttgctttctccaaaccccgattgacgtgttgcgcgggtccaccgttctcccccccgtccgttagagcaatcgcgacgcccatcgtgtggccccccccccaccccacctggcggcggcacctccttcgtagacgaaccn

SEQ ID NO: 47163 - protein, 61 aa, Zea mays
  misc_feature: Ceres CLONE 1454010-F
MTPSSALALAHHAAVSPLPSSTPRPSPRSSSLSLAPGLGRARAAPARPGAPPTGGLFLGCP

SEQ ID NO: 47164 - DNA, 807 bp, Zea mays
  misc_feature: Ceres CLONE 1454016-F
  misc_feature (253)..(253): n is a, c, t, g, unknown, or other
  misc_feature (746)..(746): n is a, c, t, g, unknown, or other
  misc_feature (747)..(747): n is a, c, t, g, unknown, or other
  misc_feature (807)..(807): n is a, c, t, g, unknown, or other
aaagctggagctccccgcggtggcggccgctctataactagtggatcccccgggctgcaggaattcgcacgagaccattacctagaacatcctaatcgaaaaaccctcaccactatccattttcattcaatgcgtccgcgccgcgcgcctccattcctctcgattccctccctccttccttgttcgaggacctccgcgaccgtggccgagggattgaggacggaaagcgaaaatgatgctgacgcgggcgtcnatgggggtgatggatgcggcggcggtggacgaagtgctgcgtcgcctcttctaaggcggccgcgggggccggcaggtgcagatgtccgaagccgatatccgccagtctgcgtcgaggccaaaaatgggctgttttttaaagacaaacttccttcgcatccacccgcccgttaaggatctggggggaaatccatgggcaactttggtgataccctggaaaatccttggattttgggggggtaacccccccaaacttcaatttaattttttccctgggaaacaattgggggtaagggggaaaacaaaggtttaaacacctttggttcccttctgggataacatttggaagcccccggaaaatttaacccctttagggggggacccttggatacccaaaattttcccagttttgggtttctctggggggggggaaaggggattcttgtgccccctagaaaaaattttggaggggcccacgggttggcctgggggcnntatataggaaaaatattttttggggggggcgccccccccgtgttcctctgttaaaaaaan

SEQ ID NO: 47165 - DNA, 794 bp, Zea mays
  misc_feature: Ceres CLONE 1454017-F
  misc_feature: Pfam Name: Ribosomal_L30 Pfam Description: Ribosomal protein L30p/L7e
  misc_feature (383)..(383): n is a, c, t, g, unknown, or other
  misc_feature (434)..(434): n is a, c, t, g, unknown, or other
  misc_feature (502)..(502): n is a, c, t, g, unknown, or other
aagctggagctccccgcggtggcggccgctctagaactagtggatcccccgggctgcaggaattcgcacgagaccgttacctagaacatcctaatcgaaaaaaccctctcagtctcgggtccgccgtcctcgcctaggtttaggcatccagcggccgcagcctccacaccacgagcggaaggagcatcgccgagaagaggggggaggcgcgcagatgagcggaagcgcgttcaacgcgttcaagtcgcgggtgccggtggcgtggagtccccggctgtacatcacgctggtgcggggcctaccgggcacgcgccgcctacaccgccgtacgctagagtgcatgcgcctccgtcagctgcatcgcagcgtcgagcactgtacangccgtcgctgctcgggatgctcacgcagggggagcggcctcgtccgcgtcnagaaccaaggagaatgtacacgctcgccaatcaagcctaggcggaaaggggccggcccgacccccggntcgtctcctccaacaacaagcacccccccctggttttgaacccgcccccccccccccgaagtgtggtgtgtcccctccccccaaacccctggggaaaagaaaaatttcctaacctttcccccgttaaaaaataaccgcccgcggttttggtcccccgggccccccccccccaaaaaaatatggtccctttggccccaagaagagacccaatgttgttccatacttttgagggggggctgtttttccccccaaaaaaaaggggggagcccccccggtgtttcaaaaaaaagag

SEQ ID NO: 47166 - DNA, 784 bp, Zea mays
  misc_feature: Ceres CLONE 1454020-F
  misc_feature: Encodes the peptide sequence at SEQ ID NO. 47167
  misc_feature (401)..(401): n is a, c, t, g, unknown, or other
  misc_feature (447)..(447): n is a, c, t, g, unknown, or other
ggagctccccgcggtggcggccgctctagaactagtggatcccccgggctgcaggaattcgcacgagaccattacctagaacatcctaatcgaaaaagacgcacactgacggagagtgatcactgatttctggtcatggcaaccgtaactgaggaagttgctccggtcgtcaccgtctccgaggagccggcgccggaagcggcgaatgaggtggtggacaacccggatgaggggaataagcccgactaggagggtgactacaggaagaatgccgaccccgccgccgagaaggagaagaatgccgaccccgccgccgagaaggagaacaaggcgaggaagccgcggatcaggaagcccatgtccgccgggctgcaccagctgccctatttcgagatgatcanggaggcgatcctgtcgcaggacggcaggaaagtcggggccaccccntacgcgatccccaacacttggggaagaaacaacgggacgtgctcccgcccaattaccgcatggtgttggcagggaacttgcggggtttccccccaaggcccccctttcaagggcaagggccctttaaaattccccccccccaaagaagaaacccctcccggggccccaaagaaaaaaaaaaggcgccgggggaaggccccccaaaaagcgcccccccccgcccaaaaaaaaccgcggccctccccccccgccccaaaagaggaccataagggggcccaaaaaacacaagaaagtggcgcctccccccccaaaataaaaaaaaaaaccccgccgcccc

SEQ ID NO: 47167 - protein, 37 aa, Zea mays
  misc_feature: Ceres CLONE 1454020-F
MATVTEEVAPVVTVSEEPAPEAANEVVDNPDEGNKPD

SEQ ID NO: 47168 - DNA, 767 bp, Zea mays
  misc_feature: Ceres CLONE 1454025-F
  misc_feature: Encodes the peptide sequence at SEQ ID NO. 47169
  misc_feature (364)..(364): n is a, c, t, g, unknown, or other
  misc_feature (691)..(691): n is a, c, t, g, unknown, or other
  misc_feature (759)..(759): n is a, c, t, g, unknown, or other
  misc_feature (763)..(763): n is a, c, t, g, unknown, or other
  misc_feature (765)..(765): n is a, c, t, g, unknown, or other
  misc_feature (766)..(766): n is a, c, t, g, unknown, or other
acccgcggtggcggccgctctagaactagtggatcccccgggctgcaggaattcgcacgagaccattacctagaacatcctaatcgaaatctcgatttctcactcctctctcggcaggcgccttcccaccatcgataaggtgttgcctcccacacatacaaatcggaagttcgaccttcctccccaaatcaacaatcggtcctattacaatgctacaggacaagtgaactgaggggggagtgctaggacggcaaggactacacgtgctgggaggagctgctgccggacgcgatgggcctcatcttccgcaacctgccgctgcaggaggtgctcaccgtcctgccgcgggtgtgcaagtcctggnggcgggtggtggccggcccctactgttggcaggagacccccctcccaaagtggagccagcagaaggggcaacccgaaggaaatcgcccgcatgggccgaattaatcgtggggcccaaaggcggggtcggggccccggaataaagggccccgcccggcccggaatcccggcttcttcttttttgggaaaaaaatctgcttgaaaaagggagaggtgggttttaaaattttagaaaggaaaaccccggcccatttttttgtggaaaaggggggttgggagaccctcttcgatgttttttaaaaaaaccgggccaaaaaggcggcccctnaaacaaaataaaagaagaattgggggggggcatttgaaaaaaaaaaaacacccccctccgccaaaaantaanannc

SEQ ID NO: 47169 - protein, 58 aa, Zea mays
  misc_feature: Ceres CLONE 1454025-F
  misc_feature (25)..(25): Xaa is any aa, unknown, or other
MGLIFRNLPLQEVLTVLPRVCKSWXRVVAGPYCWQETPLPKWSQQKGQPEGNRPHGPN

SEQ ID NO: 47170 - DNA, 771 bp, Zea mays
  misc_feature: Ceres CLONE 1454026-F
  misc_feature: Encodes the peptide sequence at SEQ ID NO. 47171
aagctggagctccccgcggtggcggccgctctagaactagtggatcccccgggctgcaggaattcgcacgagaccattacctagaacatcctaatcgaaaaaaaaatagaggaggtagtgccgacagaggcacgagcgcctccctcgtcttcgttccgtctctccccacagggaaccgccgcccgtcgcctccagatacgtgcctccggcggaaaatcggtatcaagctcgctttgttcgaatcttctgtataaccaggaaggaggcctctccatctcctccgggaaggctgtgcaacaatggagaagtataacagcaagactcggttagcacccttgagagataccccatttgctctccgtggtgctcttggtagttcaagctcataccttgagcaagccaggggctacacgtcttcccctctagcagctctgcgaccaaagatgtcttctactaccggaaatcgactcctgcactcgagttgccccctgtcatctcctgtagcaaaacgcccgctgtcgccccaccttcctctgaagaagccacagttcagcgcgactttctcaatctcgcatcgtatattcggtgtcacgttgggagttgccatcgtatctgtccctctcgccaccaagttcagcctaatgtttggtgtctgagagcgatttgctgcatctcatgagaaacatcattttccgtttctgtgtctgttattcatcgtctcggtatacttgcgacacagctggtaggtgccgctcggaatactatcttagc

SEQ ID NO: 47171 - protein, 118 aa, Zea mays
  misc_feature: Ceres CLONE 1454026-F
MEKYNSKTRLAPLRDTPFALRGALGSSSSYLEQARGYTSSPLAALRPKMSSTTGNRLLHSSCPLSSPVAKRPLSPHLPLKKPQFSATFSISHRIFGVTLGVAIVSVPLATKFSLMFGV

SEQ ID NO: 47172 - DNA, 740 bp, Zea mays
  misc_feature: Ceres CLONE 1454030-F
  misc_feature (285)..(285): n is a, c, t, g, unknown, or other
  misc_feature (322)..(322): n is a, c, t, g, unknown, or other
  misc_feature (329)..(329): n is a, c, t, g, unknown, or other
aaagctggagctccccgcggtggcggccgctctagaactagtggatcccccgggctgcaggaattcgcacgagaccattacctagaacatcctaatcgaaaaaaccctactagtgctagctttcggccgcgaaaaacgtccccacccccacgtctcaactttatagccgccccctccccaccgccgcggccgccacgcgcagcagcaacccggtagcaggagcgcagccagcaagctcagccccccagccctactgccaccgcgccgaacgccatggccgagccngcaaagcacgtccagcggaggaagaggaagccgcggncgccgcnaagaatgagacaccggcgcccaggtcggcgccatcgtgaactggagaggtcgccgtaccaccgaaaaggaggacaggaccccctcctgaattaaaggaaaactttccggttccaaagggaggaaaccgtggaaaaaccggcccaaggctttggacctctctaaaacaaaaaacccccagggccccctttttgggttggggaaacacttaaaatgcgcgcccccttcgggggggaacaaaaaaaagaaaaccccggggaaaaaatgtggggggggcgccgttttttctccccgggggataaaaagaaggtttttccccttttgtttgtgcaaaaaaaaaaaaaaccggggggcgtgaaataaaaacccccccgggggggggggaaaaaaaaaatttcccctcccctcctcct

SEQ ID NO: 47173 - DNA, 761 bp, Zea mays
  misc_feature: Ceres CLONE 1454038-F
  misc_feature: Encodes the peptide sequence at SEQ ID NO. 47174
  misc_feature (756)..(756): n is a, c, t, g, unknown, or other
aaagctggagctccccgcggtggcggccgctctagaactagtggatcccccgggctgcaggaattcgtctccccctaatcgaaaagatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaaaaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgccatcctggccggcttggtgggcgcggcgaccaaccttggcggcgtgcaccacatgcgcgcctggtgccacgacagcctgaccaccaacgccgcgtcgtcgctcatcgcctgggccatcacggcgctcgccttcgggctggcctgcaaggagatccacatcaggcgacaccgcggctggcgcctgcacgtgctgtaagccttcgtcatcatcctcgccttcaggcagctcctctacgtgctcatgctccacactgacctcttcngcagc

SEQ ID NO: 47174 - protein, 121 aa, Zea mays
  misc_feature: Ceres CLONE 1454038-F
  misc_feature (14)..(122): Pfam Name: AWPM-19 Pfam Description: AWPM-19-like family
MAGIGRNMVAPLLVLNLIMYIIVIGFASWNLNHFINGQTNYPGVAGNGATFYFLVFAILAGLVGAATNLGGVHHMRAWCHDSLTTNAASSLIAWAITALAFGLACKEIHIRRHRGWRLHVL

SEQ ID NO: 47175 - DNA, 733 bp, Zea mays
  misc_feature: Ceres CLONE 1454039-F
  misc_feature: Encodes the peptide sequence at SEQ ID NO. 47176
  misc_feature (548)..(548): n is a, c, t, g, unknown, or other
ctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgtttgagtactatgctaagctgaggagctgcattcacatcatgtggtggagcgcgagggaggcttctttatcggacagcctcacttgtcaccgacgcaatcaggcacccccccaagccgtggactacgctggntttggctttggcatgagaacgaccgctgtgtttgtcataagtcatatcgtaactagagaaacagtaggtttatatcacaatgtatcaccttcctacagaactatggatgcgtcttgtcaatagcccggataggccgcttctaaaaaaaaaaaaaaaacgagaccgtcgaggtacccgattcgccc

SEQ ID NO: 47176 - protein, 69 aa, Zea mays
  misc_feature: Ceres CLONE 1454039-F
PRGGGRSRTSGSPGLQEFVSPLIENKWERQRFGLQGGFVTNPLAEPNISSAGKTMVTHEGRKKDKTLQK

SEQ ID NO: 47177 - DNA, 749 bp, Zea mays
  misc_feature: Ceres CLONE 1454040-F
  misc_feature: Encodes the peptide sequence at SEQ ID NO. 47178
  misc_feature (558)..(558): n is a, c, t, g, unknown, or other
aagctggagctccccgcggtggcggccgctctagaactagtggatcccccgggctgcaggaattcgtctcacccctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgatgccnttgatcgcattcaggaagcttggccgaaccactgcgccggggccccaagggcttccttcctcttccaaagccggtttggggaaaaaaaagggttccgggcccttgggtccccccccccccaaaaacgccccgggttgtgtggccccaccgcaaaaaaaaatcccagcgcttggggggttccaccgtggacc

SEQ ID NO: 47178 - protein, 182 aa, Zea mays
  misc_feature: Ceres CLONE 1454040-F
  misc_feature (49)..(164): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLMPLIAFRKLGRTTAPGPQGLPSSSKAGLGKKKGSGPLGPPPPKNAPGCVAPPQKKIPALGGFHRG

SEQ ID NO: 47179 - DNA, 754 bp, Zea mays
  misc_feature: Ceres CLONE 1454044-F
  misc_feature (754)..(754): n is a, c, t, g, unknown, or other
ggagctccccgcggtggcggccgctctagaactagtggatcccccgggctgcaggaattcgtctcacccctaatcgaaaaacgccattccccctcctgctgttttccccaaggtacagcaaccacaagatgggacctcgctcctgctcgcccatggcaccctggtggccgagctgccccttccttgtccatggctggatgctcccctgctggagctccttgccggcgcccccaaatccctggtttcccttgcgcaggagcagagactctcatggacgccccctcccaagctcctgagcgtgcaaggcagcaacaccttcatcccctcggatccaagtcgctgggaggtttttctcggtgctggaacccgatgcagccacccatggtgccctctcacccagccatggccgccaccctaaccctctgtacacgcgcgaccttcatcttcaagcacagcaagcagccgcggccacatgcagcgcggcaatctgcctgtgcgtgcacaaggcagaggaagaagatgactccctgagcctatgacaagtggacccagggcggatgaccgagagaggatgatcgtgcaagtgatgtggtgccaaccacaaggtgcagtcggtggacgacccaaggaaggatggacttaaccagtggatgctcgccaagcgagtacctcccccagcaaacactacctaagtgttaaattaaaggtacctccttgattttggtgatggtgtgacttggcctccatccctgcn

SEQ ID NO: 47180 - DNA, 721 bp, Zea mays
  misc_feature: Ceres CLONE 1454047-F
  misc_feature: Encodes the peptide sequence at SEQ ID NO. 47181
  misc_feature (715)..(715): n is a, c, t, g, unknown, or other
tggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttngtaaaa

SEQ ID NO: 47181 - protein, 72 aa, Zea mays; identical to SEQ ID NO: 46899
  misc_feature: Ceres CLONE 1454047-F

SEQ ID NO: 47182 - DNA, 729 bp, Zea mays
  misc_feature: Ceres CLONE 1454051-F
  misc_feature: Encodes the peptide sequence at SEQ ID NO. 47183
ggagctccccgcggtggcggccgctctagaactagtggatcccccgggctgcaggaattcgtctcacccctaatcgaaaattttcaagctctcctcccctcttcctaccattagcagtagccacagccagaacaccagcagacagcagcatcagcagggaggaacacgatgagcggcgccggtccggatctgcagctgccaccggggttccggttccgcccgacggacgaggagctggagatgcactacctctgccgccgctgcgccggcctgcccatcgccggccccatcatcgccgagatcgacctctacaagttccacccatggcagctcccaaggatggcgctgtacggcgagaaggcccggtacttcttctccccgcgggaccgcaagtacccgaacgggcccaggcccaaccgcgccaccggggctgggtactgaaaggccaccggcgctgacaagcccgtgggcacgcccaagccgctggccatcaagaaggcgctcgtcttctacgccggcaaggcgcccaagggcgagaagaccaactggatcatgcactagtaccgcctcgccaacgtcgaccgctcggcgcgcaagaagaacaccctcaggttggatgactgggtcctgtgccgcatctacaacaagaagggcggcgggctggacaatgcggcggcgccggcagccggctgctaccacaagcctgtgttcgccacggcggcggtgagc

SEQ ID NO: 47183 - protein, 90 aa, Zea mays
  misc_feature: Ceres CLONE 1454051-F
  misc_feature (10)..(91): Pfam Name: NAM Pfam Description: No apical meristem (NAM) protein
MSGAGPDLQLPPGFRFRPTDEELEMHYLCRRCAGLPIAGPIIAEIDLYKFHPWQLPRMALYGEKARYFFSPRDRKYPNGPRPNRATGAGY

SEQ ID NO: 47184 - DNA, 745 bp, Zea mays
  misc_feature: Ceres CLONE 1454055-F
  misc_feature: Encodes the peptide sequence at SEQ ID NO. 47185
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
ggagctccccgcggtggcggccgctctagaactagtggatcccccgggctgcaggaattcgtctcacccctaatcgaaaattcctcgtgcccgtcccctcaggcgctcttgctggttctggaagccggagcatcggcgctgtcgctcaggtctgaccattcccctccaaagccctaaagctaggcttcctgtgctaacccgaatcaagcaagccccgtaaacctcccccggcgtcggcttcttcgctgttgctctcctctcgaccgggtccccatctcctcccttcaccgccccataactcctcactcgggcgctgccgatgcaaggtctccgtggcatctggccttcgtcattactcatcacactaatcattggcaaacttggaactgcatgctcccaaagcaaaacgtcggtcatatatcccaacgaaaaatggaacagccatgatgcttccgctccatattcattacaaagatgtactacgtcaggatctgttgctcaaacagaatcatgccaatatcatgcaagatccagggttgtttgagcaataacaagctgctgtagactatgatgagnnnagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47185 - protein, 35 aa, Zea mays
  misc_feature: Ceres CLONE 1454055-F
MMLPLHIHYKDVLRQDLLLKQNHANIMQDPGLFEQ

SEQ ID NO: 47186 - DNA, 775 bp, Zea mays
  misc_feature: Ceres CLONE 1454057-F
  misc_feature: Encodes the peptide sequence at SEQ ID NO. 47187
aagctggagctccccgcggtggcggccgctctagaactagtggatcccccgggctgcaggaattcgtctcacccctaatcgaaaaatcggactcatctccttcgattcagcagaggacagcgctctgcctctccactacttgacagccacggatccttccatccctcgcctagcgaacagacccggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgagctctgccatcgcattcatgttacctctgaaagcactcagacaatcctctagatttattgtcaataacagctgcgtatttggcattggcttcatcaaagttgccactatcaaagttaacacgacgctagaaacactgtttgtcaggaagatgaacatcttcaacgaggccaaagtttacacttggaaaatcgaggatttctctgctctgaaaacccgtcccactcaccggagtttgagatcgctggatacacatggattatctcttttgatccatcctacgatggtaacagccctgtcctttatcctg

SEQ ID NO: 47187 - protein, 168 aa, Zea mays
  misc_feature: Ceres CLONE 1454057-F
MRYLKLNPKYEVSNEECVSLRLELSQSSVKLDTIFEASFKFMIYDQLIGKHKVHLGNHSFQTASTSSAIAFMLPLKALRQSSRFIVNNSCVFGIGFIKVATIKVNTTLETLFVRKMNIFNEAKVYTWKIEDFSALKTRPTHRSLRSLDTHGLSLLIHPTMVTALSFIL

SEQ ID NO: 47188 - DNA, 812 bp, Zea mays
  misc_feature: Ceres CLONE 1454063-F
  misc_feature: Encodes the peptide sequence at SEQ ID NO. 47189
  misc_feature (380)..(380): n is a, c, t, g, unknown, or other
  misc_feature (436)..(436): n is a, c, t, g, unknown, or other
ggagctccccgcggtggcggccgctctagaactagtggatcccccgggctgcaggaattcgtctcacccctaatcgaaaaaaaacttaaagccctaaacccatcttgctcccccctcgtctccactgctctgctgctcctcgcgccgccgccgccgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgatggccgggaccctctaggcgaggtccatgaccaccttcacgcgcacgaagccccatgtgaacgtcngcaccattggggcacgtctatcacggcaaaaccacctctcactgctgacattaccnaggttcctggacgaggcaggagaagcccaacccgttgcttttcaagaaatcaacaaagcctccggaggaaaaaacccaaggaatcaccccttggcaccgctcccctccagataaaaaacgggtaaaaaggctttatgccccgcttgtttttgcccggccacataattttgggagagaaaagaaccccgggagctgtccacacggggggggggcttcttgggtggggccccccctggggggccgcggcgccaaaaaaaagagatttttttttttgcccccgggggtgggggcactcccccttgggggttctaaaaaaaaagggtgtgggggtgaaacccaccctctccccaatttgagggaggagcgcccccccccc

SEQ ID NO: 47189 - protein, 52 aa, Zea mays
  misc_feature: Ceres CLONE 1454063-F
MASAAVLRNAGSRRLFSYPTLRAAAIYVPSALPDAPAAAAAPAQPPPMAGTL

SEQ ID NO: 47190 - DNA, 718 bp, Zea mays
  misc_feature: Ceres CLONE 1454065-F
  misc_feature: Encodes the peptide sequence at SEQ ID NO. 47191
aagctggagctccccgcggtggcggccgctctagaactagtggatcccccgggctgcaggaattcgtctcacccctaatcgaaaactaaaccctacccgactccgccgccgcccgccgctccgcctcagcgcatagcccgccgcgacctcatcgatcaccttcaactttcaatcatggcggacgtcgatgtcgaaccggaggttgccgccggagctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcgctcatcaagaagctgcgcaaggcgaaaaaagatgttcctgctggtgagaaaccagagccagtcaagacacatctcccgtaacatgatcattggtccctgaaatgaatggaagcatttgttggtgtctacaacggcaagaaccttcaaccggtttgaaatcaagccttgaaaatggaccggccccaaaccttgggggagaatttcccccctctcctaaaaacccggtcaaaatgggaaggccccggattggggccccccccccccccgggtttatcccccgaaaaagaggtgtacccggcgtttgaacccccccaaaaaaattgggggaggggcccccccttttcccctgttttaa

SEQ ID NO: 47191 - protein, 89 aa, Zea mays
  misc_feature: Ceres CLONE 1454065-F
MADVDVEPEVAAGAPKKRTFRKYSYRGVDLDALLDMSTDDLVQLFPARARRRFQRGLKRKPMALIKKLRKAKKDVPAGEKPEPVKTHLP

SEQ ID NO: 47192 - DNA, 762 bp, Zea mays
  misc_feature: Ceres CLONE 1454066-F
  misc_feature: Encodes the peptide sequence at SEQ ID NO. 47193
  misc_feature (401)..(401): n is a, c, t, g, unknown, or other
  misc_feature (404)..(404): n is a, c, t, g, unknown, or other
  misc_feature (413)..(413): n is a, c, t, g, unknown, or other
tccccgcggtggcggccgctctagaactagtggatcccccgggctgcaggaattcgtctcacccctaatcgaaaaagcagtccgatagccaggaagcccgtgcacgtcgaccgacgtacgccaccatgccggggctcaccataggcgacaccgtccccaacctggagctggactccacccacggcaagatccgcatccacgactacgttggcgacggctacgctatcatcttctctcacccagccgacttcacgcccgtgtgcacgacggagatggcggcgatggcggggtacgccaaggagttcgagaagcgtggcgtgaagctgctgggcatctcgtgcgacgacgtggagtcgcacaggcagtggaccaaggacgtgaaagcgtacggcgggaaacancancagcagcancatacgacaaccaaggtgacgttccccaatcctggcggacccggggcgggaaccccatccgggaactgaaactggggggaaccccaacaaaaaagaacccggcggggggagaaaattcccttccccggcgtctcacttttttgggggcccaaaagggccggaaaaattaaactcccttgacccggcgcccaccgggggggaaaaaaggaaaaaaggggtggggcgcgctaaaattcttttttccgcgcccccaaaaagggggggaaggggggcccccccccccataatgaaaccgcggggggggggccttttctccccccgggttctcaaaaaaacgccaaaaatattc

SEQ ID NO: 47193 - protein, 118 aa, Zea mays
  misc_feature: Ceres CLONE 1454066-F
  misc_feature (6)..(102): Pfam Name: AhpC-TSA Pfam Description: AhpC/TSA family
  misc_feature: SWISSPROT Homolog: EC 1.11.1.15 Peroxiredoxin
  misc_feature (92)..(92): Xaa is any aa, unknown, or other
  misc_feature (93)..(93): Xaa is any aa, unknown, or other
  misc_feature (96)..(96): Xaa is any aa, unknown, or other
MPGLTIGDTVPNLELDSTHGKIRIHDYVGDGYAIIFSHPADFTPVCTTEMAAMAGYAKEFEKRGVKLLGISCDDVESHRQWTKDVKAYGGKXXQQXHTTTKVTFPNPGGPGAGTPSGN

SEQ ID NO: 47194 - DNA, 768 bp, Zea mays
  misc_feature: Ceres CLONE 1454067-F
  misc_feature: Encodes the peptide sequence at SEQ ID NO. 47195
ctccccgcggtggcggccgctctagaactagtggatcccccgggctgcaggaattcgtctcacccctaatcgaaaagaacggaggtcgagcaccagacctcatctcactccgctaccccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccgccgtacgtggtggtggacagcgccaacgggttcgagatccggcggtacacggacgccatgtggatcaccacggcgcccatcgaggacatctccttcgtcgccgccacgagcaccggcttcctccagctgttcgactacatccagggaaagaacgcgcacaacaagacaatcgatatgacggcgccggtgctgacgagggtgtcgcccaccgacgggcccttctgcgcctccgccttcggcgtgagcttctacgtgccggccaaaaaccagggaacccccccccgggccgaggccctgcccgtggaaccgctgggccgggggcagggaacccggcgggcgcccctttcgggggcttcttggcggacccctaacctcggggaaacaggcggcccgccctctaggccagtctccagggcaacccgggggggcccgcgcccgtcaactaacccttgctagggccaaacacggcctcccctctaacccgcacccgcaataaaaactcccccccttcgaggttt

SEQ ID NO: 47195 - protein, 183 aa, Zea mays
  misc_feature: Ceres CLONE 1454067-F
  misc_feature (28)..(172): Pfam Name: SOUL Pfam Description: SOUL heme-binding protein
MARRASLLLAAALLVAVAAAAVPPTCERIECPPYVVVDSANGFEIRRYTDAMWITTAPIEDISFVAATSTGFLQLFDYIQGKNAHNKTIDMTAPVLTRVSPTDGPFCASAFGVSFYVPAKNQGTPPRAEALPVEPLGRGQGTRRAPLSGASWRTPNLGETGGPPSRPVSRATRGGPRPSTNPC

SEQ ID NO: 47196 - DNA, 766 bp, Zea mays
  misc_feature: Ceres CLONE 1454069-F
  misc_feature (359)..(359): n is a, c, t, g, unknown, or other
  misc_feature (450)..(450): n is a, c, t, g, unknown, or other
  misc_feature (451)..(451): n is a, c, t, g, unknown, or other
ggagctccccgcggtggcggccgctctagaactagtggatcccccgggctgcaggaattcgtctcacccctaatcgaaaagaggaaagagagagggggaggtcgacgatactcatagagaaggccatgagggttcctctccccattcctcccttccgtgccctatccgagccaaccgcgaggaaggaggcatcccgccgtctcgcctggtgcccggccgtcggccgaccttctgccgcagcttccaattgtaaaaagatcatagatttttgtgcaagagcgagtggatatggcacgctcccctcaacctatggatgtcgctgccggtggtgacaagtgtatcctgcctctgcctatccngctgcagcagcagtagctcctgcttctgttgatctgctcgttgacaggcatggcagtcactcccacgcagtcctgatatatgagtgctcannagcaaatgtctactaacagctgaacaatccaccgaagctccaacatcagcaaaactggactttaggacttctgggtttaaccctgccctgaaatgggggccgcaatggtttccaaaacccccattttgcctttgggaggtaaacaaaatttgaggcgccctaaaatattcccaaaattaaccgaaaatcccggtattcttttaaaaggtgggaaaattccccccgggggaaaatttttgggggggaccccctcggaaaaaacacccccccccctcaaaaaaaaataatttgtgagaaaataaaaaggggtttttt

SEQ ID NO: 47197 - DNA, 746 bp, Zea mays
  misc_feature: Ceres CLONE 1454074-F
  misc_feature: Encodes the peptide sequence at SEQ ID NO. 47198
acccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgtttgagtactatgctaagctgaggagctgcattcacatcatgtggtgaagcgcgagggaggcttctttatcggacagcctcacttgtcaccgacgcaatcaggcacccccccaagccgtggacaacgctggggttggcctttggcatgaaaaacaaccgctgtgttttgcataggcccaaacgaaaccaaaaaaaacaagtaccttttaaaatcccaatgtttcaccctccctacaaaacttgggaggcgcccttggacaaaggcccgagaaaagcctcttccaaaaaaaaaaaaaaaaaaagaaacccccggagaccccaattcccccctg

SEQ ID NO: 47198 - protein, 69 aa, Zea mays
  misc_feature: Ceres CLONE 1454074-F
TRGGGRSRTSGSPGLQEFVSPLIENKWERQRFGLQGGFVTNPLAEPNISSAGKTMVTHEGRKKDKTLQK

SEQ ID NO: 47199 - DNA, 783 bp, Zea mays
  misc_feature: Ceres CLONE 1454075-F
  misc_feature: Encodes the peptide sequence at SEQ ID NO. 47200
  misc_feature (348)..(348): n is a, c, t, g, unknown, or other
  misc_feature (376)..(376): n is a, c, t, g, unknown, or other
  misc_feature (384)..(384): n is a, c, t, g, unknown, or other
aagctggagctccccgcggtggcggccgctctagaactagtggatcccccgggctgcaggaattcgtctcacccctaatcgaaaactctgatttttggcgagcagaacatactctgagacgacaggtagaagacgactgactgcctcgagcagcagagatcagggaggccgagggcgggatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacnaggtcgtttacaggcgctacgcctcccnttttctcntcgtcggcgtcaacagcgatgaggatgagttagctatccctggaatcaaacgtctttcgggtggaactatggatccgccacttcggcaaggggtgccagctcgaattcatgtcccatctggaaaaatggccttcctgtttaaaaaaaagggataaaagggtttctttgggaaaaacaaaaaaaaaaaatcttgtggccccctatcccttttggggaaaaaccccccaaaaaaagggacccccttttggggggttttaaaccccctttttaaaaagttgggcggggcgccccttttcaaaaaatccccctcgttgggggagagggagaaaaaacttcctccaacaaagggaaaataaaacccccgagtgggggggaaaaaaaaacgggcgggcccttttt

SEQ ID NO: 47200 - protein, 119 aa, Zea mays
  misc_feature: Ceres CLONE 1454075-F
  misc_feature (2)..(112): Pfam Name: Clat_adaptor_s Pfam Description: Clathrin adaptor complex small chain
  misc_feature (57)..(57): Xaa is any aa, unknown, or other
  misc_feature (66)..(66): Xaa is any aa, unknown, or other
  misc_feature (69)..(69): Xaa is any aa, unknown, or other
MTIRFVLFVNKQGQTRLAQYYEHLSLDERRALEGEIVRKCLARTDQQCSFVEHRNYXVVYRRYASXFLXVGVNSDEDELAIPGIKRLSGGTMDPPLRQGVPARIHVPSGKMAFLFKKKG

SEQ ID NO: 47201 - DNA, 748 bp, Zea mays
  misc_feature: Ceres CLONE 1454078-F
  misc_feature: Encodes the peptide sequence at SEQ ID NO. 47202
  misc_feature (700)..(700): n is a, c, t, g, unknown, or other
ccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctnctaagtgttaaataaagacatcatctgacaaataaaaaaaaaacgagg

SEQ ID NO: 47202 - protein, 72 aa, Zea mays; identical to SEQ ID NO: 46899
  misc_feature: Ceres CLONE 1454078-F

SEQ ID NO: 47203 - DNA, 762 bp, Zea mays
  misc_feature: Ceres CLONE 1454079-F
  misc_feature: Encodes the peptide sequence at SEQ ID NO. 47204
  misc_feature (369)..(369): n is a, c, t, g, unknown, or other
  misc_feature (477)..(477): n is a, c, t, g, unknown, or other
agctcaccgcggtggcggccgctctagaactagtggatcccccgggctgcaggaattcgtctcacccctaatcgaaaatccgaccttccagtcttctccgtaggggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaangaaaagatgaggctgcaggtgccagggataaaggtatttggaggatccctggacaatgtgaaaggctgcactgatcaggtggagaatggaatgaagttgtcactttgngaaggacattgagatactatgccttaccacgccttgccacactaaaggtcatatcagctactatgttactagcaagggagggtgaagatcccgcggtctttcaccgaagatacttggttcattgctggggggcgggaaactttttttaagggtcctgcacaacaaatgtttcactcccttattgttacacggtgttcgcttgccaaattctacccgagtttactggtgggcatgaataccctgggaaaaacccaatattcctgcttaaacctggacccaaaaaaa

SEQ ID NO: 47204 - protein, 102 aa, Zea mays
  misc_feature: Ceres CLONE 1454079-F
  misc_feature: SWISSPROT Homolog: EC 3.1.2.6 Hydroxyacylglutathione hydrolase
  misc_feature (63)..(63): Xaa is any aa, unknown, or other
  misc_feature (99)..(99): Xaa is any aa, unknown, or other
MKIIPVPCLDDNYAYLIVDESTKKAAAVDPVEPEKVLKAAGEVGAYVDCVLTTHHHWDHAGGXEKMRLQVPGIKVFGGSLDNVKGCTDQVENGMKLSLXEGH

SEQ ID NO: 47205 - DNA, 748 bp, Zea mays
  misc_feature: Ceres CLONE 1454084-F
  misc_feature: Encodes the peptide sequence at SEQ ID NO. 47206
  misc_feature (539)..(539): n is a, c, t, g, unknown, or other
  misc_feature (549)..(549): n is a, c, t, g, unknown, or other
  misc_feature (574)..(574): n is a, c, t, g, unknown, or other
aagctggagctccccgcggtggcggccgctctagaactagtggatcccccgggctgcaggaattcgtctcacccctaatcgaaaaaaaaatagataaaaccctttacctcctccccgctcagagaccatcgcggagagaaaccccaaacccccaaatcttgtcgactccaacgatgccgccgccgccgacgagcgccccgcattctctcgctgctgacgatttccacacctcggacacggctgccgccgcggccggggctgtggtgccatgcgcggcgtcccagccggggaccaacggcggcaagaagcctgcgttcgcgttcgggcgggtgtggtcggaggcggacgaagttcgcatcctcgagggcctcgcggcgtacgccgcggcccacggcgcagaaccgcgccggtcccagctccacgccgcgctcggcggctgcggcctggacaagtccgagttcaccgtcacggagatctacgagaaggtgcggcggctcgggacctagtacgcgaacgggcgctccgccgggggcgtgccngtgcctgcanctgcaggtgggggctggtgaccgcnaatgaggcccgcaagtacgacctgtcgaggtcgatttgggggcaacctgcccctcaaaaaagtaaggggccagccccgcccccaaacccatggggtaatggggaatgggaatggcaatgccaatgggggttcccgggaaaacggggccccccaaagagggttcaaagaaattcc

SEQ ID NO: 47206 - protein, 110 aa, Zea mays
  misc_feature: Ceres CLONE 1454084-F
MPPPPTSAPHSLAADDFHTSDTAAAAAGAVVPCAASQPGTNGGKKPAFAFGRVWSEADEVRILEGLAAYAAAHGAEPRRSQLHAALGGCGLDKSEFTVTEIYEKVRRLGT

SEQ ID NO: 47207 - DNA, 753 bp, Zea mays
  misc_feature: Ceres CLONE 1454088-F
  misc_feature: Encodes the peptide sequence at SEQ ID NO. 47208
  misc_feature (30)..(30): n is a, c, t, g, unknown, or other
gtgggggtccataaggggccccgggctgcnggagatgcctcaccccgtgatcgaaaaacgtccaaaaaccaaccaaagcacacacacactttgtcggccaccacgccctcctctgcctccgctgacgccgagggcgcccgcagcaaacgcaaaagaggctcgtcggccgcatgcgcatccgacggcagcgaccagcagggcccgtcgtcccactggctgacgccgcgcgcgcagcaggcatactcctccaagctcctccaggcgctgcgcctcgtgcgcggcggcactggcacacccacctgctccgcctccgccccggcggtgcgcgacgcgggattctgtttgatggcctacacagcacgtggacggtcccgctaggagggtaccacccggaaaggaattcacccgctcctggggctccaccacgcgcaccaacactccgccctcgacgcgaagactccactcgagtgggtattgatcaattgaaggagacctgtcagcgggaagggtgggtaggggggttaaggctcttgcctcgcttcgaggggaggaggaggaccctgagggtccctgggctcgggggggaattttccgacctagagcgagactatctagaggttgggtgataagcgtcgggaggggttcataacctccttgccagtgcatataaatatcatgcacctaagacttggatccaggaattggtaagataacgccacctccttccgtatcggagcgccacgctcacccttc

SEQ ID NO: 47208 - protein, 125 aa, Zea mays
  misc_feature: Ceres CLONE 1454088-F
VGVHKGPRAAGDASPRDRKTSKNQPKHTHTLSATTPSSASADAEGARSKRKRGSSAACASDGSDQQGPSSHWLTPRAQQAYSSKLLQALRLVRGGTGTPTCSASAPAVRDAGFCLMAYTARGRSR

SEQ ID NO: 47209 - DNA, 769 bp, Zea mays
  misc_feature: Ceres CLONE 1454101-F
  misc_feature: Encodes the peptide sequence at SEQ ID NO. 47210
  misc_feature (503)..(503): n is a, c, t, g, unknown, or other
  misc_feature (506)..(506): n is a, c, t, g, unknown, or other
  misc_feature (763)..(763): n is a, c, t, g, unknown, or other
ggagctccccgcggtggcggccgctctagaactagtggatcccccgggctgcaggaattcgtctcacccctaatcgaaaaacgtccaaaaaccaaccaaagcacacacacactctgccggccaccacgccctcctctgcctccgctgacgccgagggcgcccgcagcaaacgcaaaagaggctcgtcggccgcatgcgcatccgacggcagcgaccagcagggcccgtcgtcccactggctgacgccgcgcgcgcagcaggcatactcctccaagctcctccaggcgctgcgcctcgtgcgcggcggcactggcacacccacctgctccgcctccgccccggcggtgcgcgacgcggcctaccgcgcgctggccgtggcggcgcggggccggtcgcgctggagccgcgccatcctggcacgcagccgccggcgccgggcgctcctccgcgcgcgccgacctccgcccccgacgccaaggcaccgtcagcggcggcatcatcancancaggacaagcggccggcgggagggctggctggcacgaccaaggtgctggcgcggttggtgccagggtgcaggagcctgttgctgaccgcactactggccgaagtgtccgactacgtcaccgcactggatatgcaggtgcgcgccatgggccagctcacgcacgacctcgcgtcatcatcttcggcgccgacgactgggtcaaacgatgattgctcgccatagctcggctcaggcgctcaactccttctcttggaatnatttgg

SEQ ID NO: 47210 - protein, 30 aa, Zea mays
  misc_feature: Ceres CLONE 1454101-F
MQVRAMGQLTHDLASSSSAPTTGSNDDCSP

SEQ ID NO: 47211 - DNA, 746 bp, Zea mays
  misc_feature: Ceres CLONE 1454102-F
  misc_feature: Encodes the peptide sequence at SEQ ID NO. 47212
  misc_feature (694)..(694): n is a, c, t, g, unknown, or other
ctggagctccccgcggtggcggccgctctagaactagtggatcccccgggctgcaggaattcgtctcacccctaatcgaaaaactatcctaccaggcaccactcgcatcgtgtgctcagtcagatccccgtcccgcatttcctaaggccagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcagctgctcctggcctctaaggtttaagcgcaatgatgttgttgtaagagcaacactcccaagagtgtggcccgcaggggcttcccattgatctcagaggtaaaagggcattcatttgctgggagttgctgatgataatggctatgggatgggcaattgcgaaggcacttgcctgcggctggtgcttaaaattctttgtggggtacatggggtgcccggcaccttaacatatttgagaccaggtctgagggcgtggaaagtttgatgaaatccccgcgaaagcctcccgatggatctcttatggatattgttaaagtctatcccacttgatgctgtctacaattccccctggatgaatgttccctgaagatgtcaaatcgaaccaaangatatgcagggggcatccaactcgaccactaaaaggaagttggtggaatcat

SEQ ID NO: 47212 - protein, 76 aa, Zea mays
  misc_feature: Ceres CLONE 1454102-F
MTASAAAGVQMVAARPCISASPGILTARVAVSRTDCMLSTTATFPKISCSWPLRFKRNDVVVRATLPRVWPAGASH

SEQ ID NO: 47213 - DNA, 747 bp, Zea mays
  misc_feature: Ceres CLONE 1454104-F
  misc_feature: Encodes the peptide sequence at SEQ ID NO. 47214
  misc_feature (584)..(584): n is a, c, t, g, unknown, or other
  misc_feature (616)..(616): n is a, c, t, g, unknown, or other
ggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgtttgagtactatgctaagctgaggagctgcattcacatcatgtggtggagcgcgagggaggcttctttatcggacagcctcacttgtcaccgacgcaatcaggcacccccccaagccgtggactacgctgggtttggcttttggcatgagaacgaccgctgtgnttgtcataagtcatatcgtaactagagaaacnagtagctttataatcacatgtatcaccctcttacgaacctatggatgcgttctggacataggccgaatcaggcccttctaaaaaaaaaaaaaaaaccaaaacctccaggtaccccattccccctaaaagga

SEQ ID NO: 47214 - protein, 71 aa, Zea mays; identical to SEQ ID NO: 46198
  misc_feature: Ceres CLONE 1454104-F

SEQ ID NO: 47215 - DNA, 769 bp, Zea mays
  misc_feature: Ceres CLONE 1454106-F
  misc_feature: Encodes the peptide sequence at SEQ ID NO. 47216
aagctggagctccccgcggtggcggccgctctagaactagtggatcccccgggctgcaggaattcgtctcacccctaatcgaaaaagatgaaatgaaatgaaatgaaaagaaaaggggcattcacaggcgaatcacgccccgggccctgtgagcaggagtaggagtagagcgttgctctgaactttctctctctctctctctctctctctctctctctgaatctgccgtcacgaagaagcttctttacatgcattgtttctgaatttccccgattctctctgcgatggcctccactggcgaagaagggaggaagcagcaattcgcaagtgctgcagatgggaacgcacctctcaagtatccaagcttcaagtctcctcctaagcctagcctcaccgataccgtcatagatgtgtctcctgaggaggaggaggagactgctttccctttgggagaagaagaccgtccactagtccaagacgtgtgtactatctccgtcttacctgacgaaggcaatactgtcccgccgcaatgtacctcccagtttactctcttgagcttcgtcaaggctctgcttccttctaaaaaccagatgttcatcgatgctcagctcaactgtcagaagactcagaaccggatcaatgttcttctgggaggcactgattcctaccagtcttgcgtcgtggacattaacgtcaagaaagggaaacgtggtgaggcccatgacggaggagtcgttggaaatgtcaagtccgagagtgtacatatgca

SEQ ID NO: 47216 - protein, 161 aa, Zea mays
  misc_feature: Ceres CLONE 1454106-F
MASTGEEGRKQQFASAADGNAPLKYPSFKSPPKPSLTDTVIDVSPEEEEETAFPLGEEDRPLVQDVCTISVLPDEGNTVPPQCTSQFTLLSFVKALLPSKNQMFIDAQLNCQKTQNRINVLLGGTDSYQSCVVDINVKKGKRGEAHDGGVVGNVKSESVHM

SEQ ID NO: 47217 - DNA, 784 bp, Zea mays
  misc_feature: Ceres CLONE 1454110-F
  misc_feature: Encodes the peptide sequence at SEQ ID NO. 47218
  misc_feature (585)..(585): n is a, c, t, g, unknown, or other
ggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcatttttttcctaaggaacgtacattgtcatttttggaagcttctgaaagcatggcctgcccgtgaactataaatgtatgattcacccccacccctcctgtttgagtactatgctaagctgaagacctgcctttccctcagggggggaaacgcagggaggcttctttatggaaagcctcctttgtaacccaccaaacagacccccccccaaaccggaaaaaaccggggttggttttgggagaaaaccacccccggggttgcccaanccccccccgaacgggaaaaaaaggggtttttataacacagggtgtccccccccccaaaaaaattgagtcctcttttttaaaggcgaagaaaaccctttctaaaaaaaaaaaaaaaaagaaccccccgggaggcccaccccaccccaaggggggggtatttccccgcccccccgcgggcgtttttaaacaacaggagggg

SEQ ID NO: 47218 - protein, 71 aa, Zea mays; identical to SEQ ID NO: 46198
  misc_feature: Ceres CLONE 1454110-F

SEQ ID NO: 47219 - DNA, 811 bp, Zea mays
  misc_feature: Ceres CLONE 1454111-F
  misc_feature (417)..(417): n is a, c, t, g, unknown, or other
aagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggagaagacgccggtgcggatgaaggcggtggtgtacgcgctgtcagcccttcagcataaggtgatgcccggggctgtggaaggacctcaccccaagatcccccccaangtcaacgagaaatggaatttcgctaaggttcttcataaccccggttggtcggaacctaccaatacccctttgtggtaccaaaaaaaaggaaaaaactttcccccccaataccaaaaaggggaggcccccccaaatttccccccctttggccccaataaaaattttccccgaggggggggaaaaaaacgggaaaggcgtcttttttcgccccgtttaaaaaaaacccctttttccccttcccaaaaaaaaagaggattttttgcccccgaaaaaattttttgggggagacaaaaaataaaaacctttttcccctgttggtttataaaaaaaaaaaatttttcaaaaaaaaaaaaaaaaaaaagggccgcggggggcccctccccccccacaaggg

SEQ ID NO: 47220 - DNA, 750 bp, Zea mays
  misc_feature: Ceres CLONE 1454117-F
  misc_feature: Encodes the peptide sequence at SEQ ID NO. 47221
  misc_feature (386)..(386): n is a, c, t, g, unknown, or other
  misc_feature (574)..(574): n is a, c, t, g, unknown, or other
ggagctccccgcggtggcggccgctctagaactagtggatcccccgggctgcaggaattcgtctcacccctaatcgaaaaaaaaaacccaaaaccctgcgaccccaagataccaaagccagcagcagaagccgatgcccatgcagccgcaggcgccatcgatgaccccggccgccggaatcaccacggagcagatccaaaagtatctggatgagaataagcagcttattttggccattttggaaaatcagaacctaggaaaattggcagaatgtgctcagtatcagtcacaacttcagaagaacctcttgtatctcgctgcaatcgcagatgcccaaccagagactgctgtaagccggcctcagatggcgccgcctggtgcatcgncctgaagtagggcagtacatgtcacaggtgccctatgtcccgccgagcacaccctctacgccacagcagatgctgggagcagcacttcagcaacagcaagctcaattgctaaccttcgtggccccaatggttgctagggcctggcatggttaacggcatggctcaggcctgcaaatcaaaaagctcancctttccccggaatgaacaaccggaggtgggggagatccccgaaacccttgggaataaaacccaaagaaaaaagggggggaaaaaggggggggaacccccctccccaaaaagtttggggaattacaccacccttgggggggaaaaaaatccctttcccccgcaaaccaaaaaaaaa

SEQ ID NO: 47221 - protein, 84 aa, Zea mays
  misc_feature: Ceres CLONE 1454117-F
  misc_feature (13)..(80): Pfam Name: SSXT Pfam Description: SSXT protein (N-terminal region)
MPMQPQAPSMTPAAGITTEQIQKYLDENKQLILAILENQNLGKLAECAQYQSQLQKNLLYLAAIADAQPETAVSRPQMAPPGAS

SEQ ID NO: 47222 - DNA, 665 bp, Zea mays
  misc_feature: Ceres CLONE 1454118-F
  misc_feature: Encodes the peptide sequence at SEQ ID NO. 47223
  misc_feature (402)..(402): n is a, c, t, g, unknown, or other
  misc_feature (472)..(472): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (549)..(549): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
ctggagctccccgcggtggcggccgctctagaactagtggatcccccgggctgcaggaattcgtctcacccctaatcgaaaacttccgctaccaccttcatccatcctggcgtcggtgtcttgccctgccccagcgccgccgctccttcccccaccccgaagcgccgcctcttctgcctccgtcgacggtggtggtgctcctgatcccccgcgtgaactgggccatagagagcaaagagaaggggagcccaccagggcgccagtaaatatatcatcttcatcccggctgccaaattttttgattttccaatccgaattgaaggctcaagggcctggccccctaaataaaaccccccccgcggtccctttggaaaattttgggtccccaatttttttttttanacccccaaaccatttttccacaaaaaaaccccgggggggaaagaaaattaattgtgccaccttggccccncnnnnnnnnnnnnngggggggggaaaccctccttcccaaaaaaaaaacccccccccgaaaaaaattggggataaccnaaaaaacgcgccgttttttccttggaaaaaatttttttaaggaaaaaaaattttttttggtgtgtggggaccaaaaagagggggcccccccccccaccccccccggcgaannnnna

SEQ ID NO: 47223 - protein, 87 aa, Zea mays
  misc_feature: Ceres CLONE 1454118-F
GAPRGGGRSRTSGSPGLQEFVSPLIENFRYHLHPSWRRCLALPQRRRSFPHPEAPPLLPPSTVVVLLIPRVNWAIESKEKGSPPGRQ

SEQ ID NO: 47224 - DNA, 687 bp, Zea mays
  misc_feature: Ceres CLONE 1454120-F
  misc_feature: Pfam Name: ATP-sulfurylase Pfam Description: ATP-sulfurylase
  misc_feature (378)..(378): n is a, c, t, g, unknown, or other
  misc_feature (392)..(392): n is a, c, t, g, unknown, or other
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (398)..(398): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (459)..(459): n is a, c, t, g, unknown, or other
  misc_feature (471)..(471): n is a, c, t, g, unknown, or other
  misc_feature (474)..(474): n is a, c, t, g, unknown, or other
  misc_feature (482)..(482): n is a, c, t, g, unknown, or other
  misc_feature (483)..(483): n is a, c, t, g, unknown, or other
  misc_feature (487)..(487): n is a, c, t, g, unknown, or other
  misc_feature (488)..(488): n is a, c, t, g, unknown, or other
  misc_feature (520)..(520): n is a, c, t, g, unknown, or other
  misc_feature (521)..(521): n is a, c, t, g, unknown, or other
  misc_feature (527)..(527): n is a, c, t, g, unknown, or other
  misc_feature (533)..(533): n is a, c, t, g, unknown, or other
  misc_feature (534)..(534): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (569)..(569): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (651)..(651): n is a, c, t, g, unknown, or other
  misc_feature (665)..(665): n is a, c, t, g, unknown, or other
  misc_feature (667)..(667): n is a, c, t, g, unknown, or other
  misc_feature (676)..(676): n is a, c, t, g, unknown, or other
cgattgggtaccgggccccccctcgagccctgcagtggtaaagggcgttccggcgggaggcggcggaactgccgcaccggctgcgcctcggccgcgtcgacaaggaatgggtccacgtcctcagcgaagggtgggcgagtccgctgcaagggttcatgcgcgagcatgagttcctccaaacacttcattttaatgccatccgcggccaggatggcaaggaattgggttccaaacaattggtccccgtgccccccatcggtgctccttccgtaaggggggaagccccccacggggaaaaggggggctttttcgggcggaaaagaggggccccccccgcggggggggggcggtgttttaaaaaaaaaaaaaaaaaacccnccccccccctcctnntnnantccccccccccgnnntccccccccccccccccccccccccgcggtcgatctactcctacgnattcttcagtgnttntcctcttnntttnnaagaggagaaaaaaacaccgccggggcggagnnccgcgngggcgnncccgcgcgggggggcgcgcgnnnncgggagcaggnacgccagcggattcgggannnnnnnnnccacgcggcagcgnnnnnnnnnnnnnnnnnnnnnntgnnnnnnnnnnnntnnntnatcttttgcggtcntntgccgactncgctgtgcgca

SEQ ID NO: 47225 - DNA, 659 bp, Zea mays
  misc_feature: Ceres CLONE 1454124-F
  misc_feature: Translation starting site: 223
  misc_feature (260)..(260): n is a, c, t, g, unknown, or other
  misc_feature (339)..(339): n is a, c, t, g, unknown, or other
  misc_feature (340)..(340): n is a, c, t, g, unknown, or other
  misc_feature (565)..(565): n is a, c, t, g, unknown, or other
  misc_feature (566)..(566): n is a, c, t, g, unknown, or other
  misc_feature (586)..(586): n is a, c, t, g, unknown, or other
  misc_feature (613)..(613): n is a, c, t, g, unknown, or other
caattgggtacgggccccccctcgagccctgcagtggtaaaggaggagaagctaagctgtcttctaactctctctctcgagttcatagtttttgctcttcctctctcatggtcacaatgcttgcagctagttctctagtgaacagcaacctcgcttgctcatcaaggatatcatcctgttcagacttcacataatagccactcctggcgtcccatacatgctatgaaactccatcagatgcgtgctgtgagctcaatacntataagttgtgctgccactaaacctgcacagactcctgctgaagaagaatggaaagttaagcggcaactgctatcaaannaagcggtacaaagtgtcaatgtgaaggaagcactgcgccttcaaaaggaaacaactttgtcattcttgatgtcaggccagaagcagagtttaaagaggctcatccacctgggcgcatcaatgtacaaatatacagattaatcaaggaatggacagcgtgggatattgcgaggcgtgcagcgtttgcgttcttcggcatatttgctggaaacagaggagaatctgnnttcatacagagtgttgatancaaagttggggaaagatgcaaaaatantggtggcatgctctacaggagggacactgaaccaacgcaaaatttc

SEQ ID NO: 47226 - DNA, 692 bp, Zea mays
  misc_feature: Ceres CLONE 1454136-F
  misc_feature: Encodes the peptide sequence at SEQ ID NO. 47227
attgggtacgggccccccctcgagccactgcagtggtaaagggtgtcatcgccttcccctccccacaagccaaacgcgaataccacccccgtgacttcccgatctccggcgatggccgcgcggcgcctcggatcccccgcatctaggtggctgcgcccgtctgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgaatcgcaccgcatctccctcagggtgacgttgccggtaggaaacggtatgtcttacccccccactgtgttgtccgcgtatttttggctttcgcggcggtctatcttcctccccttcccgcctcgctcctggccttcccaatttctagtctctggtccctctacaatctttcagttctaactcccccctcttccctctccaatcctctacaatccctcccccaccttcccctttttttttgtgtcttcctccgctttttccccttctgatttttttaatctccgtagatataccggccccctcttctcgcgctctcttctttttgcccaccacctcccctcccctcc

SEQ ID NO: 47227 - protein, 137 aa, Zea mays
  misc_feature: Ceres CLONE 1454136-F
MAARRLGSPASRWLRPSALLLLVASALLSAPSPARALRFDLESGHTKCVSDEIKVNAMAVGKYHIVGPDPNSPDAQLPESHRISLRVTLPVGNGMSYPPTVLSAYFWLSRRSIFLPFPPRSWPSQFLVSGPSTIFQF

SEQ ID NO: 47228 - DNA, 658 bp, Zea mays
  misc_feature: Ceres CLONE 1454142-F
  misc_feature: SWISSPROT Homolog: EC 3.6.3.14 H(+)-transporting two-sector ATPase
cgattgggtaccgggccccccctcgagccactgcagtggtaaagggctgtgtcacaattgttggagccgtgtctcctccatgtggtgatttttcacaccctgttacctctgcaaccctgagtattgttcaggtctactggggtttagataaaaagctcactcaaaggaagcatttcccactctgtgaattggttcatttcctattccaaatactccaaggcccttgagtccttttatgagaagattgatcccgatttcattgatattaggacaaaagctcgtgaggtgttgcacagagacgacgatctaaatgaaatcgtgcaggttgctggtaaatatgcgctggcataatctgacatgattactctgaagacagctgagctactgagagaagattatttggtacaaaatgtatttaccccatatgataagtactcgcccattctacaaatccgtttgcatgatgcgcaatgtatattcacttcaacacattggcaaatcgtgctgtggatcgagcagctggtattgatggccaaagataacatagagtgtcataggacaccgtttgggcgatctactttatcgcctagtatgtcacaagttgaggatcctgccgaatgtgaacaactttggtccgcaaatttagagactgtatgaa

SEQ ID NO: 47229 - DNA, 724 bp, Zea mays
  misc_feature: Ceres CLONE 1454145-F
  misc_feature (318)..(318): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (397)..(397): n is a, c, t, g, unknown, or other
  misc_feature (405)..(405): n is a, c, t, g, unknown, or other
  misc_feature (410)..(410): n is a, c, t, g, unknown, or other
  misc_feature (412)..(412): n is a, c, t, g, unknown, or other
  misc_feature (421)..(421): n is a, c, t, g, unknown, or other
  misc_feature (423)..(423): n is a, c, t, g, unknown, or other
  misc_feature (427)..(427): n is a, c, t, g, unknown, or other
  misc_feature (428)..(428): n is a, c, t, g, unknown, or other
  misc_feature (431)..(431): n is a, c, t, g, unknown, or other
  misc_feature (462)..(462): n is a, c, t, g, unknown, or other
  misc_feature (542)..(542): n is a, c, t, g, unknown, or other
  misc_feature (624)..(624): n is a, c, t, g, unknown, or other
tgggtccgggcctccctctagccctgcagtggtaaagggcaggcccaaaaccatcaacctctgtgcagctacaggacagcgtgcttgtgagtggctgttagggtgcttgcgttgcgttgcactgcagaggacactgaccgacggcgaataatccaatatggagggggtgcctttttggagcccatttctcgtgtttgctgttccgcatgaacaacactctttacccccctgagcctttggcttccccttaccattccccaagaacatttcggcattacttttttttatcactctgcgggatgcggggacacccccccntccttttttttttcccttggaattttctcggggaaaaggnnnnnatttttttttccccctccccccccggggtaaaganaagggggnaaatnanaaaaattananaaannaanacccccccccataacatcaaatccctctcanacgtaggcgcgcggcggcgcctcccccccccctcactctcctctccctcccggccgccccgctttctgttgaggtgtctncttcctccccgtcttcttccctctcttctttgttttatacattcgccctctttctgttcttccccgccgcggctgctctccncgacccgccctcagctccctttcactcctcccccttcctcgaaattcttccctcttgcttcggttctctctcccctgccctctctcagtctccccccgcg

SEQ ID NO: 47230 - DNA, 710 bp, Zea mays
  misc_feature: Ceres CLONE 1454151-F
  misc_feature: Translation starting site: 272
  misc_feature (17)..(17): n is a, c, t, g, unknown, or other
  misc_feature (21)..(21): n is a, c, t, g, unknown, or other
  misc_feature (320)..(320): n is a, c, t, g, unknown, or other
  misc_feature (338)..(338): n is a, c, t, g, unknown, or other
  misc_feature (364)..(364): n is a, c, t, g, unknown, or other
  misc_feature (368)..(368): n is a, c, t, g, unknown, or other
  misc_feature (374)..(374): n is a, c, t, g, unknown, or other
  misc_feature (383)..(383): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (431)..(431): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (453)..(453): n is a, c, t, g, unknown, or other
  misc_feature (465)..(465): n is a, c, t, g, unknown, or other
  misc_feature (467)..(467): n is a, c, t, g, unknown, or other
  misc_feature (468)..(468): n is a, c, t, g, unknown, or other
  misc_feature (470)..(470): n is a, c, t, g, unknown, or other
  misc_feature (666)..(666): n is a, c, t, g, unknown, or other
  misc_feature (710)..(710): n is a, c, t, g, unknown, or other
cgattgggtactggggntctntcgagcactgcagtggtaaagatattttgaggcacccggcccagcatcccgtccatatctctctcgctgctctgctccccacggaccacggggcaccaccacaaaccagacgcgacgcacgcgcgcaaaatcatccggcggagccagggcggaggcaagccagagacgcggcacgcgacgcgtgagggcgaggagcagcggcagcgcgggcgcggcgacaccgggaggactgaggaagtcgtagaggaggatgaggagcagagccaggtcgttgggaaaggccgggagatcttccaccncctacgttcaggatgccnctggtgacgacgaccaattgcatatnaggntatccncgtcgatgnatgagacaatctggggggagggttgttgtgtgtttttggggtnnnngntctgggtgggggtaatnnnccnccccccaccctnanngnggggggggggagaggaaggggaggcccttccgcctccaccacacaagacaaaccccccctccaacctttctatagtattttggggtgtggggcgtatggtgcagcatgttttttatactatcccaccttgaacaaggccatgtttcccggccttaaatataatgtggagagggggcgttggggggcgggtcttcanccactccccgctacgcccacctggtgggcggcggggtggcaaan

SEQ ID NO: 47231 - DNA, 752 bp, Zea mays
  misc_feature: Ceres CLONE 1454154-F
  misc_feature (18)..(18): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
tggggtggccaacccacngggtaggggggaggggaattaacttttttttttnnnnnnnccgaatgggtacgggccccccctcgagccctgtttcggtaaaggagcggcatccaccacgggagctcccatcatcggtctatccctccgtgtcaaccccctcctcaaaagttctaattgcatttcatcccctggctggtccgcctggccaccggaaggatccgctcgccggatgaagcccccaatctccttgccctgcggcgagtttatggggttctcgctgtaccccatgaacacgtccacgcggttgctctcgagcacaaggttcttcagaaataagctgaggtcctcctcctgcttcctcggagcccgccccacccatgtcgatcacctcatcaccgacccgctgttgctgcgcggacctagcacccgttcaagtgtgtgggtttgtgttctttgaatttaaaaaataaaacccccggggggtattattgaaaaaaacggactaaggcgaagagagcctataaaaatcagcatgaatgcgaaggcgggaagttttgaactctggggagacgccgctggcccggctggcggggaagaaggttgctctttcaagcgctgaaaggcaccccccaattaacaacggactttctttccggagggtgggttccgaaccgcggggctcctgggtaaattgaaaagaaccgcggacgccaggggggggaaaaagggcgaaccaattttgagtagaccga

SEQ ID NO: 47232 - DNA, 666 bp, Zea mays
  misc_feature: Ceres CLONE 1454160-F
  misc_feature: Encodes the peptide sequence at SEQ ID NO. 47233
cgattgggtccgggccccccctcgagccctgcagtggtaaaggggggccgcagataaaggggctgaccgggtcgctggagccctccgacgacgaggccctgcggccggacgaggaggccggcgtcggcgcggcggaggccgcgccggcggaagcggacgacggcatcgaggtctgctgcttcgacaaccgcggtgtcggccgcagctccgtgctccccaacaaatcctactactcgacggcaatcatggccacggatgccttggccttgatggatcatttggggtggaagaaggctcacgtcttcggccactccatgggtgccatgattgcttgcaagctagctgcgatggcacctcacaggctatgttcgctggcattgcttactgtcaccggaggtggctttcagtgcttcccaaagtagacgcgcagatgctatctcttgcattccgtttcttaagggcaatactccagacgacagagtccttgtggacctggaacacattatgcgaaggaatacttgaggagactgtcaggtcatgtactacaagaatggtcctctatcacgaatatgtgcaggccatatcgtcaacaggcatgcaatcacattgaggttttagagggcaaggtcatgcatgctggactcactacatgactactacggacta

SEQ ID NO: 47233 - protein, 139 aa, Zea mays
  misc_feature: Ceres CLONE 1454160-F
  misc_feature: SWISSPROT Homolog: EC 2.3.1.12 Dihydrolipoyllysine-residue acetyltransferase
IGSGPPLEPCSGKGGPQIKGLTGSLEPSDDEALRPDEEAGVGAAEAAPAEADDGIEVCCFDNRGVGRSSVLPNKSYYSTAIMATDALALMDHLGWKKAHVFGHSMGAMIACKLAAMAPHRLCSLALLTVTGGGFQCFPK

SEQ ID NO: 47234 - DNA, 679 bp, Zea mays
  misc_feature: Ceres CLONE 1454166-F
  misc_feature: Encodes the peptide sequence at SEQ ID NO. 47235
cgattgggtaccgggcccccctcgagccctgcactggtaaaggctgcacggggacgcggccgcctccgtgacgacgcaaccggcgctgcgcccggcgctcctcttcaacggagggggccagtccgtctctctcccgcaccacgactacatcccgagcgcgccgcataagtccgggccgctggccgtccgcgcgcagatcatgcggaccgaagggcgctccggacctcttctcctgggtgtccgactcatgctgcgagagaccctctactccaccatgcgaatggggctgttatacttccttagaaccaggtgtggctgagaaaactgccgcgtcttcccgttggcccgcaagatcttggtcggacctccccccggctgttggggggggggcgggagggagcctgtcaaatacccatggtcgtatgcagaccgaacggcacctgccctttggggaaaacctgaaccaccgtgggggtcggaaacccttcggccgcaatggaacgaaataaggtttcccctcgctttggggggcgggttccacttgaaccttcccctgagccccatacctctcgggcgtcttggtggggtccgtctttatttgtggcgaaggaggccctctcgggtcctcccgaggattcggggcccccaagggggtcctcctccgctaccaggccccctt

SEQ ID NO: 47235 - protein, 39 aa, Zea mays
  misc_feature: Ceres CLONE 1454166-F
MRTEGRSGPLLLGVRLMLRETLYSTMRMGLLYFLRTRCG

SEQ ID NO: 47236 - DNA, 655 bp, Zea mays
  misc_feature: Ceres CLONE 1454169-F
  misc_feature: Translation starting site: 117
  misc_feature: SWISSPROT Homolog: EC 2.1.1.104 Caffeoyl-CoA O-methyltransferase
  misc_feature (502)..(502): n is a, c, t, g, unknown, or other
  misc_feature (545)..(545): n is a, c, t, g, unknown, or other
ggggcccccccctcgagccactgcagtggtaaagggaaggaccttagcagagctcaagtacctgcgccggccagctatagacaagaggcggcttggagaggcaggcaccatcatccatggcgccctccggtgacaccattgccctcgtccacagcggcatggacagcagcaacaagacgctgctcaagagcgaggccctctacaagtatgtcctcgacacgtcggtgctgccgcacgagccagagtgcatgcgtgagctgcgcctcgtgaccgacaagcacgagtgggggttcatgcagtcgtcgcccgacgaggcgcagctgctgcggatgctcatcaagctcaccggcgcgcgccgcaccctggaggtgggcgtgtacacgggctactcgctgctgggcacggcgctggcgctccccgacgacggcaaggtcatcgccttcgacgtgaaccgcgactactacgacatcggccgccccttcatcgagcgcgccggcgtggncggcaaggtcgacttccgcgagggccccgcgctgggcacctgnacgagctcctcgccgacgaagccacctcggcgtcttcgacttcgccttcgtcgacgccgacaagcccaactacgtcaataccacgagcagctgctccggctggtgcgcgt

SEQ ID NO: 47237 - DNA, 665 bp, Zea mays
  misc_feature: Ceres CLONE 1454170-F
  misc_feature: Translation starting site: 267
  misc_feature (419)..(419): n is a, c, t, g, unknown, or other
cgattgggtaccgggccccccctcgagccctgcagtggtaaaggagtctttcaaactgatgaaccctagggccatcactcggcaacggcggtgcgccaccggcgacggtatcatcggattcactcccctccttccccggcgcggcggcgccctgcacctaggccctaacactgcagaactcgacaacaggatcagcggtcgcgcccccctcctccttccccggcgcggcggcgccctgcagatctgccactgtccgcctgccggtcatggagcacctccggtggcgccccacagtgaacgagcgcgacttcattgagtgtgcgctccaatctgacctccgtgttgactgccgccactcctttgacttcctcaagctcaagatcaccttcggcagggaggatggctcggcagaggtgcanctcggagagacacacgtgatgggctacttgacagtgcagctggtgcatccataccgtgacaggccctaatgaggggacgctggccatattcgccgagttctcacccatggccgaaccctcctttgagcctgggccgtcctggggaaattatcaatttgagctttggcccaagttaattgaaccgtgggccctcaaggaacagtccaaccctgtttgaacttgggattcccttgacgggcctgttta

SEQ ID NO: 47238 - DNA, 797 bp, Zea mays
  misc_feature: Ceres CLONE 1454172-F
  misc_feature: Encodes the peptide sequence at SEQ ID NO. 47239
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (20)..(20): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gaagaataagncnncgcctntaacttttacaaatantcaccnnnnnnnnccgaatgggtacgggccccccctcgagccactgcagtggtaaaggtacccctttaccactgcagtggtaaaaaaaaaaccttgacaagaacgaattcgcctccggctctcctcttctcgagcgttttcggcaccacggggcagtaggatggcggcggcggccccgacgagagcagaggtgctgtcgctcttccgttccttactccgcacggcgaagaagttctcggactacaacatccgcgagtacacgcgccgacgcgccgcggactccttccgcgaaaaccgcgccctcgccgatgcgtcggccgccgccgcggcgttctcggaggggaagaagcaactagaggttgcgaagcggcaaagggaggtttactctctctacgcccccaaggccaagagcgtgatggagttgaaggtgtaccccaccgctgcgaccttttcttccccaccggtcccgtttccaaatttgattgcttttggtgtgaggcatgaacactaaaaacctggctccgtttggccacattttaccgggatgattggtcatggaccttagatttattctccccgtgcagcccccattagcaagaccccctaccgcccaaaagtatagaaacccacaatgccaggaagcttctggggaaattcccggggcaaccccgggggggaactcccccaagttttccaaagcgcgtggtttatcaaattgagcggggtgagaagtctttccaccttttgtgtggttccccccc

SEQ ID NO: 47239 - protein, 116 aa, Zea mays
  misc_feature: Ceres CLONE 1454172-F
  misc_feature (6)..(70): Pfam Name: Complex1_LYR Pfam Description: Complex 1 protein (LYR family)
MAAAAPTRAEVLSLFRSLLRTAKKFSDYNIREYTRRRAADSFRENRALADASAAAAAFSEGKKQLEVAKRQREVYSLYAPKAKSVMELKVYPTAATFSSPPVPFPNLIAFGVRHEH

SEQ ID NO: 47240 - DNA, 686 bp, Zea mays
  misc_feature: Ceres CLONE 1454173-F
  misc_feature: Encodes the peptide sequence at SEQ ID NO. 47241
tggagctccccgcggtggcggccgctctagtcctagtggatcccccgggctgcaggaattcccacgagaccattacctagaacatcctaatcgaaaactaaaccaacagcacatcttaataatgcaaaggaacgggccaatagacatgaggtacaatgctttgatgaggatttgggaaaatacgaggtaagaacgatgggtggcacaacatccgacggtgaggtgcggccttcgaggacacatgttgtgttacttgatgcattttcgtgtggttgtggtaaacctagacagtaccactttccatgttctcattatgttgccgccgcacgtcatcgtaactttgcatttgagagcatgatcccttcagagttcagtgtggagagcttagtacgtacttggagccctcgttttgagccatttcttgacgagtcacagtggccaacgtacaccggtccgatatacattgctgatccagcgcatcgctgggacaaatgtggtactaggaaaaggagccgatgcaacatggttatgcggaccttatgatgaaaactttgtaatgtggaccttgtgatgtcaactttgtgatgtggactatgtattgtggactatgttatgtggaccttgtattaaggactatgttatgtggactttgtgaaaaaaaaaaaaaaaaagcttatcgataccgt

SEQ ID NO: 47241 - protein, 115 aa, Zea mays
  misc_feature: Ceres CLONE 1454173-F
MGGTTSDGEVRPSRTHVVLLDAFSCGCGKPRQYHFPCSHYVAAARHRNFAFESMIPSEFSVESLVRTWSPRFEPFLDESQWPTYTGPIYIADPAHRWDKCGTRKRSRCNMVMRTL

SEQ ID NO: 47242 - DNA, 1033 bp, Zea mays
  misc_feature: Ceres CLONE 1454175
  misc_feature: Encodes the peptide sequence at SEQ ID NO. 47243
acgcacaccaaattccccatctccccgtccccgtagcacgcgcgtccttctgccttcgccatggcctctgcacccactccgccgcccctcctcccggtgacaaaccccgcacccggatcgtccccggccgccgccggaggctccgacgcgccgatcgcgacgccggctttccggctcttcctgagccggctctccgactcggcgcggcgctcgctgtccgatcgccggccgtggggagagctcctcgaccggtcggcgttctcgaagccggactctctctccgacgccacctcccgtctgcgccgcaacctcgcctacttccgcgtcaactacgccgccgtggtcgccttcgcgctgggggcctcgctgctggcgcaccctttctcgctcctcatcctcctgggcctcctcgccgcctggtgcttcctctacctcttccgcgcgtccgaccagcctgtcgccctcttcggccgagccttctccgaccgcgagacgctgctggggctcgtcggcgcgtccttcgtcctgctgttcttcacctccgtcgcgtcgctcatcatctccgggctgctcgtcggcggggccctcgtcgcggcgcacggcgcgttccgcgtgcccgaggacctcttcctcgacgagcccaacgcggcccccggcaacagcgcggcccaagggctgctttcattccttggcgcacccggatctggggtttgaggcggcggacggcaagatctggtagggtccttgggctcgactagttcgtattaagctggaaattttgtggatctagtcttgtagctgtagcttattgcttgccctgttcctcttcatgtacctacagatctactggcttagtgctggtttcgattgatgcaccggcttctgcgaagatcagcaaattcatcgagattttaacatatggagcttagtgccaagtatacgagtttgtggtgtcagactttcaatatggattgtatcttcattcgcgagcattgatgatacgttaatatgcttcattcaaaaaaaaaaaaaa

SEQ ID NO: 47243 - protein, 217 aa, Zea mays
  misc_feature: Ceres CLONE 1454175
  misc_feature (47)..(200): Pfam Name: PRA1 Pfam Description: PRA1 family protein
MASAPTPPPLLPVTNPAPGSSPAAAGGSDAPIATPAFRLFLSRLSDSARRSLSDRRPWGELLDRSAFSKPDSLSDATSRLRRNLAYFRVNYAAVVAFALGASLLAHPFSLLILLGLLAAWCFLYLFRASDQPVALFGRAFSDRETLLGLVGASFVLLFFTSVASLIISGLLVGGALVAAHGAFRVPEDLFLDEPNAAPGNSAAQGLLSFLGAPGSGV

SEQ ID NO: 47244 - DNA, 663 bp, Zea mays
  misc_feature: Ceres CLONE 1454176-F
  misc_feature: Encodes the peptide sequence at SEQ ID NO. 47245
  misc_feature (585)..(585): n is a, c, t, g, unknown, or other
  misc_feature (663)..(663): n is a, c, t, g, unknown, or other
tgggaccgggccccccctcgagccactgcagtggtaaagggacccagctccggttgctcatccggccatcccatccgcctctccttgataaactccgtggtccgcagccaccgagccgagcccggcacagacactactggcacgcacgcaccagcaccagcaccacaccacatgaatggtggagcctagcacgggcagctagctcccggccggcgacgtgacgaccaccaccactacatgttgcatgagcagcaggcaccgccaccggcagtagcagcgccaccgccatccatcaaccccgacgacgacggcggccgcgatgtcgaggtcaccacgttccgcgacatccaccctctgacgcccgacgcgccgccgcccgcctccgcgtcctgggacacggccagccaccgctccttgtcgtcgtccgacgaccagcagtacatgacgatgagccgcgagttcacggccatggtcgccgccggggcgaccatgcagcccggcggctacgacggcgccgccgaccagctcaccagcatcggcgaagacgagctggaggagaccatccgctggtcatcgtcccgacangcaccccatcgccacgcccgccaggtcccaggcgtccgggctgaaggtcgtgcccgcgggcccggggccgcaaccgcn

SEQ ID NO: 47245 - protein, 142 aa, Zea mays
  misc_feature: Ceres CLONE 1454176-F
  misc_feature (116)..(116): Xaa is any aa, unknown, or other
MLHEQQAPPPAVAAPPPSINPDDDGGRDVEVTTFRDIHPLTPDAPPPASASWDTASHRSLSSSDDQQYMTMSREFTAMVAAGATMQPGGYDGAADQLTSIGEDELEETIRWSSSRXAPHRHARQVPGVRAEGRARGPGAATA

SEQ ID NO: 47246 - DNA, 738 bp, Zea mays
  misc_feature: Ceres CLONE 1454191-F
  misc_feature: Encodes the peptide sequence at SEQ ID NO. 47247
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
ccttttccttccctccccacttcccctacagtttnnnnnnttttttnttttaaagctggagctccccgcggtggcggccgctcttttactagtggatcccccgggctgcaggaattcgcacgagaccattacctagaacatcctaatcgaaaaaactattcccctttggccgtcggcgcgcggaggcaggggtggcgtacggcggcggcggcaaccatgaacatcaacgcgaacggcggcatcctgtcgtacgggaacatggaggggtacgcccgttgggtggccacgggcgtggcgtcggccttcttcgcgtccctggagcgcttctcctgcatccacctccacaccgccgaggacgacggcagcgacgaggaccccgacgaggccaaggaccgccccctcatcttctccagccccgacgccctccccgagtactactacaagccgttccgcatcctccgtctccttccccaagatgtgacatgcatgatctgatctgagacgagatcgcgcgcggtgccgtcgtcgtctgtgcgccaaacgatccgatccggccgtctcctcataggttaggttggtcatgtcttgcaaattgcgaaattgtattgtatccgcacgattccccggcgcgtttgtgttcttgccatggcctgccctcctgtccgatttgggcgtccttctgatctgatggatttgtaattacgcacctgcgctgtagggtgcggattagcctggttt

SEQ ID NO: 47247 - protein, 92 aa, Zea mays
  misc_feature: Ceres CLONE 1454191-F
MNINANGGILSYGNMEGYARWVATGVASAFFASLERFSCIHLHTAEDDGSDEDPDEAKDRPLIFSSPDALPEYYYKPFRILRLLPQDVTCMI

SEQ ID NO: 47248 - DNA, 664 bp, Zea mays
  misc_feature: Ceres CLONE 1454195-F
  misc_feature: Encodes the peptide sequence at SEQ ID NO. 47249
caattgggtaccgggccccccctcgagccactgcagtggtaaaggagcaacatctcaagctcagagcctcagagcgccagccaagtcttgcggtcccgaagagcaacgcaacacaagatggtgaaggtcgcattcggaagcgtcggtgactccttcagcaccacctccatcaaggcctacgtgggcgagttcatcgccaccctcctcttcgtcttcgccggcgtgggttccgccatcgccttcgggcaactgacgaatggcggcgcgctggaccctgcgggtctggtggcgatcgcggtggcgcacgcgctggccctcttcgtgggcgtctccgtggccgcgaacacctccggcggccacctgaaccccgccgtgacgttcggcctggccgtgggcggccacatcaccgtcctcaccggcctcttctactgggtggcccagctgctgggcgcgtccgtggcgtgcctgctcctcaggttcgtgacccacggaaggccatcccgaaccacggcgtctccggcggccaccacgaagctggagggcgtcgtgttcgagatcgtcatcccctttcgcgctcgtctaaaccctggtacgccaccggcccccaaccccaaaaaagggttcccttcggaaccatcgggccccatcgccattcgggtttcat

SEQ ID NO: 47249 - protein, 182 aa, Zea mays
  misc_feature: Ceres CLONE 1454195-F
  misc_feature (11)..(171): Pfam Name: MIP Pfam Description: Major intrinsic protein
MVKVAFGSVGDSFSTTSIKAYVGEFIATLLFVFAGVGSAIAFGQLTNGGALDPAGLVAIAVAHALALFVGVSVAANTSGGHLNPAVTFGLAVGGHITVLTGLFYWVAQLLGASVACLLLRFVTHGRPSRTTASPAATTKLEGVVFEIVIPFRARLNPGTPPAPNPKKGFPSEPSGPIAIRVS

SEQ ID NO: 47250 - DNA, 664 bp, Zea mays
  misc_feature: Ceres CLONE 1454200-F
  misc_feature: Encodes the peptide sequence at SEQ ID NO. 47251
  misc_feature (553)..(553): n is a, c, t, g, unknown, or other
  misc_feature (594)..(594): n is a, c, t, g, unknown, or other
  misc_feature (606)..(606): n is a, c, t, g, unknown, or other
  misc_feature (614)..(614): n is a, c, t, g, unknown, or other
cgattgggtaccgggccccccctcgagccactgcagtggtaaagggttcttgcagtggtaaaggagtctaaaaaaaaccgtatcgtctcgcctgttcagtttccttctcctcttcccgcagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgcttcggcggcctgccgctcgacgtcctcgccttcgtcgaccgcaaggtggacgacacggtgcacgaggtggacaagcacctcccgggcgcgctgaaggcggcgtcggcgcatgtctancgcgtggtttcgggcgtgcccgaggtggcgcgcgagctggncgccgagcgcancggtcggncgtgaagggcgcagcccgtgcggcgctcgcgatgacggagccggtggcgc

SEQ ID NO: 47251 - protein, 142 aa, Zea mays
  misc_feature: Ceres CLONE 1454200-F
  misc_feature (19)..(139): Pfam Name: REF Pfam Description: Rubber elongation factor protein (REF)
  misc_feature (122)..(122): Xaa is any aa, unknown, or other
  misc_feature (136)..(136): Xaa is any aa, unknown, or other
  misc_feature (140)..(140): Xaa is any aa, unknown, or other
MAEEQSNPQHQQAEEREVMVEQQQPRRAPKLRYLDFVQVAAAQAAVCLAGLYGLAKDHAGPLRPSVDAVESAVKGVVSPVYDRFGGLPLDVLAFVDRKVDDTVHEVDKHLPGALKAASAHVXRVVSGVPEVARELXAERXGR

SEQ ID NO: 47252 - DNA, 653 bp, Zea mays
  misc_feature: Ceres CLONE 1454206-F
  misc_feature: Encodes the peptide sequence at SEQ ID NO. 47253
tcgagccctgtagtggtaaaggaggcgctttaccactgcagacctcgcccgaaatcgccgagagcctcccctcagtttacgccgcacgaaccgacgcactagaccgacccgcgaatcccccgcgcgcgcgccgtgcggtcaccgtccgaggccacggcaccgccggcccccgcccccgccccggccgccaagagcaaaggcaaggccgacgcttcctcctcgtcgtcctcctcctccactccaccgaggtcgcgccgcgcgcttgccgtcgtgatggccgcgtcgctgctcgtgctcgccgtggcgttcttggttggctctggctccggggggatcgatgggggcgcagcggctcccgtcgaggtggagggcaccgaggtggcctacggtagtgtgatcaagctgatgcacgagaagacgaagcaccgtctgcactcgcacgatgtgccctacggctcaagcagcggtcagcagtctgtcaccgggtttcctgaaggttatgactccaatagctactggatcataaggcccactccaaattcatcgtctaggcacggtgatgccatcgaaactggtggcatcttttggttgcaacacatgaggacacggaggggggttgcacagtcccctgcacgcttccccgtttttttgtg

SEQ ID NO: 47253 - protein, 126 aa, Zea mays
  misc_feature: Ceres CLONE 1454206-F
  misc_feature: SWISSPROT Homolog: EC 2.4.1.109 Dolichyl-phosphate-mannose--protein mannosyltransferase
MAASLLVLAVAFLVGSGSGGIDGGAAAPVEVEGTEVAYGSVIKLMHEKTKHRLHSHDVPYGSSSGQQSVTGFPEGYDSNSYWIIRPTPNSSSRHGDAIETGGIFWLQHMRTRRGVAQSPARFPVFL

SEQ ID NO: 47254 - DNA, 709 bp, Zea mays
  misc_feature: Ceres CLONE 1454211-F
  misc_feature: Encodes the peptide sequence at SEQ ID NO. 47255
caaagctggagctccccgcggtggcggccgctctagaactagtggatcccccgggctgcaggaattcgcacgagaccattacctagaacatcctaatcgaaaaagggcgcttctctaggcagtagtgaggtgagtgagagagactgaggaggcatgtgaccctcttcactcgcttcaccctgttcatcactcgcttgtacaagaagtcacgcaccaaacgggcaagggcaaacaccaccaaagaaggcgagaacgcactccgtccctctcctccaggaccgcccgctcttatcccgtttctcccttctctgggctcggagaatcggagatggcgtccagcgcctctcggttcatcaattgcgtcacggtcggcgacggtgccgtgggcaagacatgtatgctcatctgctacaccaccaacaagttccccactgattacatacccacggtgttcgacaatttcagtggcaatgccgttgtggatggcacctacgtgaaatttgggcctgtgggattcccgcacggctagaacattacaaccgactgagggctccaagcctaccggggtgcaaatggtttccgggctttgcttctccaccttgggaatccagccctccttttgaaaaacccttgaaaaaaggggaattccgcgaccctcccccatttttgcaccttggggggggccttgttttggcctggcaaggccaaa

SEQ ID NO: 47255 - protein, 66 aa, Zea mays
  misc_feature: Ceres CLONE 1454211-F
MASSASRFINCVTVGDGAVGKTCMLICYTTNKFPTDYIPTVFDNFSGNAVVDGTYVKFGPVGFPHG

SEQ ID NO: 47256 - DNA, 682 bp, Zea mays
  misc_feature: Ceres CLONE 1454215-F
  misc_feature: Encodes the peptide sequence at SEQ ID NO. 47257
caattgggtaccgggccccccctcgagccactgcagtggtaaaggtaggctctggcgcggcaagttctccctccatccatgcggatctgaattaggggtgtccgtttctccgtgcacatatcgaatacgtacggctcggcatggacaatatccgagtctgtgctgccgacgcgccgccggcaggagcagtggctgaccgatctcatggacaaggacctcaccgacatgaagagcgcgctcgagatccgcaagatcatcttcgaccgcggcaagcaatacgctgatcagtaccctgaccaagataacgagcttgcgcctctcaagcgtgaggcccgattagaagttgccctctatgatgagcccggaggcacatcttctgtttgtgggtggcatccgtggtatcgctgctctgccccacgtgacccgcaagattttgacaactctctgccattgacgcatatcttccacgctctcttcctcagagttaacaaagcaaccattactatgctgcgcatgtggtcaccatatgttgcataccgatatcactacctgaaaactgctaggcatctgatctacaatatacgatgcgggaatctgaacatcttaacgattccatctagcaccgactgtgccatctcatagggcctcgggaatcatatatcatctgcattgaggaccttgg

SEQ ID NO: 47257 - protein, 145 aa, Zea mays
  misc_feature: Ceres CLONE 1454215-F
MDKDLTDMKSALEIRKIIFDRGKQYADQYPDQDNELAPLKREARLEVALYDEPGGTSSVCGWHPWYRCSAPRDPQDFDNSLPLTHIFHALFLRVNKATITMLRMWSPYVAYRYHYLKTARHLIYNIRCGNLNILTIPSSTDCAIS

SEQ ID NO: 47258 - DNA, 576 bp, Zea mays
  misc_feature: Ceres CLONE 1454222-F
  misc_feature (160)..(160): n is a, c, t, g, unknown, or other
  misc_feature (173)..(173): n is a, c, t, g, unknown, or other
  misc_feature (174)..(174): n is a, c, t, g, unknown, or other
  misc_feature (180)..(180): n is a, c, t, g, unknown, or other
  misc_feature (186)..(186): n is a, c, t, g, unknown, or other
  misc_feature (195)..(195): n is a, c, t, g, unknown, or other
  misc_feature (515)..(515): n is a, c, t, g, unknown, or other
  misc_feature (524)..(524): n is a, c, t, g, unknown, or other
  misc_feature (544)..(544): n is a, c, t, g, unknown, or other
cgggccccccctcgagcactgcatggtaaagggctgcctctccggcgccattgacgagcaagagagtgctccgacacctggtccgtcgcgtgccgtgcccacccgctaaggccagggcgccccgactcgagctcaccgcgtcgaactcgaaccgctgctngtccctcgcaggnngcaggntcgtcnaagatgccngacactcaaaaacgcggcggcggaactgatgggcacatcatggaaaccatccggaaaaactccccaagcaaaaattccggggggttaagaaaggggaaaaggtcctcccttttcccaaaaaagggccaaaaaaaaattgttttcccggggggggggaaaaaaccggaaaaaaaacccttggccccccccccccgggggggggggggggggggggggaaaaattaccccccccccacaaattttttttttttttttggggagggaaaaaaaaaaaaaaaaaaaatttttttcccccccccccccctttttttttgttttgnggggggggncaaaaaacacaccccccccnggggggggggggggggggggggggtgtcctct

SEQ ID NO: 47259 - DNA, 770 bp, Zea mays
  misc_feature: Ceres CLONE 1454227-F
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (516)..(516): n is a, c, t, g, unknown, or other
  misc_feature (569)..(569): n is a, c, t, g, unknown, or other
  misc_feature (613)..(613): n is a, c, t, g, unknown, or other
  misc_feature (658)..(658): n is a, c, t, g, unknown, or other
  misc_feature (659)..(659): n is a, c, t, g, unknown, or other
  misc_feature (732)..(732): n is a, c, t, g, unknown, or other
ttaattttttttttataatttagctaagagacccgggggnnnnctccttccctaaaatcgaatgggtacaggccccccctcgagccctgttgtggtaagggagaggcgtcctcagcgacggaccgggcccaagttctctgtaaagggacgcctgggagggtgagagccccgtccggaccggaccctgtcgcaccaccaggcgccgtccacgaaccggattgtttgggaatgcagcccaaatcgggcggcaaactccgtccaaggttaattatatgtgagatatcgaatagctaacaagtaccccgaggcaaagatgaaaaggactttgaaaagagagtcaaagagtgcttgatcccgccgcggccgcctcagccgctactcctccctgtccctctagggctgacctgccactccttcgtatcgagcaatcggaggcgtgtcctttttgccctccaattttatgggagcagggggcccccccccccaatcccagcttgttgccccctctgttgtatnggcctttaccgcctgccgtcgtaattattgttctacttctaataaaaagaccncttatccgtgtacactccacgatacacaatggccgtgggccctncccaacaagtattggccctttcccctctacaacctatattaaggnnctgtttcggaccccccacccccccccacgagtttattattgttacatctcctgactaacctgatccctcccanacattggatggggacgggacgcttcaaattcataatca

SEQ ID NO: 47260 - DNA, 672 bp, Zea mays
  misc_feature: Ceres CLONE 1454233-F
  misc_feature: Encodes the peptide sequence at SEQ ID NO. 47261
  misc_feature (623)..(623): n is a, c, t, g, unknown, or other
  misc_feature (634)..(634): n is a, c, t, g, unknown, or other
cgattgggtaccgggccccccctcgagccactgcagtggtaaagggtttgtccgtcagcgcaactcaggcaaacaacggaacggaaaccccggccgtcactgcgccagagctggagacagagatcatggtgcgggcatgggggcggcggacggcgctgcctccgctcctcatccttggcctcctccgcctgcactactcctcgctggtcgtcgcccaagaaggacaagaaaaagaccctgctactttgttcgcacaagcctcagggatgatggacctgaggaagtatgatggggcgcttggcctgctaaatgctgtgttggaaattgacccaaatcattctgaggcttataggcagcgtgcatccgtgcttcggcataaatgcagatacgaggaagctgagagggactataacaaacacctggagctaagtcctgggtctgcttcagtggtgaaggaattatcccagcttctgcaggctcaaaattcattacaatctgcttatggccaattcgattctggagacttctcaaaagtcgtggaatacatcaacaaaattgtgctggttttttctccaggttgcttaaaggcaaagcttctcaaggctaaagcattgctagcactngaagactactncagtgttatttcagagaccggattcattctaaaggaag

SEQ ID NO: 47261 - protein, 182 aa, Zea mays
  misc_feature: Ceres CLONE 1454233-F
  misc_feature (38)..(71): Pfam Name: TPR_2 Pfam Description: Tetratricopeptide repeat
  misc_feature (72)..(105): Pfam Name: TPR_2 Pfam Description: Tetratricopeptide repeat
  misc_feature (170)..(170): Xaa is any aa, unknown, or other
MVRAWGRRTALPPLLILGLLRLHYSSLVVAQEGQEKDPATLFAQASGMMDLRKYDGALGLLNAVLEIDPNHSEAYRQRASVLRHKCRYEEAERDYNKHLELSPGSASVVKELSQLLQAQNSLQSAYGQFDSGDFSKVVEYINKIVLVFSPGCLKAKLLKAKALLALEDYXSVISETGFILKE

SEQ ID NO: 47262 - DNA, 817 bp, Zea mays
  misc_feature: Ceres CLONE 1454237-F
  misc_feature (38)..(38): n is a, c, t, g, unknown, or other
  misc_feature (39)..(39): n is a, c, t, g, unknown, or other
  misc_feature (586)..(586): n is a, c, t, g, unknown, or other
cctattttccccccctcccactccccaccagagttttnncctttccccttaaagctggagctcaccgcggtggcggccgctctttactagtggatcccccgggctgcaggaattcgcacgagaccattacctagaacatcctaatcgaaaagaacaaccgggaccgggcaattcgtccagcagcaaggacgcgcctccgccctcgcagcaggacgatggtggtccggagcccgcctcgaccttggcttctgctccctctccggcgccaacagccaacccacccacttccgccgacgccggcggacccgccccggactccgccttcgccaacccttgcccgaacctaggtaccgtcgcaaaccctgctcagaccctataggctcctgggcccatctccgccgccgcggggccgtggtcggcgtcgaatgagaatgccttacacacacctggccgctccctttttgattgccgtctttctcctctgcttgccaagccgcggtttcctcgggtttccgttccggtcgcagttttcctcggctcctcctattccatgtcgcacgggttggcctgggttgtggcctcgtcnctctcccgttttttcccgccgtgggttttttgtggggctttaaacaggcggcttccgtcttggcccatctgttccgcggtcgttggttgggtggggtttctatccttgtccccctttttttctgccgcacacttgttttttgaggaggctgtttccccggcgggaaatacataattaattgtggggaaaggttttggaagagagcgtcggcgcaccttgccccgataatat

SEQ ID NO: 47263 - DNA, 763 bp, Zea mays
  misc_feature: Ceres CLONE 1454244-F
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tcttctccttcctctttctctttctcgtgtcgtcacttttcttttnnnnnnnttcaagctggagctccaccgcggtggcggccgctctataactagtggatcccccgggctgcaggaattcgcacgagaccattacctagaacatcctaatcgaaaaacagccgttgcctttgccgctagcgaccgtagcgaggtgattgcaatgggggcctccactgcttcccgcgtctagcccccgggcttcagcaccccttccccgtctcttcatcctccaaactgccgctcgcgcttctcccctgttcgcgcagccaacttggaagctgtgctgtctattggtgctcatctagtcccacccccaacacaggctgcaagtggcggaaaagatgctttctttgccgatagcaatgctggcggaggatttggcattgtagatggcgtctcagaaggggcccaatagaatgtctatccacctcttctctctcgacagctcacgagaaacagctctaatctcctcaatgatgaggcggtccgccttgatcctcacattcgcctcatgaaagctcgtgctggcaacttcttctattgcatctgacacagtattcatcccggtggcttagatatgaccgggactctgatattttgccagtgcggccacactggggcgtcgaaaatttttcctaaaggcgcaagtatgggtcactacattccccatcaaaaacctttttttctgactgccccttacccgtataagcttcacgaggcg

SEQ ID NO: 47264 - DNA, 675 bp, Zea mays
  misc_feature: Ceres CLONE 1454247-F
  misc_feature: Translation starting site: 231
  misc_feature: SWISSPROT Homolog: EC 2.5.1.18 Glutathione transferase
gctcttaactagtggatcccccgggctgcaggaattcgcacgagaccattacctagaacatcctaatcgaaaaaatacatacgcgcgcacgctacagagcagagtcttgctccctctcctgcctgtaaagcatccatcacgtgaagttcacaggacaaacatgtctccggtgaaggtgttcgggcacccgatgttgacaaacgtcgcacgggtgctgctcttcctgcaggatgtcggcgctgactacgagctcaagaccctctacttcggtagccggcgagcacaagaggccccaacacgtccagttaaacccgtatgcgaagatgcctgggttccaagatggggatctcgtcctgttcaagtcgcgcgccatcacccagtacatcctccgcaagtacggggggacagccggcctggacctcctcggagaaaaccgtggaatccaaaaattagcaatggtcgacatgtggacagaggtggaggcccagcagtactacccagccatctcgccggcggtgttcaagtgcatcatcattaccttcatcatacctggaggtggcacggcgccaaaacggagcgtcttggacgatatcctagaccggctgaggggtgtactgggaaatctacaaggcccagctggaaaagaccatctacttggacagggactccctcggc

SEQ ID NO: 47265 - DNA, 706 bp, Zea mays
  misc_feature: Ceres CLONE 1454252-F
  misc_feature (706)..(706): n is a, c, t, g, unknown, or other
cgattgggtaccgggccccccctcgagccactgcagtggtaaagggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtcttacgaccgcttcggcggcctgccgctcgacgtcctcgccttcgtcgaccgcaaggtggacgacacggtgcacgaggtggacaagcacctcccgggcgcgctgaaggcggcgtcggctcatgtctacccggtggttcggggcgtgccggaagtgggcgcgcgagctggctggccgacgcgcaacggtcgggccgtgagggggcccaaccccgtgcgggcgctccccgatgacggaacctggtggcccggaaacgtgtaacggccgccctgaaaccccgtggacccagggacttttactgtgggtgtactaaacccggcggccggaaacccctggggccgtcctcccccctgggcggctccccttaaacgggcactgtccgggggattccccggaacgggccccgagaaaaaatctttccctgggccn

SEQ ID NO: 47266 - DNA, 701 bp, Zea mays
  misc_feature: Ceres CLONE 1454253-F
  misc_feature: Translation starting site: 50
  misc_feature (401)..(401): n is a, c, t, g, unknown, or other
  misc_feature (701)..(701): n is a, c, t, g, unknown, or other
cgattgggtacgggccccccctcgagccctgcagtggtaaagggagggcatgctggcccacgacgccggccgcggcgtgttcgactcgggccgcgaccccggattcctggatgtgctcgaccaacacccggagaacgccgaccgcgtccgcaacatggtctccatcctccgccgcgggcccatcgcgcacttcctctcctggcactcgggccgccctgcccacgcctccgagctcctctccttccactcctcagaatacatagaggagctcgtccagacgaacgccaccggagccaagaagaagctctgtgagggcacgttcttgaacccgggctcctggggtgcggcgcttctagcggccgggaccacgctctcctccgcgaagcacatactagacgggnagggggaacctgggcaacccgttgggttcgccccccctggcaccacgcgcagcccgaacacgccgagggctactggtttttctgaacatgcccggatttgctgggcccctgggttctgggattccgggtcgccccaaaggtcccccgtttgtggaaaattgagcgcggacttacaggcaagggggccccccggaaagggctttcttaccggaacagaacccccgggcttaacaccaaggtcgtcccccaacaagaaaggattggggcccccttgtgggggccacattccgcatcccgccn

SEQ ID NO: 47267 - DNA, 651 bp, Zea mays
  misc_feature: Ceres CLONE 1454255-F
  misc_feature: Encodes the peptide sequence at SEQ ID NO. 47268
tcgagccctgtggtggtataggactcacgaacgcgcgaattcaccaaccaaactccactgtctcctactctccttcgcgtctgctacgcctctcctgcaggacgaccaatggcttccaggaagttcttcgtgggtggcaaccggaaatgcaacggtactggcgaggacgtgaagaagatcgtcaccgtgctcaaccaagccgaggtgccctctgaagacgtcttcgaggtggtggtgagcccgccgttcgtttttctgcagcaggtcaaggggctgctgcggctgaacatcgccatcgcatcgcacatttgctgtgtgcgcaagggcacgtccttccccgacgagatcactgctgatatgctgggagatgctgtggttccctgcgtcatttccccccaccctaaactcagagatctgtttggtgactccagagattttgctgttgatattgaagcctgtgccctcactcaacgcctcaaggaaattgcttggctgagccagaccctcaacgaaaatctgaatggaccactttgggttgttggtgctgcctccttcacaggttttgtggaaaagaatcctattggactacctttgggccggataagaccctgtctggctattgatcccgcaaatttgccctccatcgccccg

SEQ ID NO: 47268 - protein, 181 aa, Zea mays
  misc_feature: Ceres CLONE 1454255-F
  misc_feature: SWISSPROT Homolog: EC 5.3.1.1 Triose-phosphate isomerase
MASRKFFVGGNRKCNGTGEDVKKIVTVLNQAEVPSEDVFEVVVSPPFVFLQQVKGLLRLNIAIASHICCVRKGTSFPDEITADMLGDAVVPCVISPHPKLRDLFGDSRDFAVDIEACALTQRLKEIAWLSQTLNENLNGPLWVVGAASFTGFVEKNPIGLPLGRIRPCLAIDPANLPSIAP

SEQ ID NO: 47269 - DNA, 653 bp, Zea mays
  misc_feature: Ceres CLONE 1454256-F
  misc_feature: Encodes the peptide sequence at SEQ ID NO. 47270
  misc_feature (653)..(653): n is a, c, t, g, unknown, or other
ggatcccccgggctgcaggaattcgcacgagaccattacctagaacatcctaatcgaaaaagaaccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcagcgtcgtcgaggaccagctcgacccggcgccgcccgccttcgaccccaacgacccctactaccaggagggaggggcggcggacgatgacgactaggcggccaaggaggtggtcgtcggcgaggtggaggtcgctaaggtcgccgagagcagggacggcgtcgccagggtcgacgtcgcgccgggtctgctccaggaccagaagcagtaaaaggactgtcttttctggatacgtctagactctataaaactgtgtgtccctgtgtn

SEQ ID NO: 47270 - protein, 110 aa, Zea mays
  misc_feature: Ceres CLONE 1454256-F
MAAYMRVTHRDEEGKKVTEKMPVPETRRPDTAKHFERKLEEQGLHRFERHPANAPRGVGIGAPPPKSGRGGKYTWEGPGSVVEDQLDPAPPAFDPNDPYYQEGGAADDDD

SEQ ID NO: 47271 - DNA, 678 bp, Zea mays
  misc_feature: Ceres CLONE 1454259-F
  misc_feature: Translation starting site: 222
  misc_feature: SWISSPROT Homolog: EC 6.3.2.19 Ubiquitin--protein ligase
  misc_feature (1)..(1): n is a, c, t, g, unknown, or other
  misc_feature (678)..(678): n is a, c, t, g, unknown, or other
nccgattgggtacgggccccccctcgagccactgcagtggtaaaggcctgattcgattggcaagcgcaattggccgctcctgaccagacgccggatagggctggatttgattgagattggatccccaattgtgtttgccacgtccgtgcgttcgggcgggcgggggagttactttagggtttcggcgggtgcggtcgccgtgtaggcggtagggttttgccatggcggagaagggctgcctcaagcggctccagaaggagtaccacgccctctgcaaggagccgcctccgcagatcgttgctcgcccgctgcccaacgacatactggagtggcactatgtactggaaggaagtaaaggcacaccctttgaaagtggatattattatgggaagctcaagtttccaccggattatccttttaaccctcaagcatcagcttgacaacccctagcggcagatttgcgccacataaaagaatatgcttggtcatgagtgactttcatcctgaatcttggaatccaatgtgctctgttgcaagcattctcactgggcttctgtctttcatgaatggacattgcctgacaacttggagccttcagacctccgatgcagaaaagagacgtttaagaaaagcttcccttgtttataatgggaaagcaaaactgtccgcccttcagan

SEQ ID NO: 47272 - DNA, 682 bp, Zea mays
  misc_feature: Ceres CLONE 1454263-F
  misc_feature: Encodes the peptide sequence at SEQ ID NO. 47273
  misc_feature (440)..(440): n is a, c, t, g, unknown, or other
ggagctccccgcggtggcggccgctctagaactagtggatcccccgggctgcaggaattcgcacgagaccattacctagaacatcctaatcgaaaaatgaaatcctccctccacttccagtgggtttccatcggtacactgtcgaaaacctcaacgacgtctcatcagacgctctgttggagcgtgaagtggaagaatttgacccaccgtccgaggttcgagccatcattgaaggccaaatgctgtcgatgcggggccacgccgagaggtttggcatgccgaaccctcccaaacggatcatagcaactggcggggcatcctccaacgaaagcatcctcatgtcagtcgcgcagatcttcggctgccctgtcttcacagtccagagacctgattcggcatcgctgggcgcagcgctgagagctgcccacgggtggctgtgncacgcgcaaggtagcttcgtccccatctcgtggctgtaccagggcacctggagaagacctcccttggctcgaagctggcaatccccgcccggcaacagggagcagggaccgggacctcctccgagaagtccccctccctgatgaggaagaaaatggaaatccaaaaacccctgggggaaaaatacggccaacccgtgggaaaaaaaatccttaacccttctaaaggtgggaagaccaaatat

SEQ ID NO: 47273 - protein, 113 aa, Zea mays
  misc_feature: Ceres CLONE 1454263-F
  misc_feature: SWISSPROT Homolog: EC 2.7.1.17 Xylulokinase
  misc_feature (67)..(67): Xaa is any aa, unknown, or other
MLSMRGHAERFGMPNPPKRIIATGGASSNESILMSVAQIFGCPVFTVQRPDSASLGAALRAAHGWLXHAQGSFVPISWLYQGTWRRPPLARSWQSPPGNREQGPGPPPRSPPP

SEQ ID NO: 47274 - DNA, 723 bp, Zea mays
  misc_feature: Ceres CLONE 1454270-F
  misc_feature: Encodes the peptide sequence at SEQ ID NO. 47275
  misc_feature (572)..(572): n is a, c, t, g, unknown, or other
aagctggagctccccgcggtggcggccgctctagaactagtggatcccccgggctgcaggaattcgcacgagaccattacctagaacatcctaatcgaaaacccactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggttcctgctccaaaatatgattcgtctggtctggcgcgcgtgagtccagctcgtgtgtcgtgcgtgtctctgtgtgaggtgtcggcgggcgtgtgtgttttgtatggagtcggccgcggcggcggcggaggaggaggtgtgcgcgtggtgggtggtacntgcttcgacgcgccactgtttgtcgcggcgatcatgtactaccctgctgcggtttctggggagcaatgagaagatggattttgattcattccttttacaaaaaaaaaaaaaaaaagctttaatcgatccccctccacctcgaggggggggc

SEQ ID NO: 47275 - protein, 57 aa, Zea mays; identical to SEQ ID NO: 43282
  misc_feature: Ceres CLONE 1454270-F

SEQ ID NO: 47276 - DNA, 667 bp, Zea mays
  misc_feature: Ceres CLONE 1454280-F
  misc_feature: Encodes the peptide sequence at SEQ ID NO. 47277
ggagctccccgcggtggcggccgctctagaactagtggatcccccgggctgcaggaattcgcacgagaccattacctagaacatcctaatcgaaaaaacccaacccaacccaaccgcgctttttgtcacctctcacctggaaagggaagacaagtcgagattcgagaaggcaaatcgaattcgccatgggcatggctgctccgcgcgcgccgctgcctctcccccaactgctcctcctcctcgttgctgcgctcctcgccgccgctcccctccctagggcggccggggcggacgagttcgacgtccgccgccacctctccaccgtcaccaggtatgatgtggccagggagtccagtagtgtcatctccatgccgtcaatcccagacgggtgccgtgtcattcacctcaatctagtggcaagacatgggactcgcgctcctaccaagaagcgcatcaaggagctggatagattggcagttcgactggaagcccttctgaaagaggcaaatcaggtccttgatagtgattctctgaagaaaattccatcctggattaaaggctgggaatcacgctggaagggtaggactaaaggtggtgagctgattagtgaaggggaagaggagctgtacaatttaactaccagaatgaaggagaaggttcaagatct

SEQ ID NO: 47277 - protein, 160 aa, Zea mays
  misc_feature: Ceres CLONE 1454280-F
  misc_feature: SWISSPROT Homolog: EC 3.1.3.8 3-phytase
MGMAAPRAPLPLPQLLLLLVAALLAAAPLPRAAGADEFDVRRHLSTVTRYDVARESSSVISMPSIPDGCRVIHLNLVARHGTRAPTKKRIKELDRLAVRLEALLKEANQVLDSDSLKKIPSWIKGWESRWKGRTKGGELISEGEEELYNLTTRMKEKVQD

SEQ ID NO: 47278 - DNA, 759 bp, Zea mays
  misc_feature: Ceres CLONE 1454281-F
  misc_feature: Encodes the peptide sequence at SEQ ID NO. 47279
  misc_feature (12)..(12): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ggttttttcctnccccgccgcgttagagtaatctccaccacannnnnnnnnnntcacagctggactccccgcggtggcggccgctctataactagtggatcccccgggctgcaggaattcgcacgagaccattacctagaacatcctaatcgaaaagtgggaactgcatgctgagagcaaacccagaaaggaaaaaggaaaaaaagaaaacagagagaggggagagtgggagacggtcggagacagaggcctcactcctccacactctcagtcgtcttccagtcccagcgctttcttggatcgcgaggaaaccactcggggagtttgcagttgcagagaactgtatcggccgaagtggttgcacggtgtgttggccttggccatgcgccacggcagggaacagagacgagcagcagggaggctgcaatggaggcgctcattgaccctgctcccactgtaaagatagtcccgcggtgccctccgaattccacttgatccaactctcgacatgaagcggccacgcggggctactccctcccctgtctgcgatgcccaatcatcaagaaaatgacggcctacgcgggctccggatgggaggctgacttggacgtggaacggggaccaaggagaagatggcgttccggcggtcgccggtgaaaaaaaaagcggccccctgaattgcccaaacaaggtgccgccgcccttggaaacctaacccttcaaaggtgggaaaaaccaattcttggaaccccggaaccg

SEQ ID NO: 47279 - protein, 91 aa, Zea mays
  misc_feature: Ceres CLONE 1454281-F
MLRANPERKKEKKKTERGESGRRSETEASLLHTLSRLPVPALSWIARKPLGEFAVAENCIGRSGCTVCWPWPCATAGNRDEQQGGCNGGAH

SEQ ID NO: 47280 - DNA, 807 bp, Zea mays
  misc_feature: Ceres CLONE 1454282-F
  misc_feature (51)..(51): n is a, c, t, g, unknown, or other
  misc_feature (52)..(52): n is a, c, t, g, unknown, or other
gtggtggcttgtgttttccactttcataaacccacctattaggggggccgnntaaatcaacaccaaactggagctcaccgcggtggcggccgctctagaactagtggatcccccgggctgcaggaattcgcacgagaccattacctagaacatcctaatcgaaaaatcgaatcccttcctccccagtccctagctagccactaggcgctttgccagcctttgcagcgtcgcggtcgcgtagcacgcccttgtgcatcgacggcagacgagaccgagccgtcggtgttggtggagaaggggccgcagcaagggagctgctcgtgggggacaagctcaacaagctggatgaaggaggggaggggaccggacggcgtggtgtactaggcccatcgacaaggggacggggggccggggtgggggcaggacaaggaccccgccgggggatgggtaaatcattaacaacccgatccaacaataattccgagtaaatggggccccccgggaagccgtgcctcccccgaggggtgggtgcatgctcgttcgggctccccttcgtttgggcctagcctagggggccgattttgggaaatgtggcaccgggtccggcccgcggggtggggcggccctttctgatgtttgtgggtacagccgttcgggggcgcagggggaacggtctaccccctttccgaaacggggtggcccgcccgcccctagacgggctcaaccggcggacaagtttgggaacaaggaaagccgcccgcgtgccgcttttttttggtatcgtcgcgtttttgtgccgccccttcc

SEQ ID NO: 47281 - DNA, 695 bp, Zea mays
  misc_feature: Ceres CLONE 1454287-F
  misc_feature: Encodes the peptide sequence at SEQ ID NO. 47282
ggagctccccgcggtggcggccgctctagaactagtggatcccccgggctgcaggaattcgcacgagaccattacctagaacatcctaatcgaaaaacggacaaggacctgctctgtttctcggcgagtttttcccacttccacctctccgtccctgccgagctgcggcggccgcatcgactgttagggcgaaaatccgttctagtctctcggcgattttcggcaggcggaggcagcaggatctgcgggaaggatttcgtgtcgagatggctgggcgcaaggaaactgcactcgacctggcgaagttcgtcgacaagggcgtccaggtgaagctcaccggcggccgccaagtgacaggaactctaaagggatatgaccaactactcaacttagtgctagatgaagcagttgagaatgaaagagagcaagatgatccattgaagctatcagggaaaactagacaacttggcctcattgtgtgcagaggcacagcagtcatgctggtctcaccgactgatgggactgatgagatcgccaaccctttcctcgcggacggagcatagcttgcacccctcggaacaatatgtccctgtgggaaaagaacccgtttctcgtgtatttgttgtacctgttgctacggttactaatgtgctgctgctgagtacttccgttttctttcctctcttctgagttcg

SEQ ID NO: 47282 - protein, 98 aa, Zea mays; identical to SEQ ID NO: 46535
  misc_feature: Ceres CLONE 1454287-F
  misc_feature (9)..(82): Pfam Name: LSM Pfam Description: LSM domain

SEQ ID NO: 47283 - DNA, 690 bp, Zea mays
  misc_feature: Ceres CLONE 1454289-F
  misc_feature: Encodes the peptide sequence at SEQ ID NO. 47284
tggagctcaccgcggtggcggccgctctatactagtggatcccccgggctgcaggaattcgcacgagaccattacctagaacatcctaatcgaaaactcattctcatcacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcttagctaattaataagcactacatccatgcatgtccacaatagggccctagccctactatactatacgtcgtcagcagaaagtctggttttgatttcaatataagatgccccttttgtgggggtaaaaaaaaaaaaaaa

SEQ ID NO: 47284 - protein, 116 aa, Zea mays; identical to SEQ ID NO: 40624
  misc_feature: Ceres CLONE 1454289-F
  misc_feature (1)..(93): Pfam Name: GRP Pfam Description: Glycine rich protein family

SEQ ID NO: 47285 - DNA, 707 bp, Zea mays
  misc_feature: Ceres CLONE 1454293-F
  misc_feature: Encodes the peptide sequence at SEQ ID NO. 47286
aaactggagctccccgcggtggcggccgctctattactagtggatcccccgggctgcaggaattcgcacgagaccattacctagaacatcctaatcgaaaaactgcgactgtgagcttcgttcgttcagttcatccgtgttcttgtttgcgaggtcaacagagagaggatgtcctgctgcgcaggcaactgtggatgcagctccagctgccagtgccgcaacggctgcggagggtgcaccaccatgtacccggacatggctgagcaggtgaccaccaccacccaggctctcatcatgggtgtcgcaccatccaaagggcacgccgagggcgggttcgaggcggccgccggagctgagaacggcgggtgcaagtgcggcggcaactgccattgccacccctgcaactgccgcaagtgagctaggtgctcccccctgcatgccggcccggaggaaccttcctaattataaacctaattaaagtaaaccggccttcgctggttgtgtttcgaagcaattcagtcatttttcttgcctttggcctggcccccaattcagaaaaaaaaaaaaaatgggcgaaatggggggcttccttggctccccccctggccccctggggggacccttcttgggaaaacaattgtttttgtgttttttgtgggggctcccacaccccttaacaggggcttttccccaggtggccaccggtg

SEQ ID NO: 47286 - protein, 82 aa, Zea mays
  misc_feature: Ceres CLONE 1454293-F
  misc_feature (1)..(80): Pfam Name: Metallothio_2 Pfam Description: Metallothionein
MSCCAGNCGCSSSCQCRNGCGGCTTMYPDMAEQVTTTTQALIMGVAPSKGHAEGGFEAAAGAENGGCKCGGNCHCHPCNCRK

SEQ ID NO: 47287 - DNA, 717 bp, Zea mays
  misc_feature: Ceres CLONE 1454298-F
tggagctccccgcggtggcggccgctctatactagtggatcccccgggctgcaggaattcgcacgagaccattacctagaacatcctaatcgaaaaaaagacggtgtatcgaagggtcgacaatggttacgacgatcggtagtccatagcagcgggggcgcaacttcgacccggttttcttcccatatatctgtcaaatccttctccggttaccctccatcggcagcaatttccgccatagataccggcgatcgagggcctcggacaacccaatcgacggagcagcgcggcggcaggagagggcaaacccttttcttctcagtactctacttgtctgcgcctggatcccctccgcaggaagataagacatgggtcaagcactcggcttgattcaagtggatcaatcgacagtagccctcaaggaaactttttggggaagtttgacaaaggccctagagccctggatgcccacttcttggcctgggggcataagggaaagcaaattgctgggaatcggtccctgggtgggcaacaaccttggaggccccctcgcaaaaaaaaaacaaaggaaatggcctccccaaagtgtgggggatcctgtgaaaatcccggcccttgccaaaaaggcttcgaatgctttttaagggtttatataccccggggaaaaaaacccccccatgtttttttaagctccccggggaaggttcccaaaaaaac

SEQ ID NO: 47288 - DNA, 700 bp, Zea mays
  misc_feature: Ceres CLONE 1454299-F
  misc_feature: Encodes the peptide sequence at SEQ ID NO. 47289
atagctggagctccccgcggtggcggccgctctagaactagtggatcccccgggctgcaggaattcgcacgagaccattacctagaacatcctaatcgaaaaaggctgctagctagtgctacctttcaaaaaacccctacatcctgccatccatccgcggtccgccgccgccgccatctcctcccactctcttccccccactcctaccaaaccctattcaatatccatttctccatccatggcgtggcgcggccccgccacccgggccgtcctcgccgccgtccgccgcccggcagcggccgcgcgcctccacgccccgcgccgccgcgtcccgcccgccttcgccaccacctcctccccgctcccgtccgcgcggcctctggcggcgttgatggggtccccggtgacggtggccgcggtgatggcgcgcctcacggcgcatcccggcgccagcgcgcgcgcgtgctgcaagctttcccagggtacttgaatctgttgtgtagaccccatcctttcgaaaggataaatgatgtatcttttggggaataaaagctattatggcatttcttccacagcaaagttcgaagaaattacccaacaataactagtttcctcgttaggatttcgagaaacccttaaaatttttacgttacatggcatggcttttgctgcggaaaccgccttttgaagaaaaactttg

SEQ ID NO: 47289 - protein, 83 aa, Zea mays
  misc_feature: Ceres CLONE 1454299-F
MAWRGPATRAVLAAVRRPAAAARLHAPRRRVPPAFATTSSPLPSARPLAALMGSPVTVAAVMARLTAHPGASARACCKLSQGT

SEQ ID NO: 47290 - DNA, 516 bp, Zea mays
  misc_feature: Ceres CLONE 1454302-F
  misc_feature (200)..(200): n is a, c, t, g, unknown, or other
  misc_feature (206)..(206): n is a, c, t, g, unknown, or other
  misc_feature (210)..(210): n is a, c, t, g, unknown, or other
  misc_feature (214)..(214): n is a, c, t, g, unknown, or other
  misc_feature (215)..(215): n is a, c, t, g, unknown, or other
  misc_feature (260)..(260): n is a, c, t, g, unknown, or other
  misc_feature (280)..(280): n is a, c, t, g, unknown, or other
  misc_feature (315)..(315): n is a, c, t, g, unknown, or other
  misc_feature (321)..(321): n is a, c, t, g, unknown, or other
ggagctccccgcggtggcggccgctctagaactagtggatcccccgggctgcaggaattcgcacgagaccattacctagaacatcctaatcgaaaaatacagcaacatagaccggatgtcacagtgaccaccgccctctagctcgtcgcctcgtcggcgtgcccagcttctggtccagcgcgtcgcctccgctgctgctngggccnccgnaacnngccccaactaccgtgccgaaggtcccaggcaggaagcatcttggncgtacgtgccgccggcgacnagcacccacacacagtcaatgatagtgattcattncagcanttcctgacactatatacagtcatgagtcgttagccaagcagagaccagccaaatcccgctcattgtgcgccctggtgaattcctgcatccaccaacatcgggtcagggtatatgctgctatgcagggataaccgggtaaaaccccttccttccttggaaaaaaaccatacctttcgaaaaaggccttataactgg

SEQ ID NO: 47291 - DNA, 662 bp, Zea mays
  misc_feature: Ceres CLONE 1454303-F
  misc_feature: Translation starting site: 144
  misc_feature: Pfam Name: DUF167 Pfam Description: Uncharacterised ACR, YggU family COG1872
ctccccgcggtggcggccgctctataactagtggatcccccgggctgcaggaattcgcacgagaccattacctagaacatcctaatcgaaaactgttggagctcggaacgaatcgagccggggcccacttcgatcgaaacgaaatggctccgggaaagcgaggcaaggccaaaggggcggcggcgccgctgcccaccgcggcggcgagtaccggagctgtagggttccctggctgcctccgcctgatgccgccgtcgaccgtggccatatctatacacgccaagcccggctccaaggtcgccaccatcacagagattggggacaaggcggtgggcgtgcagatcagacgcgccggcgagggatggcgaagccaacgccgcgcttgtccactttatcagctcggtacttggggtgaacaaaagagaagtgtctataggctcgggttctaaatcgagggaaaaggttgtgctggtacaaaatgcgactcttgaaggtgtctaccatgctctgaagaagtcttgtaattgtgcatgaggtatgtacggtaatcctggagttaacttgaatgggcagggcatatgaatgcttttctgataaaaaaaaaaaaaaaaaagcttatcgataccgtcgacctcgagggggggcccggtacccaattcgcc

SEQ ID NO: 47292 - DNA, 665 bp, Zea mays
  misc_feature: Ceres CLONE 1454304-F
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (541)..(541): n is a, c, t, g, unknown, or other
ccccgcggtggcggccgctctagaactagtggatcccccgggctgcaggaattcgcacgagaccattacctagaacatcctaatcgaaaacatgggttgtgttgtctcttcttccgattgttggtggtgtagctttggcatcccttactgaggcctcctttaactgggctggattttggagtgcaatggcttcaaatgtaaccttccagtcaaggaatgtgctaagcaagaaacttatggtgaagaaagaggaatctctcgacaacattaacctattctcgatcattacagtcatgtcattcttcctgttggccccagtaaccttacttacagaaggtgttaaagttagtccagcagtgttgcagtctgctggtttgaacttgaaacaggtatacacaaggtcattgattgctgcattctgcttccatgcataccaacaggtatcatacatgatcctcgccagggtatccccagtcacacattcagtgggcaattgcgtcaagcgtgtggtggtcattgtgacctctgtnnnctgtctcangacccctgtttctcccatcactctcttggtacgggatcgctcttgctggagtttcctatactcgcattgagagacttagcccaagccagactggctgacatatacattgtaagtcattcaaaga

SEQ ID NO: 47293 - DNA, 695 bp, Zea mays
  misc_feature: Ceres CLONE 1454307-F
  misc_feature: Encodes the peptide sequence at SEQ ID NO. 47294
ggagctccccgcggtggcggccgctctattactagtggatcccccgggctgcaggaattcgcacgagaccattacctagaacatcctaatcgaaaattttttttcaaaggagactgtttcataaacaggagccaggcaccggactttccaggaggataccacctcccgaacatggtgcgtcgacgacccgccaccggggcagccccgagaccccacctcgccgccgtcggtcgcgggctgctcctcgcgtccgtcctcgcggccgctgcctcctccctcccagtagccgagtcgtcctgcccgcgagacaactcactggtgagagacataagccgaatgcagcagcgcaactacgggagggaaggattctcgcatataactgtcacaggtgctcttgctcacgggacgaaggaggtggaagtgtggctacaaacatttggtccaggtcaaaggaccccaatccacaggcattcttgtgaagaggttttcattgtcctcaaggggaaaggcacgctcttactcgggtcgagctcgctgaagtacccaggacagccgcaggaagttcctgtctttcagaataccacattttcgatccctgtaaatgatccacatcaggtctggaattctaatgagcacgaagatttgcaagttcttgtgatcatatcgcgcccaccggtcaagatatttatatacga

SEQ ID NO: 47294 - protein, 174 aa, Zea mays
  misc_feature: Ceres CLONE 1454307-F
  misc_feature (39)..(174): Pfam Name: Auxin_BP Pfam Description: Auxin binding protein
MVRRRPATGAAPRPHLAAVGRGLLLASVLAAAASSLPVAESSCPRDNSLVRDISRMQQRNYGREGFSHITVTGALAHGTKEVEVWLQTFGPGQRTPIHRHSCEEVFIVLKGKGTLLLGSSSLKYPGQPQEVPVFQNTTFSIPVNDPHQVWNSNEHEDLQVLVIISRPPVKIFIY

SEQ ID NO: 47295 - DNA, 670 bp, Zea mays
  misc_feature: Ceres CLONE 1454309-F
tagtggatcccccgggctgcaggaattcgcacgagaccattacctagaacatcctaatcgaaaagtaatcctccgcctcgtgccgcatatccctacttactccgcccgccagccatggcccgatcctcctcgcagtctcagtcctccgttggcgccggagccggcgccggcaagcgcccggccaccgtcgggccgcgctgagtacggacgcgacggccgccgggatgcgccgccgccgcgccaccgcgtccggtgggggtggcgtattctcaccggacttagtgagctagatgctcatcttctatccgacaatgcgccaggtgatcaagatatcgacaaccaatggtgctttccaacacaatctgcacccatcagttgtttttggggcttccacatcttcgtattgttctaccattcccggacagccttggtctccgcgtgatctttttcgatccaaccgctcttagtcccaataatcggtatcaaaccgacagatcacaccgagaaggttttgacttttgttccatgatttagaaataggccactcccaaagaatgttgactctccacggcaaggggtagaaactatcttttcattctaatgaccctttcctcgaacctgtcaccctaattacctcactttagtggaaatttctcaccatagacatata

SEQ ID NO: 47296 - DNA, 681 bp, Zea mays
  misc_feature: Ceres CLONE 1454310-F
  misc_feature: Encodes the peptide sequence at SEQ ID NO. 47297
ggagctccccgcggtggcggccgctctataactagtggatcccccgggctgcaggaattcgcacgagaccattacctagaacatcctaatcaaaaaatatgaatagaaaagaacccctttgcgcaaggcaaacccccacccagctcacctcggcgatggcatcggcggcgtccgtggagtgggaggcggcggcgcggaaggtgctggtggcgcgcaagccctgctttgggctacctacggcctgcccaacctgcctccccgtgctcctctacctccgcatggcgcaggttcccttcgacatccacgtcgacacctccttccccgatgccgatcacataccatatgttgaatttggggattgcgtggctttcaacaacgagaaaggaggcgtaattgagtatctcaaggatgagaaaattgctgacttgaactcaaatcacccaaatatttcatccaccactgtgctagatacaaaggccatggtttcgtcctggcttgctaatgctttgctgtatgaactctgggtggttagtgctggaagcattgcaaatgatatctacttctctgatctcccttggcccattggaaagatactccatttggataaaactagacatgtgaagcagctactgggattacaaactctatggctgcaaaaaaagaagaggagatatccgtgag

SEQ ID NO: 47297 - protein, 174 aa, Zea mays
  misc_feature: Ceres CLONE 1454310-F
MASAASVEWEAAARKVLVARKPCFGLPTACPTCLPVLLYLRMAQVPFDIHVDTSFPDADHIPYVEFGDCVAFNNEKGGVIEYLKDEKIADLNSNHPNISSTTVLDTKAMVSSWLANALLYELWVVSAGSIANDIYFSDLPWPIGKILHLDKTRHVKQLLGLQTLWLQKKKRRYP

SEQ ID NO: 47298 - DNA, 834 bp, Zea mays
  misc_feature: Ceres CLONE 1454314-F
  misc_feature: Encodes the peptide sequence at SEQ ID NO. 47299
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (612)..(612): n is a, c, t, g, unknown, or other
tggtgtcccgacnnnnncggtacgatagcggttannnnncatnnnnntcatactgggactccccgcggtggcggccgctctattctagtggatcccccgggctgcaggaattggcacgagaccattacctagaacatcctaatcgaaaagttagagttagagacctgctggaggagacagagcttaggtgagcaggctagagcgagagacaacagatcatcagatcgggacatccatggagctggaggccggtgccgcgccggcgacgacgtgcagctggagggacgggcggaagctggtgaggtgcccgcggctgcagatggacaccaagacggccacggccatcgagaaatccacgggggcgagaatcgcctaatgccggcggctgccgccgagggcgcgatgcgaggtcaggatggggttcagcaaacaacaccttcaagaaggaggccgacgcccgcccccggggggggggtagggaaggccttttgccgggcttgctgccggggcttgagagacctctcggaagtttggttgaaggccccggccatcctaaaaaaaccaggttggggccccgggaagggggccaaagccgggtggggtccaccgggnccgtgcaaaaattccccgggagggaaaggctttataacccatagccccccgggaggggggaaaccccccggattgcgctaaagctgtcctttacccacccccacaccattaggtttctaaatccccttcccgttacgtgaaaaaaatagccgatccccttttttttcccccggggtgctcatacccctcacagaagtgttggtccccaaaaagagaatactt

SEQ ID NO: 47299 - protein, 46 aa, Zea mays
  misc_feature: Ceres CLONE 1454314-F
MELEAGAAPATTCSWRDGRKLVRCPRLQMDTKTATAIEKSTGARIA

SEQ ID NO: 47300 - DNA, 768 bp, Zea mays
  misc_feature: Ceres CLONE 1454320-F
  misc_feature (21)..(21): n is a, c, t, g, unknown, or other
  misc_feature (23)..(23): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
ctcaaaataaaccccctttcntntgtctacctataannnnanacnnnnnnnnnnccgattgggtacgggccccccctcgagccatgaagtgggacaggctccccttgactctagtttgactttgtcaaatgcttgtgaggtgtcagataagtgcgagcctccgggcgcaagtgacatagaactacttttaacgttatttttcttagtgcgatagtcgaaagaggggcagcgccccaccttttggctccaaggaccggcctcagcgggccgatccgaggggaagacattgcctcgtgcggagtttggctggggcagcacatctgtgataagataaggcaggtgtcctaagatgagctccaccagaacagaactctcgtgtggaacaaaagggtaaaagctcgtgtgattctgatttcccgtacgaatagaaaacgtgaaagcgtggactatttatcctttaaaccttaacaccttactacctcgaggtgtaaagataagttaccaccagggaataactggccttgtgggaccccttgcggttcatagccgccgtttgctttttggatcctttcgatgggcgctccctccttaccattgttgaaaaccaaatttccccaaatgttgggaattgtttcgcccaacccccaaaggcaacgttgaacctgtggattaaaacaaaagcgtggaaacccgggttagattttcccccttaacggaatgaaccgcctctctcccctcagtacaatccaacccccagtagcccaaggg

SEQ ID NO: 47301 - DNA, 711 bp, Zea mays
  misc_feature: Ceres CLONE 1454321-F
  misc_feature: Pfam Name: Glyco_hydro_14 Pfam Description: Glycosyl hydrolase family 14
  misc_feature: SWISSPROT Homolog: EC 3.2.1.2 Beta-amylase
cgattgggtaccgggccccccctcgagccactgcagtggtaaaggaccccatgcccgtgctcaagggccgaacccccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgaataacttgaaagcggctgctgaaggcgtgggcaagcccgagtggggcaacgcggggtccggacgaatcccggcagctacaaggactggccccggagacacggggcttccttccggcccgagggccggcttggaccacggaataacgggaaagttcctcccccaactttggaactccaaaaatgttccctgggacccggggaaagggaattcccgcccccccccccacccagcgtggttccccgggggtccccccgggggggaaaaaattccggtgaaagggggcccgggaatcacatggggaattcagggacccccggtgccccaccccgggggaaacttaaacccggggggaatattaaaaaacccccggtccccaaaaaaggggatccccccccccctccggggcaacttcttggggccgccccccagagccccctgct

SEQ ID NO: 47302 - DNA, 733 bp, Zea mays
  misc_feature: Ceres CLONE 1454333-F
  misc_feature: Encodes the peptide sequence at SEQ ID NO. 47303
  misc_feature (19)..(19): n is a, c, t, g, unknown, or other
  misc_feature (394)..(394): n is a, c, t, g, unknown, or other
  misc_feature (733)..(733): n is a, c, t, g, unknown, or other
cgattagggtaccgggctntctttcgaggcactgcggtgggataggccgactgcctctgaccgctgaccgcactgctcccttctcctgttctctctccccacttcgagacttcctccattcgcggtttgcctctctgccttccctacctcagatcctccctcagattgccatggcggaccagctcttcgacgaccagatcgccgagttccaggaagcattcagcctcttcgacaaggacggcgacggctgctttaccaccaaggaacttggaactgtgatgcgctcgttggggcagaaccctactgaggctgagcttcccgacttgatccacttagttgatgcttaaggcaatggacccctcgacttccctgaggttcccagactcacgccccnccagatgaacgacccaaagtttggacccccacccccacgacgcccttctctgtagtcggaagagggactggaacgggttggagtgcggggggggggaagtgggggcggtggggggcgggggctacgggagaaacccggcccgacccaaggaggcggaccaaacatgatcccccggaaggccccccaggggcggggggggcgggcccctaagttccccggcgcggggagggcgccgcgaaggggtcaacggaagtgggccccgggcggaagtggggcccggtggacgcgcgggtgcagccgcccgggccgccccagctgtctgcgcaggggtgaggccgn

SEQ ID NO: 47303 - protein, 58 aa, Zea mays
  misc_feature: Ceres CLONE 1454333-F
  misc_feature (12)..(40): Pfam Name: efhand Pfam Description: EF hand
  misc_feature: SWISSPROT Homolog: EC 2.7.11.1 Non-specific serine/threonine protein kinase
MADQLFDDQIAEFQEAFSLFDKDGDGCFTTKELGTVMRSLGQNPTEAELPDLIHLVDA

SEQ ID NO: 47304 - DNA, 686 bp, Zea mays
  misc_feature: Ceres CLONE 1454334-F
  misc_feature: Encodes the peptide sequence at SEQ ID NO. 47305
tcgagccctgcagtggtaaagggtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggcccgtggaggccggcggctacagcggtggcgggcgccgtgatggcggtggcagctaccgccgttgccggcggcttaaccggtggcgagcggcggctacggtgcgtggtggggggcggcttacggcggggggcaaaccgtggcggggggcttcggccaactcccaacgggtaacctgggaggaaacctgacaccggtggggggccccgccccgggcccacagtttattccttgttttcgcctaaccgcggggaatgttgtatcaccc

SEQ ID NO: 47305 - protein, 156 aa, Zea mays
  misc_feature: Ceres CLONE 1454334-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGPWRPAATAVAGAVMAVAATAVAGGLTGGERRLRCVVGGGLRRGANRGGGLRPTPNG

SEQ ID NO: 47306 - DNA, 670 bp, Zea mays
  misc_feature: Ceres CLONE 1454341-F
  misc_feature: Encodes the peptide sequence at SEQ ID NO. 47307
cgattgggtacgggccccccctcgagccctgcggtgggaaaggagaggccacgcggccacgccgtcctcttcaccccagggttgccgacgcggcgactccgatcacccaccaccgctgccccctgtcctccctgctgccgcctgtgccggggctagcccgccgcggagccatgtcgcggtccttgagcatgagagggagcatgagggcgcgccgcgacctgcctcctcctgagaagacaattgaaaggcttgagagtatggtggatggaggaaatttctatgaagctcaacaaatgtacaagtcaaccagtgcaaggtatattgctgctcagaagtattcagaagccttggacatccttcagtcaggcgctttggttcaattgaagcatggacaggttacctgtggtggtgaacttgctgccctctttgttgacaccctcatcacaggagagcttccatatagtgaacaaatttttgatcgtatcagaaagatgtatgaggcattcccaagggtaactgttccacatttccttggagatgactatgatgatgaggggcatcaattatctgaagctatttctgctgcccaaatgcggggcaaagagttgctcctccttcatgaaaacctgccattcaggtgggcctgcctgagttttggaacatccaagag

SEQ ID NO: 47307 - protein, 166 aa, Zea mays
  misc_feature: Ceres CLONE 1454341-F
MSRSLSMRGSMRARRDLPPPEKTIERLESMVDGGNFYEAQQMYKSTSARYIAAQKYSEALDILQSGALVQLKHGQVTCGGELAALFVDTLITGELPYSEQIFDRIRKMYEAFPRVTVPHFLGDDYDDEGHQLSEAISAAQMRGKELLLLHENLPFRWACLSFGTSK

SEQ ID NO: 47308 - DNA, 677 bp, Zea mays
  misc_feature: Ceres CLONE 1454343-F
  misc_feature: Encodes the peptide sequence at SEQ ID NO. 47309
  misc_feature (620)..(620): n is a, c, t, g, unknown, or other
  misc_feature (677)..(677): n is a, c, t, g, unknown, or other
cgaattgggtaccgggccccccctcgaggcctgcggtgcgatagggaggccaacccataaacatagaaggcgtgtacaccaagaagaagccggccaaccaaccgactcccccgaccctcctgatcgatcgagggccccttgttctagccagttgtccccttccctctcgccggcgttgctcctgcctgctccaatggccgctgcctctgccgccgcccccacgaagacggcgaacatccccgcgacgatgcgggccgtgcagtacgactcctgcggcgggggcgccgctggactcaagcatgtggaagttccggtcccttcggccaaaaagaatgagcttctgctgaagctggaggcagcaagcatcaacccagtggactggaaggtgcagaaaggcatgctgaggcctttcctgcctcgtaaattaccttttatcccagtgactgatgtggcaggagtcgtggctgatgttggtccaggaatcaatgggttccaagccggagatcaagttgttgctatgctcaactcatttaacggaggtgggcttgcggagtatgctgtggcatcagaaaatctgaccgtcaagaggcctcctgaagtatctgctgccgaaggcgcanggctgcccatcgccgccggcactgcccctccagcgctcaggaacatcggcgccaagn

SEQ ID NO: 47309 - protein, 161 aa, Zea mays
  misc_feature: Ceres CLONE 1454343-F
  misc_feature (46)..(132): Pfam Name: ADH_N Pfam Description: Alcohol dehydrogenase GroES-like domain
  misc_feature: SWISSPROT Homolog: EC 1.6.5.5 NADPH:quinone reductase
  misc_feature (143)..(143): Xaa is any aa, unknown, or other
MAAASAAAPTKTANIPATMRAVQYDSCGGGAAGLKHVEVPVPSAKKNELLLKLEAASINPVDWKVQKGMLRPFLPRKLPFIPVTDVAGVVADVGPGINGFQAGDQVVAMLNSFNGGGLAEYAVASENLTVKRPPEVSAAEGAXLPIAAGTAPPALRNIGAK

SEQ ID NO: 47310 - DNA, 669 bp, Zea mays
  misc_feature: Ceres CLONE 1454346-F
  misc_feature: Encodes the peptide sequence at SEQ ID NO. 47311
  misc_feature (601)..(601): n is a, c, t, g, unknown, or other
cgattgggtaccgggccccccctcgagccactgcagtggtaaaggtttaccatggtaaagatggaaaccctgacaaacttgctgtccgagggttgtctcttgccataccaaaaggccagtgttttggaatgcttggtccgaatggagctgggaaaacatccttcatcagtatgatgattgggcttattccaccaacatctggcactgcctatgtacatggaatggatataaagaccaatatggatgcaatctatactaccatgggtgtatgcccacagcatgacttactttgggaaacattaacaggaagagagcatgtaatgttttatgggagactgaagaatcttaagggcactgaattactgaaggctgttgatgactctctgaagagtgttaatctgtttcatggtggcgttggtgataagcaagtgggaaagtacagtgggggcatgaaacgaaggcttagtgttgccatttcattaatcggggatcccaaagtagttttcatggacgagccaagcaccggactagatccagcatcaagaaacaatctgtggtgtgtcgtgaaggaggcaaagaaaaaccgtgccatcattcttancacgcactcgatggaggaagcggaagtactatgtgatagacttggtattttcgtcgatggtggtttca

SEQ ID NO: 47311 - protein, 222 aa, Zea mays
  misc_feature: Ceres CLONE 1454346-F
  misc_feature (38)..(220): Pfam Name: ABC_tran Pfam Description: ABC transporter
  misc_feature: SWISSPROT Homolog: EC 3.6.3.31 Polyamine-transporting ATPase
  misc_feature (200)..(200): Xaa is any aa, unknown, or other
IGYRAPPRATAVVKVYHGKDGNPDKLAVRGLSLAIPKGQCFGMLGPNGAGKTSFISMMIGLIPPTSGTAYVHGMDIKTNMDAIYTTMGVCPQHDLLWETLTGREHVMFYGRLKNLKGTELLKAVDDSLKSVNLFHGGVGDKQVGKYSGGMKRRLSVAISLIGDPKVVFMDEPSTGLDPASRNNLWCVVKEAKKNRAIILXTHSMEEAEVLCDRLGIFVDGGF

SEQ ID NO: 47312 - DNA, 645 bp, Zea mays
  misc_feature: Ceres CLONE 1454349-F
  misc_feature: Encodes the peptide sequence at SEQ ID NO. 47313
cgattgggtaccgggccccccctcgagccctgcagtggtaaagggtccaaagcgagagagctaagctaagccgagctaagaagcacagcaagtctcaccagactagcggctagcgcgagaatggccaaggacatcgaggccgcggcgcacgagggcaaggactactcggacccgcctccggcgccgctggtggacgcggaggagctgaccaagtggtcgctgtaccgcgcggtgatcgcagagttcgtggccacgctgctcttcctctacatcacggtggccacggtgatcgggtacaagcacacagacggacgcggcggcgtcgggccccgacgcggcgtgcgggggcgtcggcgtgctcggcatcgcctgggctttcggcggcatgatcttcatcctcgtctactgcaccgcaggggcgtcgggagggcacatcaacccggccgtcaccttcggcctcttcctggcgcgcaaggtctcgctggtgcgcgcgctgctatacatcgtcgcgcagtgcctcggcgccatctgcggcgtcgggctcgtcaagggcttccagagcgccttctacgtgcgctacggcggcggcgccaacgagctcagcgccggctactccaagggcaccggcctcgccgcggagatcag

SEQ ID NO: 47313 - protein, 86 aa, Zea mays
  misc_feature: Ceres CLONE 1454349-F
  misc_feature (1)..(86): Pfam Name: MIP Pfam Description: Major intrinsic protein
  misc_feature: SWISSPROT Homolog: EC 2.4.1.227 Undecaprenyldiphospho-muramoylpentapeptide beta-N-acetylglucosaminyltransferase
MIFILVYCTAGASGGHINPAVTFGLFLARKVSLVRALLYIVAQCLGAICGVGLVKGFQSAFYVRYGGGANELSAGYSKGTGLAAEI

SEQ ID NO: 47314 - DNA, 657 bp, Zea mays
  misc_feature: Ceres CLONE 1454353-F
  misc_feature: Encodes the peptide sequence at SEQ ID NO. 47315
  misc_feature (1)..(1): n is a, c, t, g, unknown, or other
ncgattgggtacgggccccccctcgagccctgcagtggtaaaggggggtggaattgggaactgagaagaaaaaaaaacacccacacccacacccgcgtccgcgtgctctctctgccccatccgcgcgcccctcctcctcctccaccgcccgtcccgccgccgcccggccgtctggtggcgatggcgtaccgggcggacgacgactacgactacctcttcaaggtggtgctcatcggcgactccggcgtcggcaagtccaacctgctctcgcgcttcacgcgcaacgagttcagcctcgagtccaagtccaccatcggcgtcgagttcgccacccgcagcatccacgtcgaggacaaggtcgtcaaggcccagatctgggacaccgccggccaggaaagataccgcgctatcacgagcgcgtactaccgcggagcggtcggagcgctggtcgtgtacgacgtcacgcggcacgtcaccttcgagaacgtggagcggtggatgagggagctgagggaccacacggacgccaacatcgtcatgatgctggtagggaacaaggcggacctgcgccacctcagggccgtcccgaccgaggacgccaaggccttcgccgagcgccagaacgccttcttcatggagacgtcggccctggaggcg

SEQ ID NO: 47315 - protein, 159 aa, Zea mays
  misc_feature: Ceres CLONE 1454353-F
  misc_feature (14)..(159): Pfam Name: Ras Pfam Description: Ras family
  misc_feature (14)..(128): Pfam Name: Miro Pfam Description: Miro-like protein
  misc_feature: SWISSPROT Homolog: EC 2.7.11.1 Non-specific serine/threonine protein kinase
MAYRADDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELRDHTDANIVMMLVGNKADLRHLRAVPTEDAKAFAERQNAFFMETSALEA

SEQ ID NO: 47316 - DNA, 663 bp, Zea mays
  misc_feature: Ceres CLONE 1454354-F
  misc_feature: Encodes the peptide sequence at SEQ ID NO. 47317
cgattgggtccgggccccccctcgagccctgcagtggcaatggcggccgtgctgaggagagccgtggcgcagtgcttcgcgtcgtcgtcgtcgtcgtcgccggcgacgttcgggctccggcggttcctgcaggagcagccggcgttccgccccgccgtgccgcccgaccgcttcatgcccctggccgaccggatccgggacctcggggtcggcgtcgcattcccgcggatcaacctcgacggcctcgtgccgcccgcgccggcgccggcgccggccaagcgggagccggacgcggcgctgcccgcggcgagcctcacggtggaggaggcgcgcaaggtgctgcgcgccacacagatggaggcggcccgcgcgcggattcgggagtccggcgccggcgccgtgccgtacgccgacttcctgcacctctgctgcgacgccgccggcccggacactggcccatccgtcgcgcgcgcgctcgacgagtccggatccgtcatcgtgctcggaaagaccgtcttcctcatgcccgacatggtcgtgaaggccatcgagaatgcgatccccgtgcgggacgtcgccgccgccgcggagatcgaccccgcgaggcaggaggagctgatggccatggatgttgacaacgtgacatcgaccgggcggcgtcgg

SEQ ID NO: 47317 - protein, 208 aa, Zea mays
  misc_feature: Ceres CLONE 1454354-F
MAAVLRRAVAQCFASSSSSSPATFGLRRFLQEQPAFRPAVPPDRFMPLADRIRDLGVGVAFPRINLDGLVPPAPAPAPAKREPDAALPAASLTVEEARKVLRATQMEAARARIRESGAGAVPYADFLHLCCDAAGPDTGPSVARALDESGSVIVLGKTVFLMPDMVVKAIENAIPVRDVAAAAEIDPARQEELMAMDVDNVTSTGRRR

SEQ ID NO: 47318 - DNA, 661 bp, Zea mays
  misc_feature: Ceres CLONE 1454357-F
  misc_feature: Encodes the peptide sequence at SEQ ID NO. 47319
  misc_feature (452)..(452): n is a, c, t, g, unknown, or other
  misc_feature (500)..(500): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
cgattgggtacgggccccccctcgagccctgcagtgggaaagggatggcgcacggcggctacccgcgccgcggcgctgccgtacgcaggcccaagtcctcggcctctgccgctgttgccgaccgcaagcggaagcggaccgccgccgccgccaagaccacctcccttaagaaccagatccgctccaccgagcgcttcctccgcaaggaccttccggatgagattagggttgctcaagagaagaaactggaagaactgaagaggcaacaagagcttcagaatcaacttgttgtccagcggacattacagtttagagatagaaagataaaattctttgagagacggaagattgagaggatgataaggcgactcgagaagcacaacgttcaaatggtgacggtgtcaacaataatctgtcaaaattgcgagaagatcttgaaatatgtagattcntccctaagaatgagaaatatgtctcgctgttcactggagggaacagtncagatattgtccagaagagaataaatggcgcaacagatcagggagatctcatggctgctgccgcaacggaaaagattttaaaaaaagccgccgccaccatacttgaggnnnagggataaaaattctttgtgccggattccaggataaaaagctaagaaagg

SEQ ID NO: 47319 - protein, 159 aa, Zea mays
  misc_feature: Ceres CLONE 1454357-F
MAHGGYPRRGAAVRRPKSSASAAVADRKRKRTAAAAKTTSLKNQIRSTERFLRKDLPDEIRVAQEKKLEELKRQQELQNQLVVQRTLQFRDRKIKFFERRKIERMIRRLEKHNVQMVTVSTIICQNCEKILKYVDSSLRMRNMSRCSLEGTVQILSRRE

SEQ ID NO: 47320 - DNA, 687 bp, Zea mays
  misc_feature: Ceres CLONE 1454358-F
  misc_feature: Encodes the peptide sequence at SEQ ID NO. 47321
  misc_feature (418)..(418): n is a, c, t, g, unknown, or other
cgattgggtaccgggccccccctcgaggccagcagtgggataagcggggagctgcatgcctccctccggctcccattgcctaaatatacaagccatcctaggaggaggggtagtacggtggtgtcattctttttgactgtctctctctcctcacctcaagtccccgaaccagtagtgcaccaagaaccactccatccatctccatgggagactccggaggaagaagaggaccacctcttcctcggctgctagatctcatcccggacgggaaagaacggaaggggagggaagcgcaagacgcgggaaggtcgaagaacaccggcggcttcgggggcgaagaggacgcgaagctggagctcaagctcgggcctcggggtctcactctcgtagaagaaggaacgacagctaccgtgcaaanccatggaggggtactacagcgagagacaacgacacccccgaccctctcgctcgggggcttcccaaggaaaccctccaaacccgggggtaaaaccatcttccccttgtaaaaaaaaggaaattttttaaatccccccccaccccaaaaaggaaaggcccttaaacgaattggaaaaaaaggccaaaacgggtttgtggaaaaaactttcccggggaaaaaaaaaaacacccccccccccccatgtaaaaaacaaaaaggatcccgcttcc

SEQ ID NO: 47321 - protein, 107 aa, Zea mays
  misc_feature: Ceres CLONE 1454358-F
  misc_feature (72)..(72): Xaa is any aa, unknown, or other
MGDSGGRRGPPLPRLLDLIPDGKERKGREAQDAGRSKNTGGFGGEEDAKLELKLGPRGLTLVEEGTTATVQXHGGVLQRETTTPPTLSLGGFPRKPSKPGGKTIFPL

SEQ ID NO: 47322 - DNA, 654 bp, Zea mays
  misc_feature: Ceres CLONE 1454360-F
  misc_feature: Encodes the peptide sequence at SEQ ID NO. 47323
  misc_feature (1)..(1): n is a, c, t, g, unknown, or other
ncgattgggtaccgggccccccctcgagccctgcagtggtaaaggagtgacagcctcacactcacttgaccgaccctttgcgacgccaaccggccaaagctcccggctcggcggcgccgcttcgtttcgttgatggattggtccacccggttccgcacccgaaacccgtcgccggccgtgtcccactttgccggccacaggcggagtcaagcggatagggtatttctccggaccatggcgtcggcggccccggtgcaggagccgacggcggcggccgaggcgaaggggcggctgaccggtgactccttcatccggcgccacctcaggaccctcgccccgtatcagcccatcctgcccttcgaggtgttatctgctcgccttgggcgtagaccagacgacataatctagttggatgcaaatgagaatccatatgggccacccccggaggtcgctgcagcactaggtagtctcaagttcccctatgtgtaccctgatccctgaagccgccaattgcgtgctgcccttgctgaacattctaaacttgaatctgattacatacttgctggatgtgccgcagatgaactaattgattctattatgagatgtgtgctggaacaggcgacaaaattgttgattgccctccacattcacaag

SEQ ID NO: 47323 - protein, 91 aa, Zea mays
  misc_feature: Ceres CLONE 1454360-F
  misc_feature: SWISSPROT Homolog: EC 2.6.1.9 Histidinol-phosphate transaminase
MDWSTRFRTRNPSPAVSHFAGHRRSQADRVFLRTMASAAPVQEPTAAAEAKGRLTGDSFIRRHLRTLAPYQPILPFEVLSARLGRRPDDII

SEQ ID NO: 47324 - DNA, 725 bp, Zea mays
  misc_feature: Ceres CLONE 1454365-F
  misc_feature: Encodes the peptide sequence at SEQ ID NO. 47325
  misc_feature (725)..(725): n is a, c, t, g, unknown, or other
ggagctccccgcggtggcggccgctctagaactagtggatcccccgggctgcaggaattcgcacgagaccattacctagaacatcctaatcgaaaaagaaaaactaccgaacgcgccgccgctcctgccccgtatctataccaccgaaggcgaggaaggggggccaaggacgagcgctttttcgtgcccgctggccattgccgctgctcacgagcctcccgccccgcgctgccctgccctctgcggctctgccccaacgagccccaggagagccaggtaaaggagccgtcaaaagcccccgccgaggagagcacgcaaggtcagacatggcgtcaaccgttaccttcagcctaattagcacccaggctgggttgatccataagccaaggaaccttggagccacaagctacgctggcttaaaggtgccgagctttggctctgaatcatcattcttgggaaggaacgcatcccttcggacggctgttactacaaggattgtgcccaaggcaaagtctggatctcagatatcgccacatgcatcttacatggtggcgctgcgtcagagctactcggtggcatctgtcaacccttgggactcatgattaagatgcctccccctggtgtcccaagcttgccttcgggtgggaatttggcaaaagcgcaaggaaatccctttataattttcaacccaatgtatccccgccccgttcggggaaattgtattn

SEQ ID NO: 47325 - protein, 91 aa, Zea mays
  misc_feature: Ceres CLONE 1454365-F
MASTVTFSLISTQAGLIHKPRNLGATSYAGLKVPSFGSESSFLGRNASLRTAVTTRIVPKAKSGSQISPHASYMVALRQSYSVASVNPWDS

SEQ ID NO: 47326 - DNA, 708 bp, Zea mays
  misc_feature: Ceres CLONE 1454368-F
  misc_feature: Encodes the peptide sequence at SEQ ID NO. 47327
tggagctccccgcggtggcggccgctctagaactagtggatcccccgggctgcaggaattcgcacgagaccattacctagaacatcctaatcgaaaaacccatctctcgccgcctcgcctgcaccggagactggccctagtgcccgcgcgcctgcgaggtatcgaacacccaaagatggcaatggcaaccttcacatcatccccagttctctgcagcttcaggaccatcgaacagaagaaggcccctctgctgaacaacagcacaaaacggccgcttcacttgggcttcccaaggagcgtgccgacgtcgccgagcttgagagagaggctagacctgcgcgtcgccgctgtctacaaggtgaagctcctcggccccgaagggcaggagagcgtgctcgacgtgccagaggacagctacatcctggacgctgccgaggaggccggtctcgacctgccctactcctgccgcgccggggcgtgctccacgtgcgccggcaagctcctggaggggctccgccgacaaggaaaacagtcgttccctcgaaaaagccaaaggccgggccggggtaccccttcacctggggtcgggtaacccaattccgaatggggtttccaaacccccgggaggaaaaatttgttttaaaccggggttggcccccgggaagggaacacccttggcccctccttcaaaaaaccaacctttgggtt

SEQ ID NO: 47327 - protein, 136 aa, Zea mays
  misc_feature: Ceres CLONE 1454368-F
  misc_feature (63)..(122): Pfam Name: Fer2 Pfam Description: 2Fe-2S iron-sulfur cluster binding domain
  misc_feature: SWISSPROT Homolog: EC 1.14.13.7 Phenol 2-monooxygenase
MATFTSSPVLCSFRTIEQKKAPLLNNSTKRPLHLGFPRSVPTSPSLRERLDLRVAAVYKVKLLGPEGQESVLDVPEDSYILDAAEEAGLDLPYSCRAGACSTCAGKLLEGLRRQGKQSFPRKSQRPGRGTPSPGVG

SEQ ID NO: 47328 - DNA, 775 bp, Zea mays
  misc_feature: Ceres CLONE 1454369-F
  misc_feature (1)..(1): n is a, c, t, g, unknown, or other
  misc_feature (239)..(239): n is a, c, t, g, unknown, or other
  misc_feature (254)..(254): n is a, c, t, g, unknown, or other
  misc_feature (400)..(400): n is a, c, t, g, unknown, or other
  misc_feature (402)..(402): n is a, c, t, g, unknown, or other
  misc_feature (403)..(403): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
natagctggagctcaccgcggtggcggccgctctagaactagtggatcccccgggctgcaggaattcgcacgagaccattacctagaacatcctaatcgaaaaattgataacagatgtcggcattctcctcgctcctgctgccatcgtttttcctttttcctggacagccactgcaactcctcccaaatcctcccacccggtttagccggctccgctgccaccgccgcgactccacctntgtcgccaccatggncaagtccaaggccatcagggtccacgagctgggtggcccccagggggtggggaggggagaggtggaagttcttttatcccggggaaggggaaatccccttccggaactctttttttccccccccaccaggggaaagaagggaggtncnnaaannnccccccccccccttgggggacccttccccctacaccccaaaaaaagggaagccgcttggggtgggggcccccccttattttgctcccccgccccaccactagcaagcaaaaagaggccaaaaacgtgcttgagcgaaggacgccacccccccgggagaccccacgtgcggttattaagccggagacttccctcgctgctccactccccccccttgatatcccccccctcccactcaataaggacgaaatttgcgtcttctcattcacccaacccttcctaccccctggtcttccatatccaccgccccttgcctgagagaacaatacacagctcccccccttcctcccccctacatgattggagcg

SEQ ID NO: 47329 - DNA, 814 bp, Zea mays
  misc_feature: Ceres CLONE 1454375-F
  misc_feature: Encodes the peptide sequence at SEQ ID NO. 47330
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (46)..(46): n is a, c, t, g, unknown, or other
  misc_feature (50)..(50): n is a, c, t, g, unknown, or other
  misc_feature (508)..(508): n is a, c, t, g, unknown, or other
ttttggccccccttnccnnncccccttttatttctttggtcttttntttnccaaactggagctccaccgcggtggcggccgctctttactagtggatcccccgggctgcaggaattcgcacgagaccattacctagaacatcctaatcgaaaaacccatctctcgacgcctcgcctgcaccggagactggccctagtgcccgcgcgcctgcgaggtatcgaacacccaaagatggcaatggctaccttcacatcatccccagttctctgcagcttcaggaccatcgaacagaagaaggcccctctgctgaacaacagcacaaaacggccgcttcacttgggcttcccaaggagcgtgccgacgttcgcccagcttgagagagaggctagaccttgcgctcctcgcctgtctacaagggtgaagctcctcgggcccccaaagggccaggacaagcgtggttcgacctttgcccaaaagcacagcataccatcccttggacgcatggccngaagtaggcccgggtcttggaacctggcccttaattcccttgcctcctcccggtttccttggcccccccgctggccgcaccggacaaagcctcctttggaggcggcttccccgcttaaccccaagtctaaaactgatgttctttcccctcgcgacaaagggccctaaggggtcctggggccccgggttataaccgcctttccactcgcgttgtccccgcttataaccccaaaacctcctcaaatggttgctctcctctcccgcaaacccgtcacaccggttggggcaataaaccctttgccaccaa

SEQ ID NO: 47330 - protein, 147 aa, Zea mays
  misc_feature: Ceres CLONE 1454375-F
  misc_feature (93)..(93): Xaa is any aa, unknown, or other
MAMATFTSSPVLCSFRTIEQKKAPLLNNSTKRPLHLGFPRSVPTFAQLEREARPCAPRLSTRVKLLGPPKGQDKRGSTFAQKHSIPSLGRMAXSRPGSWNLALNSLASSRFPWPPRWPHRTKPPLEAASPLNPKSKTDVLSPRDKGP

SEQ ID NO: 47331 - DNA, 789 bp, Zea mays
  misc_feature: Ceres CLONE 1454383-F
  misc_feature: Encodes the peptide sequence at SEQ ID NO. 47332
  misc_feature (372)..(372): n is a, c, t, g, unknown, or other
  misc_feature (375)..(375): n is a, c, t, g, unknown, or other
ggagctccccgcggtggcggccgctctagaactagtggatcccccgggctgcaggaattcgcacgagaccattacctagaacatcctaatcgaaaaagccctcgagtctggtcccccacccctcagcgcgacgaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccanaangaggaggactggaagcgcatcgaggaccgaatcggatgcgggcaggtcgaggagctcatcaaggaggccgaggacgagctcaagctcatccctaaaaatgattgaatgggatccctggggtgttcccgaagactacaaatgtgaggggtttgaaaaaccacccccccatttcctaaccttgttccttcacacccggcctggtggcccttccctggaagaattctttcaggcccctaaatgctgtcaaaatctgaacctgctctttcaaggggaaactcccccccccaggggaaggggataggatggcgttttccctgggatacaccccttttctccttttttccccccgcggggtaaggcactcgttctcttgggtgcattttccacccatggcgttttttcctaataaaaata

SEQ ID NO: 47332 - protein, 112 aa, Zea mays
  misc_feature: Ceres CLONE 1454383-F
  misc_feature (35)..(91): Pfam Name: ETC_C1_NDUFA5 Pfam Description: ETC complex I subunit conserved region
  misc_feature (77)..(77): Xaa is any aa, unknown, or other
  misc_feature (78)..(78): Xaa is any aa, unknown, or other
MFLRRILTGGGGLAALRAARAVKETTGIVGLEVVPNAREVLVGLYERTLKEIKAVPEDEGYRKAVESFTGHRLQICXXEEDWKRIEDRIGCGQVEELIKEAEDELKLIPKND

SEQ ID NO: 47333 - DNA, 682 bp, Zea mays
  misc_feature: Ceres CLONE 1454384-F
  misc_feature: Encodes the peptide sequence at SEQ ID NO. 47334
  misc_feature (510)..(510): n is a, c, t, g, unknown, or other
ggagctccccgcggtggcggccgctctagaactagtggatcccccgggctgcaggaattcgcacgagaccattacctagaacatcctaatcgaaaaatccatcaattagagtgtgtcctcgttcacgactctgagaaaggattgtctcgccgccgccgccgccggactaggaggaggaaaggccaagatgctcttccacgtctgctggatcggatcatgctgctgcacccgcggcacttcggcccgctcctccgcgacaagtgcgtcgtctagctcatgaaagacgtccagggcgcctgccgcgacctccacggattcgtcgtgatcatcaccggggtggaggacatctccaaagccatcatccagcatggcacggtcttcatcgccttccgcgatgagtgccagtgcgtcgtcatccgcccactcagggcgagatgcttgtagccgtcttcggcatgacctacagatggggatcttcgcgaacgccgggactgtacggttttttgtgcnaaccatttcataccagatttttcgagtccagaccgggggaggtgccaggaaatggacttctgatggaccggtaaattttccaaaaaaaactggggtcagaaaaagaatattaagccctccggttgccccgcctgagttttgttcctccggacccttaaaaaaccaatttctg

SEQ ID NO: 47334 - protein, 55 aa, Zea mays
  misc_feature: Ceres CLONE 1454384-F
MKDVQGACRDLHGFVVIITGVEDISKAIIQHGTVFIAFRDECQCVVIRPLRARCL

SEQ ID NO: 47335 - DNA, 709 bp, Zea mays
  misc_feature: Ceres CLONE 1454389-F
  misc_feature: Encodes the peptide sequence at SEQ ID NO. 47336
  misc_feature (398)..(398): n is a, c, t, g, unknown, or other
  misc_feature (471)..(471): n is a, c, t, g, unknown, or other
  misc_feature (709)..(709): n is a, c, t, g, unknown, or other
aagctggagctccccgcggtggcggccgctctagaactagtggatcccccgggctgcaggaattcgcacgagaccattacctagaacatcctaatcgaaaaaactccagatgcttacttcgccttggcgcaaataattccggcacattaaaaacgcaaggatttctcggttcctcctcgtcctggcgctctcccggtctcccctcccccgagcatcccaaaaaaaaaaactcggccactgcgctatctcgcccaccaagccagcaccagcagcggcgcgcgatggccaccgcgccctacgcctcctccctcttcctgtcttcctcccccatctccaccgcgccacgaaaccgcgccgggccctgccctccgtccccggcagccgcggccgccgtccangcggagcaccagcccgcgttgaccgcggcgccgaagccacccgcgctaccgttccgggtgaggccacgcttcnacctccaccgcctggagcccgacctcccgctcatcatcggggggatcaacatcccccacgaccgcggctgcgaggctcactctgacggcaacgtgctgctgcactggggggtggacgcgattctcgggcgcgctgggggtgccagacatcggccaaagtttcccggatcccaacccccgttggaaggggcccgatttcttcgggttcatgaaggaagctgtgaaaattgagccttgan

SEQ ID NO: 47336 - protein, 139 aa, Zea mays
  misc_feature: Ceres CLONE 1454389-F
  misc_feature: SWISSPROT Homolog: EC 4.6.1.12 2-C-methyl-D-erythritol 2,4-cyclodiphosphate synthase
  misc_feature (39)..(39): Xaa is any aa, unknown, or other
  misc_feature (64)..(64): Xaa is any aa, unknown, or other
MATAPYASSLFLSSSPISTAPRNRAGPCPPSPAAAAAVXAEHQPALTAAPKPPALPFRVRPRFXLHRLEPDLPLIIGGINIPHDRGCEAHSDGNVLLHWGVDAILGRAGGARHRPKFPGSQPPLEGARFLRVHEGSCEN

SEQ ID NO: 47337 - DNA, 543 bp, Zea mays
  misc_feature: Ceres CLONE 1454390-F
  misc_feature (310)..(310): n is a, c, t, g, unknown, or other
tggagctccccgcggtggcggccgctctagaactagtggatcccccgggctgcaggaattcgcacgagaccattacctagaacatcctaatcgaaaaaaaaggttctcttcgatccggcctctccgggccacccagtcccacacaaggatggatcgctatactctttgatcactgtactagtcacacgattggctacacgacacgagctcagagctctcaggtttcccaacgccggctgctggccaatggcgcagcaccacggcagccactccctggagggtcgcggcgtcgagttcgacgacgaacggncgcgccgcgcgcacgggcaacttatggaactgctttcgcgaaattatcacccccttgaatcggtttcggggtgggtttgggcccctccctgggaaacccccccccattgggcgtttgggggggggggggggccccccccccccaaaggttttttttttccccttttaaaaaaaaaatttcccccccttttcccccccgtggccccccccccctcgtgtttaaaagaagcgccc

SEQ ID NO: 47338 - DNA, 710 bp, Zea mays
  misc_feature: Ceres CLONE 1454394-F
  misc_feature: Encodes the peptide sequence at SEQ ID NO. 47339
aagctggagctccccgcggtggcggccgctctagaactagtggatcccccgggctgcaggaattcgcacgagaccattacctagaacatcctaatcgaaaacaccttcctggcagcagccttcagtcaagcaggctccgaacgtcactcagtgcaagggatatgcctgctgatgactactccctgatgccggacttcgattcccaacttatgaatgatctatgctattcccgtctcggttcatccacagggaaccactctgcacggaccaagtccctgaatccatcaaacctggatgatctcttctctgccgaactggtatcatccccgaggtatagtaatggtgatcagggtgctatgttttcaccttctcacaaggctgctatcctgaatcagttccagcagcagcagcaagcactgctttctccaatcaacacaggagtttactctccaaaggctgtggacaacaagcagttaccttcacacccatctctgctgcatgcatcgcttgggatgccctcccctggccggatgtctccacgatgtgtcgaatcaggctccccgatgaactcccacctagctgctgctcttgcccagcgtgaaagcaaccgcaaacgatgaggagccctcagttcccgtgaaccttgggcccggggggggaagaattttaattttgggtcccccttaaagaaatcagggtctaaggggaaa

SEQ ID NO: 47339 - protein, 205 aa, Zea mays
  misc_feature: Ceres CLONE 1454394-F
AGAPRGGGRSRTSGSPGLQEFARDHYLEHPNRKHLPGSSLQSSRLRTSLSARDMPADDYSLMPDFDSQLMNDLCYSRLGSSTGNHSARTKSLNPSNLDDLFSAELVSSPRYSNGDQGAMFSPSHKAAILNQFQQQQQALLSPINTGVYSPKAVDNKQLPSHPSLLHASLGMPSPGRMSPRCVESGSPMNSHLAAALAQRESNRKR

SEQ ID NO: 47340 - DNA, 843 bp, Zea mays
  misc_feature: Ceres CLONE 1454403-F
  misc_feature (371)..(371): n is a, c, t, g, unknown, or other
  misc_feature (405)..(405): n is a, c, t, g, unknown, or other
  misc_feature (415)..(415): n is a, c, t, g, unknown, or other
  misc_feature (757)..(757): n is a, c, t, g, unknown, or other
ccccgcggtggcggccgctcttgaactagtggatcccccgggctgcaggatttcgcacgagaccattacctaaaacatcctaatcaaaaaagaccccagtcccccaactcggacctggggggcatctcacccaggacgacctcccgctgggctcgggccttagggtattgcttctcctccctgctcgggtgagcacgcccgcttccagaacgcatcctcacctcctcccgtgtcaaggggatagtaggttgcaactccatcaaagctggaggaagcggacgggttaacaatgggggcccagggatcatccggtccaagtgccacttccaaggaccttaacgctgctagtaaattgtgtatgtggtgaaaangggtttggtgatggaacttgtttgtttggcacgnactgtttcanaaaacatatttatgaggttgttggattggtatctcccattggtacctactaaaacggcttcactatggtacaaaagctgtctggtttaaagcttgttattggtggtgacagattggcccgttattatgtcatcgaaggtgggctttatttccggaacttctgaattccattataaacttggtggtgtaactcgtcaaacttgtgatcgtgttttaaaccaaagtcatttttgctctatggctttgaaaattgggagaatacggaaaactctctgaaaggaatagagaatttctgtacctctatctaaaaaagtgttcatttgtgtaacttctcaaaaaattncggagggtggggacattacgcccatgtcatgggaatgtatataactataaagatgcttatttggattggcggtgagttctttaaga

SEQ ID NO: 47341 - DNA, 680 bp, Zea mays
  misc_feature: Ceres CLONE 1454404-F
  misc_feature: Encodes the peptide sequence at SEQ ID NO. 47342
ggatcccccgggctgcaggaattcgcacgagaccattacctagaacatcctaatcgcaaaagaattcctgtcactgctcgaaatcgatccgatctccgctcgcgctgaagcctgatctccaccgggttcgcagcaggggcgcaggacctcgatcacgaggaggcaggggagcagcatccacaaccacaagccatggcggggagggccaacatccccactaacaactccgccctcatcgcaatcatcgccgacgaggacaccgtcactggcttcttgatggccggcgttggcaatgttgatctgcgcaagaaaaccaactacttcctcgttgacaacaagacgacagttaaacaaatctacgatgccctcaatgaatttactacgagggaggatattgctattgtgttcatcactcagtatattgccaacatgataaggcttctggtggatagctacaacaagctcgtcccaactattctggagatcccatccccggacctatccatatgatcccatcttctttattttctcgctctcttgaagggaacactctgtctactcccaataaaccggcgccgctccgaaaaggggatacaaagaggcgttacggcacataaaaaacccctcctatacactcccttttttgcctttgtactttaacaaaaataaaggcccccttt

SEQ ID NO: 47342 - protein, 105 aa, Zea mays
  misc_feature: Ceres CLONE 1454404-F
  misc_feature (15)..(104): Pfam Name: ATP-synt_F Pfam Description: ATP synthase (F/14-kDa) subunit
  misc_feature: SWISSPROT Homolog: EC 3.6.3.14 H(+)-transporting two-sector ATPase
MAGRANIPTNNSALIAIIADEDTVTGFLMAGVGNVDLRKKTNYFLVDNKTTVKQIYDALNEFTTREDIAIVFITQYIANMIRLLVDSYNKLVPTILEIPSPDLSI

SEQ ID NO: 47343 - DNA, 716 bp, Zea mays
  misc_feature: Ceres CLONE 1454405-F
  misc_feature: Encodes the peptide sequence at SEQ ID NO. 47344
ggagctccccgcggtggcggccgctctagaactagtggatcccccgggctgcaggaattcgcacgagaccattacctagaacatcctaatcgaaaaggggcgccgcctcgccgggtgcgtgctgctgtggcccttcttcggcggcgagcggaggacgcggtcggaggcggcctacctgggagacgcgttcctgacgctcccgctgtacgaccagatgtggcgcctggcgctgccggcgggggcgacgcgggaccacccggccgcgaacccggaggcgggcgagctcccgccgctgctcgtcgcggccggcgaccgcgacatgctgatcgaccgcatcagggagtacgtggcgcgggtgcgggccgccgccccgggcaacaggcgcgtcgacctcgtcgagttcccgggcgcggggcacgggttcgccatcctcgagcccgatggcgaggctgccagtgagctagtccgcgtcgtgcggcggttcgtgcatggcggggatgccgccgggcccgggccgcccagcgggccgcggatgagacaaggagtcgtttgggatttgtcccggacccctttttcgtcacgcttccgggtgccagcacttgaaaacgtttagggtttccggcgcggggacagggttgtatcctctccccggggaccttggcccaatgggcaatgggcttgccccccccccaaataatttttcggaaactaatccc

SEQ ID NO: 47344 - protein, 132 aa, Zea mays
  misc_feature: Ceres CLONE 1454405-F
MWRLALPAGATRDHPAANPEAGELPPLLVAAGDRDMLIDRIREYVARVRAAAPGNRRVDLVEFPGAGHGFAILEPDGEAASELVRVVRRFVHGGDAAGPGPPSGPRMRQGVVWDLSRTPFSSRFRVPALENV

SEQ ID NO: 47345 - DNA, 768 bp, Zea mays
  misc_feature: Ceres CLONE 1454406-F
  misc_feature: Encodes the peptide sequence at SEQ ID NO. 47346
  misc_feature (369)..(369): n is a, c, t, g, unknown, or other
  misc_feature (424)..(424): n is a, c, t, g, unknown, or other
  misc_feature (543)..(543): n is a, c, t, g, unknown, or other
tggagctccccgcggtggcggccgctctagaactagtggatcccccgggctgcaggaattcgcacgagaccattacctagaacatcctaatcgaaaaatccttggtctccagctccgcctcgcgtcttcctttccgctgcaggaaagtgcaaacccccactcaactaaaaaaagccgcaaggcaaagagaaaaagcaacgcgaagcaaaccaccatttcggcctccccacccccatcccatctcatcccctccgaggctccagggacggcgtgatgaggccagcggcgccggctgcggcggcggacgcgcaccagtcgcggctgctctacgagctctgcgcgctcctgctgaccgtcctcggagcgtcnccggacgacggggcgggggcgcggccgctgctgccccgcgcagtgacacctgccngggtggcgtccatgctgctgggcgcgtccatggcgctgatgctctgcggctcggtcaccttcatgctcggaattcttctcatgccctgggcggcgggttcggttcccccttcctcttcncgggttcgcacccacctttccgggattgggaaggcattccccttgggccctccccgggggtcccccagagaaaaccccccccggggaaaaattcccaagcctttttttggggggggagaagaggggtctccaacccgggcccccccggggggttaaaaaggggaatcccccacattttttttttttggcccatatttttttcccgagaaatttttttttttttaa

SEQ ID NO: 47346 - protein, 141 aa, Zea mays
  misc_feature: Ceres CLONE 1454406-F
  misc_feature (51)..(51): Xaa is any aa, unknown, or other
MRPAAPAAAADAHQSRLLYELCALLLTVLGASPDDGAGARPLLPRAVTPAXVASMLLGASMALMLCGSVTFMLGILLMPWAAGSVPPSSSRVRTHLSGIGKAFPLGPPRGSPRENPPRGKIPKPFFGGGEEGSPTRAPPGG

SEQ ID NO: 47347 - DNA, 542 bp, Zea mays
  misc_feature: Ceres CLONE 1454407-F
aaagctggagctccaccgcggtggcggccgctctagaactagtggatcccccgggctgcaggaattcgcacgagaccattacctagaacatcctaatcgaaaaatactttttttcgccgcatctggggcgctcgttttcgatgcccagcaccgctacgcgccgcacttcgccccccttctcctccctctcatgcccggctggttgatctctcgtcatctcctccctccaagcacggatctttcttcgttctcctccaagcacggatcaggagcactgaaattctacctcaccgggtcctcccaactggaaaatttgaatccaaaggttgatccaaccggaaggaagggggaggtgggtattttgattcccccaggggaacccaaccttccagaaaaaggggggggggaaaaaaaataacaccccttttggaaaaaaaaaaaaccctttttggaaaaaaagaaaacctaaaaggttttatccccccgggaatttttgggggctattaaaaaaaaaaccaccccccccaaaaaaaaaaaaaaaa

SEQ ID NO: 47348 - DNA, 738 bp, Zea mays
  misc_feature: Ceres CLONE 1454409-F
  misc_feature: Encodes the peptide sequence at SEQ ID NO. 47349
  misc_feature (616)..(616): n is a, c, t, g, unknown, or other
  misc_feature (738)..(738): n is a, c, t, g, unknown, or other
ggttcccccgggctgcaggaattcgcacgagaccattacctagaacatcctaatcgaaaagaggtagcagctccccccgcaaaaaccctagctttacctccccacaagcgcctccaagatgaagctcgtcaggttcttgatgaagctgaacaacgaaacggtgaccatcgagcttaagaacggcaccgtcgtacacggaaccattaccggcgttgacatcagcatgaatactcatctgaagactgtgaagctgacactaaaagggaaaaatcctgttacccttgatcaccttagtgtgaggggaaacaacatccgctattatatttttaaaaacagcctaaacctggatactttgctggttgaggaatctaccaacggtcaagcctaaaaaccctacttctgggaagcccttggcaccagggcgtgcccgtggtcttgggcgcgctcggggccggagacgttgaccatgctacctcctcttggaaatcaattgcactgcatctgcaggataacctacattcccaatcactggaccgaggaatgccttagaataggcaacaacgaatcaattggttatgtttttttgccctggtatctatgtggatgaggtttcctntgttgagatatggcaccatcccctagaacttctcaaaaacccaattggtctctctatccctttaaaagaaaaaaaaataaaactttatcgatatctgttcacctcttagtggaggccccgcn

SEQ ID NO: 47349 - protein, 89 aa, Zea mays
  misc_feature: Ceres CLONE 1454409-F
  misc_feature (5)..(70): Pfam Name: LSM Pfam Description: LSM domain
MKLVRFLMKLNNETVTIELKNGTVVHGTITGVDISMNTHLKTVKLTLKGKNPVTLDHLSVRGNNIRYYIFKNSLNLDTLLVEESTNGQA

SEQ ID NO: 47350 - DNA, 693 bp, Zea mays
  misc_feature: Ceres CLONE 1454411-F
  misc_feature: Encodes the peptide sequence at SEQ ID NO. 47351
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaagatttctgaatttgttcctcgtttcgttgccagcccaatcggttcagtttcggcggtaacaagatcaactgcggtcgccagtcgattctgtgagcctgccagccatggagttgtccagttccgtctcgtccacggcggcggcggcggcgcaggcgcggctgctccggccgccgtcgtttcgccagccggggccggcgggattcgtgtcctgtaggagttacgctataaggagcaaactggtgagggcgatgcctccgatccttgctagcttccagcctgcatctcctcggtacccaagctttcaagacgcaaatggcaaaagacgaaatgttccttgttatcagagacaacaaaccccgcaggtagaagccaggtcgatggaggaggtatatgacgctttggctgaacaccttctttcggtcttgaagaatattgaacatcttgattcaaaatacattgttggtctagctgccccactggtgctgcaagtcacagtttgctctgaagttgtncgaacttgttaaaactttttgggcccccaaaccaccaaagggaatgggagcccccctttcctacaaaggaaattgctgcg

SEQ ID NO: 47351 - protein, 139 aa, Zea mays
  misc_feature: Ceres CLONE 1454411-F
MELSSSVSSTAAAAAQARLLRPPSFRQPGPAGFVSCRSYAIRSKLVRAMPPILASFQPASPRYPSFQDANGKRRNVPCYQRQQTPQVEARSMEEVYDALAEHLLSVLKNIEHLDSKYIVGLAAPLVLQVTVCSEVVRTC

SEQ ID NO: 47352 - DNA, 746 bp, Zea mays
  misc_feature: Ceres CLONE 1454417-F
  misc_feature (359)..(359): n is a, c, t, g, unknown, or other
  misc_feature (361)..(361): n is a, c, t, g, unknown, or other
  misc_feature (368)..(368): n is a, c, t, g, unknown, or other
  misc_feature (378)..(378): n is a, c, t, g, unknown, or other
ggagctccccgcggtggcggccgctctagaactagtggatcccccgggctgcaggaattcgcacgagaccattacctagaacatcctaatcgaaaaattagcaaaagatcccagcagcagagcacaagctgccttgcgcttcggtgatcacgaggacaccaccaagacgacgcaggttcactggttcagcgaccggtttccgcgatgtgccgcgccacggcgatagagggcggcttcctccgcccgcccccgtcccggcgcctcgacatccgcgctttctacctccgcctctcctcctgctccgccacgacgcccgcggagctcacgctggcctaccacccggccatcgggggcgcggngntgggaantcaaggccgngggctccccgcagccgcgcccggcaaagccacccttccgcggggcccccccaaacggaaacgaaggcccaacccgtttcccccccacaaggggcgcggtttggggggtcccccccccccccggaaaaaaacccccgcaaaagtgctctctccccccccccaaggggggggggggcctaataacccccccgccccccccccccccggggggggccccaaaaaggggggttccccccaaagggggcgtttttataaaaaaagaggcccccccccccccccgggggcgaaatgtatgtaaacccccccccccttgggggaaaaaaaaaaaaaaaaacccccccccccccgcgcggggggggggtgccataa

SEQ ID NO: 47353 - DNA, 752 bp, Zea mays
  misc_feature: Ceres CLONE 1454418-F
  misc_feature: Translation starting site: 227
  misc_feature: SWISSPROT Homolog: EC 3.1.3.7 3'(2'),5'-bisphosphate nucleotidase
  misc_feature (662)..(662): n is a, c, t, g, unknown, or other
ctggagctccccgcggtggcggccgctctagaactagtggatcccccgggctgcaggaattcgcacgagaccattacctagaacatcctaatcgaaaaatcccggaacagacacagattaccgcttgtatttagatcggcccagaccatctgacgacgaggaggagggcggggaggcgaggccaaatccggtcggactcggaccggcgaactcccccgacctcgctatgggcagcctccgcgtcgtcggctgggcttggaccgccgccgccgcgccggagtggggcgtgcaccgccgctgctgccgcgggacgccgctggcccgcccccgcgcggcgacgtcctcccttggcgcggggcagctccgggtcgggacggagcacgggtggctctgggattgccgcggcggcggcggcgcgggggattacgccagggagatggaggtggcggtgcgcgtcgtgcaggtggcctgcaccctgtgccagcgcgtgcaggactcgctcctccgccccggccccgacgccgccggcggcgacgggcgcgtccacgccaagctcgaccgctcccccgtaaccgtcgctggaatcaacctctgcgcgtgtacagcatggtgaaatatgctgcaatagcacgaggcgatgctgaaatcttcatgaaatttgncagagctggatacaaagagaagatatgggatcatgctgcaggggtggttatcattcaggaggctggtggagtggtcacagatgctggtgg

SEQ ID NO: 47354 - DNA, 636 bp, Zea mays
  misc_feature: Ceres CLONE 1454419-F
  misc_feature: Encodes the peptide sequence at SEQ ID NO. 47355
ggagctccccgcggtggcggccgctctagaactagtggatcccccgggctgcaggaattcgcacgagaccattacctagaacatcctaatcgaaaaaggccccggccagatccgcgcgcccgcggggaagagggcctcctctcctcctcctcctcccttggctcgcgctctggtcgaggaggcggaggccggtgccggcaggcggggaggcaggtaggtagcagcttgcggttgcgggagggaagctgcgcgcgctaggctgccatggcggtggagaagacgctgcccggcgcgagtgctgggaggaccgtgctggtcacgggcggggcgggctacatcggtagccacgccgtgctgcagctcctcctcgcgggcttccgcgccgtcgtcgtcgacaacctcaacaactcctccgagctggccgtccgccgcgtcgccgcgctcgcgggggaccactcccgcaacctctctttccacaagattgatctccgtgacaagggagcactggaaatggtttttgcttctacaagattgagctgtcatcactcgctgattgaagctgtggtgaaagcgtacgagcatacttatttgacacacctcttgcacgaaatcttcagagtatgctgttccgtgcag

SEQ ID NO: 47355 - protein, 124 aa, Zea mays
  misc_feature: Ceres CLONE 1454419-F
  misc_feature: SWISSPROT Homolog: EC 5.1.3.2 UDP-glucose 4-epimerase
MAVEKTLPGASAGRTVLVTGGAGYIGSHAVLQLLLAGFRAVVVDNLNNSSELAVRRVAALAGDHSRNLSFHKIDLRDKGALEMVFASTRLSCHHSLIEAVVKAYEHTYLTHLLHEIFRVCCSVQ

SEQ ID NO: 47356 - DNA, 700 bp, Zea mays
  misc_feature: Ceres CLONE 1454424-F
  misc_feature: Encodes the peptide sequence at SEQ ID NO. 47357
ggagctccccgcggtggcggccgctctagaactagtggatcccccgggctgcaggaattcgcacgagaccattacctagaacatcctaatcgaaaaaaccatcaggacgcggacgcggacgcggacgcggctcacatcaaacacccccttcagctgtgctcagtgctcactgccgcaaaaccacagccacacagggaagcgcccagcgccctttcacatcaccacatccacgctcctccgttccatggccatgtcgagcagcgccagcaagaagcaagcccaggcccaggcccaggcccagaaggccgggcggaggcccccggcggtgtcgtcggccgcggccgcggacgcggagatgcagagggtgttctcgcgcatcgacgcggacggcgacgggcggatctcgccgtcggagctggcggcggtgtcgcgcgccatatccccgccggcgagctcctcgcacgggcggcgcgaggtggcggccatgatggaggagctggacacggaccgcgacggcttcgtggacctgggcgagttcagggcgttccacgcgcgccggcggcgggcttggcggcgacgaccacaagacgcggagctccgcgccgccctcgccggtgtacgaaccccaaaggaaaagggcccattccggcggccaaaatgggaaagggggtcccccccattcggaaaggggggcaccccc

SEQ ID NO: 47357 - protein, 152 aa, Zea mays
  misc_feature: Ceres CLONE 1454424-F
  misc_feature (37)..(65): Pfam Name: efhand Pfam Description: EF hand
  misc_feature (77)..(105): Pfam Name: efhand Pfam Description: EF hand
  misc_feature: SWISSPROT Homolog: EC 2.7.11.1 Non-specific serine/threonine protein kinase
MAMSSSASKKQAQAQAQAQKAGRRPPAVSSAAAADAEMQRVFSRIDADGDGRISPSELAAVSRAISPPASSSHGRREVAAMMEELDTDRDGFVDLGEFRAFHARRRRAWRRRPQDAELRAALAGVRTPKEKGPFRRPKWERGSPPFGKGGTP

SEQ ID NO: 47358 - DNA, 656 bp, Zea mays
  misc_feature: Ceres CLONE 1454433-F
  misc_feature: Encodes the peptide sequence at SEQ ID NO. 47359
ggagctccccgcggtgggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacccggttcctgctccaaaatatgattcgtctggtctggcgcgcgtgagtccagctcgtgtgccgtgtgtgtctctgtgtgaggtgtcggcgggcgtgtgtgtatgtatggagtcggccgcggcggctgcggcggacgaggtgtgcgcgtggtgggtggtacgtgcttcgacgccccactgtttgtcgcggcgataatggactaccctgctgcgttttctggttaacaatgaaatgaattatttgaa

SEQ ID NO: 47359 - protein, 57 aa, Zea mays; identical to SEQ ID NO: 43282
  misc_feature: Ceres CLONE 1454433-F

SEQ ID NO: 47360 - DNA, 757 bp, Zea mays
  misc_feature: Ceres CLONE 1454435-F
  misc_feature: Encodes the peptide sequence at SEQ ID NO. 47361
  misc_feature (673)..(673): n is a, c, t, g, unknown, or other
  misc_feature (674)..(674): n is a, c, t, g, unknown, or other
  misc_feature (717)..(717): n is a, c, t, g, unknown, or other
tggagctccaccgcggtggcggccgctctagaactagtggatcccccgggctgcaggaattcgcacgagaccattacctagaacatcctaatcgaaaaaagtaggtcggtaggtatacgtgcacgtctcaccaacgcaacacaccgttgcctgtgaagcagcgcagcgcggagcggaagggtccagcgaccgcgactgatggggaggagcggcggcgagacggcggggaagaggcagcagttcgggagcatggaggagttctggggcttctacctgagccagcactccaagccgggcacgcggcggtggcacttcctcggcacgctggcctcgctcgcctgcgcggtgctcgcggccgccactggccgcgccgcggtcctcctcgcgggccccgttctcgggtacggcatggcgtggtacagccacttcttcgtggagggcaaccgccccgccacgttcggccaccccgtgtggtccttcctctgcgacctccgcatgttcctgctcatcctcaccggccgtatcgacgccgagctcgcacgcctccgcgtccggccgacggccgagtccaccgacgccgcggcggcctctgcgcaccatgactgatccgtatcctccatgctcgtctgtcttgcctatccggctacccgtagcgcgtttgaagtgaaggccnntaatcatcgattaccagcaggcagttcgtagctgtttcttggntatatctgtatcacaaccattttcacttgtatctctaatc

SEQ ID NO: 47361 - protein, 135 aa, Zea mays; identical to SEQ ID NO: 43398
  misc_feature: Ceres CLONE 1454435-F

SEQ ID NO: 47362 - DNA, 711 bp, Zea mays
  misc_feature: Ceres CLONE 1454440-F
  misc_feature: Encodes the peptide sequence at SEQ ID NO. 47363
  misc_feature (592)..(592): n is a, c, t, g, unknown, or other
  misc_feature (602)..(602): n is a, c, t, g, unknown, or other
tggagctccccgcggtggcggccgctctagaactagtggatcccccgggctgcaggaattcgcacgagaccattacctagaacatcctaatcgaaaagggacgagggaggggaaaagagagatggtggaggcatcgccggagtccggcgccgcggcgaccggaggtgcctctagtacggcggcggtgcggaaggggaagtcatgcaagggctgcctctactactcgtcagtgctcaagtcccgcggttacaacccaatctgcgttgggatcccccgctccatcccccaagttcctaactacgtggtggatgaacctaaggaggaggcgacggcgcaggggcatgacctcaggcggttcaggtacgggtgcgcgggttactccatgttcgtggacaacagggacggccagggtggtgagagcgagggcaagacgttgttgccatattgcaggggcctcgagttattggtggacagcagattggtcgagagaaagccatcggcaactgaacaagctccagcacatgttgcaaaggatgctaccatccgctctcaccaacaaggacaacagagacctcagaacttgtcgaggcangaattctggnacaggttaagaaggagcgctggactggtccctttcaggggttgcgaagaatctaaacaaaccgccattttttccaagaaaaatttcgggattggcccccgatcccctct

SEQ ID NO: 47363 - protein, 196 aa, Zea mays
  misc_feature: Ceres CLONE 1454440-F
  misc_feature (157)..(157): Xaa is any aa, unknown, or other
  misc_feature (161)..(161): Xaa is any aa, unknown, or other
MVEASPESGAAATGGASSTAAVRKGKSCKGCLYYSSVLKSRGYNPICVGIPRSIPQVPNYVVDEPKEEATAQGHDLRRFRYGCAGYSMFVDNRDGQGGESEGKTLLPYCRGLELLVDSRLVERKPSATEQAPAHVAKDATIRSHQQGQQRPQNLSRXEFWXRLRRSAGLVPFRGCEESKQTAIFSKKNFGIGPRSP

SEQ ID NO: 47364 - DNA, 641 bp, Zea mays
  misc_feature: Ceres CLONE 1454442-F
  misc_feature: Encodes the peptide sequence at SEQ ID NO. 47365
  misc_feature (51)..(51): n is a, c, t, g, unknown, or other
aagctggagctccccgcggtggcggccgctctagaactagtggatcccccngggctgcaggaattcgcacgagaccattacctagaacatcctaatcgaaaaaacacaacccaccttcacatcaagcagtacaccgccgtgtccccgatccagccacacgagtcgacactcgacacaggcccgcgatccgctcccctttcttccttccccggattcgcggcgatctagccggcggcgggcggcgcagcgatggcggggcaaaaccagcggctcaacgtcgtgccgacggtgacgatgctcggcgtcatgaaggcgcggctcgtcggcgccacccgcggccacgcgctgttgaagaagaagtccgacgcgctcacggtccagttccgcgccatcctcaagaagatcgtagccgccaaggagtccatgggcgagacgatgcgcgcctcctcctttctcctcgcgaggcagtatgtcgcggcgacggcgtcgtcacgtcgtcctcagtccatcgcgcgcctcggtcgcgtcgatcccacaggagaatgtcgcgggtcagctcccaagttcatcattcgtcacccggcgcggatccggggggcctcaagcgtctcaaacctaagggcccgcccgcggggaacagg

SEQ ID NO: 47365 - protein, 130 aa, Zea mays
  misc_feature: Ceres CLONE 1454442-F
  misc_feature: SWISSPROT Homolog: EC 3.6.3.14 H(+)-transporting two-sector ATPase
MAGQNQRLNVVPTVTMLGVMKARLVGATRGHALLKKKSDALTVQFRAILKKIVAAKESMGETMRASSFLLARQYVAATASSRRPQSIARLGRVDPTGECRGSAPKFIIRHPARIRGASSVSNLRARPRGT

SEQ ID NO: 47366 - DNA, 852 bp, Zea mays
  misc_feature: Ceres CLONE 1454443-F
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
tttttcggcctttgtgggggtggcgttctcaatnnnnnannnnnnnccaaactggagctccaccgcggtggcggccgctctagaactagtggatcccccgggctgcgggaattctcacgagaccattacctagaacatcctaatcgaaaatcccctcccctgctctggtcgtcggctcctcccttccgaataccgagcccagcttctctttttcttctccggcccgccgccaaaatgaagccccgcccccgtgaagtggtgtctggagcgggccgctcttgcgggtgaaaaagtccctgcccaagaagggcgtggcgcccgctcttgcgcctagcggggaggcctaccagggcacgccgtccgctatgaggtctcgcctcgggtgccgggcagcgccctgtggcggggtgtatttgggaaggggtgtgaaagggggaatctgcaaattgtctattgcgccatatggctcctctgcggcccccccgcgggggcgggctcatggcgggcctgggctggccccgttgtgcactgcgctgtgccgccccgggcccccggctgattgccgctgtgggcggttgtggggggcctgtcgatgcttcgggcacgaaccccctgcgctaggggtgtcgggcggggggagggggccgccctcgcatgggacgagattctcctgatatggcgagggtgtcggggattgctgtcgtttggcgcgcgcggtatgctattcgattcaggcccgcgtacccaggcgttccatggcggagctcggaattcccccgcgcactgcaacctgcctgaggaaacctatcccgcagcgttatcccgcgatcgggtgtgttctcttttcggcgg

SEQ ID NO: 47367 - DNA, 754 bp, Zea mays
  misc_feature: Ceres CLONE 1454444-F
  misc_feature: Encodes the peptide sequence at SEQ ID NO. 47368
aaagctggagctccccgcggtggcggccgctctagaactagtggatcccccgggctgcaggaattcgcacgagaccattacctagaacatcctaatcgaaaaaaaagctctcggcttcgaatcccgacaacctccctccccaagctgcttagccgccggctgggcctcagacctgcgtcaagcttccggcggcagcccatcgagcaccacaatggcgtccggcggagcggccatctcggcggggcctacaccgccgtcggcgacggcgtcgtcggttgagtggcaccagcggccgccgaacccgaagaaccccgtggtgttcttcgacgtgaccatcgggtccatcgccgccggccgcatcaagatggagctcttcgccgacatcgcccccaagaccgcggagaacttccggcagttctgcactggggagcatagaaaaaatgctttgccacaaggttataagggctgccaattccatagagtgatcaaagatttcatgattcagggtggtgacttcttgaagaatgatggtactggatgcacatcaatctacggtaccaaatttgatgatgaaaattttatagcaaagcatacagggcctggactgctctcgatggcaaacagtggaattaactctaatggatctcagttctttataacatgtgcaaagtgtgactggcttgacaacaaacatgtggtatttgggagagtgcttggagacggtttgctcgtcgtgaggaagattgtaaatgtt

SEQ ID NO: 47368 - protein, 181 aa, Zea mays
  misc_feature: Ceres CLONE 1454444-F
  misc_feature (35)..(181): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MASGGAAISAGPTPPSATASSVEWHQRPPNPKNPVVFFDVTIGSIAAGRIKMELFADIAPKTAENFRQFCTGEHRKNALPQGYKGCQFHRVIKDFMIQGGDFLKNDGTGCTSIYGTKFDDENFIAKHTGPGLLSMANSGINSNGSQFFITCAKCDWLDNKHVVFGRVLGDGLLVVRKIVNV

SEQ ID NO: 47369 - DNA, 795 bp, Zea mays
  misc_feature: Ceres CLONE 1454446-F
  misc_feature (651)..(651): n is a, c, t, g, unknown, or other
ggatcccccgggctgcaggaattcgcacgagaccattacctagaacatcctaatcgaaaaatcacaccggagtacttcagaggccggacccggcgagaagcgaccgaccgtcagccagctcacatctccctcttcataccaccatgatgagggtcgccggcaggcccattctcgtggggtatcgcctggagcccctccgccgcccccgcaggctcccggggccctctcgccggtaaactaccgagccagctactacgacgactcccctcatgaaagggggcgatcacttccaatctccctcttcgcggctgcccgaagtgttttggtaggggacttcttgctccgagaaacccaccggtgggggtttttttgacccccctttgttttctcccccacctgtggaaagaccccacgccggaaacaggggtgggtgtgtgtgtgtgatgaccgggaaccgcctcccccccgtggaagtcctcaggagggctgggatttcgccccacatttttgtcttggttggttggggaggttagtattagcaccgtcttttgtctggaactctctcccctttcaaaaattgctttataaattgggctcaacccaaagaagaaggaaatttcgtgtctttgctcactatgccaagatgagggntgttaatattacttatgcttggaaaccacagcaatcccttttagaaggagaggacacacgccttttgctatcaacaaattggagtaggagtgcttattttcgctctctgcctccataaagtatcgcttcgaccccctccacacc

SEQ ID NO: 47370 - DNA, 807 bp, Zea mays
  misc_feature: Ceres CLONE 1454450-F
  misc_feature: Encodes the peptide sequence at SEQ ID NO. 47371
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
ggggggggccccgacgcggccattctataccgtaacaggagtcnccccccnnnaaaagctggagctccaccgcggtggcggccgctctagaactagtggatcccccgggctgcaggaattcgcacaagaccgttacctagaacatcctaatcaaaaaagcacaccggacgagtgcccaggctccgtacctctccttcccttacctcgcctcgtctcctctccttgagatctccagggtacgagcgcattcgcgattttggccgcctccgccgccgtccgggaagatggcgggtctgggaaaggccatgtacggcggggggctctggatccgggagactggccaggccctcgaccgcctgggctgccgcctgcagggcaagtactttcttccacgagccgatctcaagggttcgcaccatcgatgaatatgttttaaaaaaacccctcatgtgcttaaagacggattcgacgccccaagggcgtcgcttaatgtggatgaccatgacggggcaggaaacttccctttcgccaggcccgcgtcctacgagggaacgcccacgtccccccaaattggaagcagctgaccgccatcccaaggcggtatctcctgaccacgtgcggcgaaattttaaatgcacgatgtgcaaggagctttgtcagcgcaccgctggggttctaaacgcacccccccaccataacaaatagcatgtgatttatggggcacgagcctgggtgtagcgccccaacgccccctccccacgccatcagcggggaggaaacccccagtatacgccggcgcgcggcgcg

SEQ ID NO: 47371 - protein, 46 aa, Zea mays
  misc_feature: Ceres CLONE 1454450-F
MAGLGKAMYGGGLWIRETGQALDRLGCRLQGKYFLPRADLKGSHHR

SEQ ID NO: 47372 - DNA, 777 bp, Zea mays
  misc_feature: Ceres CLONE 1454455-F
  misc_feature: Encodes the peptide sequence at SEQ ID NO. 47373
  misc_feature (21)..(21): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (777)..(777): n is a, c, t, g, unknown, or other
ggggggggtccgccctcgccncgcagttacagcatattctccctttnnnnnnnctaaagctggaactccccgcggtggcggccgctctagaactagtggatcccccgggctgcaggaattcgcacgagaccattacctagaacatcctaatcgaaaaacacagctcaacaaaggagcgcggcgggccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagaccgccaagtacaacttccggaccagcaccgccccccccaagctcggggtcatgcttgtggggtggggaggaaacaacgggtcctcgctgacggctggggtcattgccaacagggaggggatctcatgggcgaccaaggaccaggtgcacccaagcccaactactatggtgtggctccccccaggtttccccccccataaaaggggagctactgaggggggaaggggatatgtgtgcgcgcggttcgaaaagggccccccctaccgcagggtggaaacccctaaaaaaaaaccttgtgtgttggggaggcgtctgggaaatatcggcgccacgcttggaan

SEQ ID NO: 47373 - protein, 160 aa, Zea mays
  misc_feature: Ceres CLONE 1454455-F
  misc_feature: SWISSPROT Homolog: EC 5.5.1.4 Inositol-3-phosphate synthase
MFIESFRVESPHVRYGPTEIESEYRYDTTELVHEAKDGASRWVVRPKTAKYNFRTSTAPPKLGVMLVGWGGNNGSSLTAGVIANREGISWATKDQVHPSPTTMVWLPPGFPPHKRGATEGGRGYVCARFEKGPPYRRVETPKKKPCVLGRRLGNIGATLG

SEQ ID NO: 47374 - DNA, 777 bp, Zea mays
  misc_feature: Ceres CLONE 1454457-F
  misc_feature: Encodes the peptide sequence at SEQ ID NO. 47375
  misc_feature (235)..(235): n is a, c, t, g, unknown, or other
  misc_feature (398)..(398): n is a, c, t, g, unknown, or other
  misc_feature (417)..(417): n is a, c, t, g, unknown, or other
gctctgaactagtggatcccccgggctgcaggaattcgcacgagaccattacctaggacatcctaatcgaaaagtccccgtctcaccgcactgccttgccccctactctgcctcgcttagcttagccgccgctgctacgcactctcgccgtccttgttcccgcgtcgctctgctcgcgatggcgtcccgcgttgcagtgctgctcgtggccgtggcggccgtgctgttcgccgcnccatcagcgcaagagatggacctgggcgtgccgcccgcgccggcgcccgacacgggcgcggcagcgggggccgcggcgtcggtcctggccgtggcttggtttgtaaaattcttcagcctcgtcgccggtggcctcgtgcgtaagacgaccccaccccccaccncgacggctaacctgctggntccggggtcaaggccgaacccctggtccgaaccctttctccccgttatttagcacatataactagccagcccatggggctggggttgaattggggtccctgcctcccccccttggggggggcttgcagaactttggagcgtattgccttaattcttttttggtgcccatactgcaaactcttccaaaggtatatctctggctgttgcaagaaaaaaaaaaaaaaaaaagctttaatcaatacccaacccaccttccggagggggggcgccccgtgaccccaatttacaccacactaatgaggtccggttttccccgccctccccgcgggcccgggtgttaataccacgctggtgggtggg

SEQ ID NO: 47375 - protein, 96 aa, Zea mays
  misc_feature: Ceres CLONE 1454457-F
  misc_feature (74)..(74): Xaa is any aa, unknown, or other
  misc_feature (80)..(80): Xaa is any aa, unknown, or other
MASRVAVLLVAVAAVLFAAPSAQEMDLGVPPAPAPDTGAAAGAAASVLAVAWFVKFFSLVAGGLVRKTTPPPTXTANLLXPGSRPNPWSEPFLPVI

SEQ ID NO: 47376 - DNA, 760 bp, Zea mays
  misc_feature: Ceres CLONE 1454461-F
  misc_feature: Encodes the peptide sequence at SEQ ID NO. 47377
  misc_feature (653)..(653): n is a, c, t, g, unknown, or other
ggagctccccgcggtggcggccgctctagaactagtggatcccccgggctgcaggaattcgcacgagaccattacctagaacatcctaatcgaaaaccccaccacctccctgtatccctcctccccttctggccgacgaaaccctacgcgcgcgcgctgccaagacctcgccgccgacgcctactccgactccgacgccgcagtcgtgatgtacgccgacaggacctcgggcaggaaacgctctgtaatggaccgcctcggctcgggcggcggctcgcgctcgcggtccgacgacgcaaaaaggttttgccaggatgatgggacatggagacgtgagctttataaggattctagaggaactcagacttcatctgaacctacttccagaaatctggaatcgaacaaaaaatcccaagtgcagcaaaaggttgtgaagaaattaccagtttcagatcttcgtggaaagttatctggtgtcgcgagccagcgccctcaacttagcagtactgttcaggtcccaaaacctgtaaaagaggttattaagagcaacaaacctgttcaaaagagagaccccgctccaactactgcccctcctgacatcaagaaacccagtgcacctgcacccgtaccagcaccatctgcactaccaaagncatcccagaacaggattgatgcttcgcttgacagtttactgaagtctcttgatctagagaagtattttgataatttccaggcctgagaggtttgatatgaagcattg

SEQ ID NO: 47377 - protein, 176 aa, Zea mays
  misc_feature: Ceres CLONE 1454461-F
  misc_feature (149)..(149): Xaa is any aa, unknown, or other
MYADRTSGRKRSVMDRLGSGGGSRSRSDDAKRFCQDDGTWRRELYKDSRGTQTSSEPTSRNLESNKKSQVQQKVVKKLPVSDLRGKLSGVASQRPQLSSTVQVPKPVKEVIKSNKPVQKRDPAPTTAPPDIKKPSAPAPVPAPSALPKXSQNRIDASLDSLLKSLDLEKYFDNFQA

SEQ ID NO: 47378 - DNA, 757 bp, Zea mays
  misc_feature: Ceres CLONE 1454462-F
  misc_feature: Encodes the peptide sequence at SEQ ID NO. 47379
  misc_feature (14)..(14): n is a, c, t, g, unknown, or other
  misc_feature (16)..(16): n is a, c, t, g, unknown, or other
  misc_feature (18)..(18): n is a, c, t, g, unknown, or other
  misc_feature (30)..(30): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tttttttgcggccncncntccactgtacanatggacaaaaaannnnnnnnnnccaaactggggctccccgcggtggcggccgctctagactagtggatcccccgggctgcaggaattcgcacgagaccattacctagaacatcctaatcgaaaaaacgcgaagcaaacccttttcggcgtccggcgtccccatccccaccccaccaggccaccacggcgggatgaggccggcgtcggacgcgcaccagtcgcggctgctctacgagctctgcgcgctcctgctgaccgtcctccgggcgtcgcctgacgacggggcggtggcgcggccgctgctgccgcgacatgtgacgcccgccggggtggcgtccatgctgctgggggcgtccatggcgctgatgctctgcggctcggtcaccttcatggtgggaaacatcctcatgccctgggttgtcgggctcggtttcgtgttcctcttcgtcggcttcatcaccaacctctccgggatctggagggacatcatcctctgggcctccgtcgcgtggtccgcatcggactcacccaaggaggcaccctccccatgggatatggtttccaaaccttcatccttgtcgacgtgaatccaaagacaaggtaaggctcccacggaggtccataaaaagcgggagatggttgaacaacaaaactccttgccattggcaacccataatcttccctccctggacaaacctttctttaaacatgggaaaaccgcaaacta

SEQ ID NO: 47379 - protein, 131 aa, Zea mays
  misc_feature: Ceres CLONE 1454462-F
MRPASDAHQSRLLYELCALLLTVLRASPDDGAVARPLLPRHVTPAGVASMLLGASMALMLCGSVTFMVGNILMPWVVGLGFVFLFVGFITNLSGIWRDIILWASVAWSASDSPKEAPSPWDMVSKPSSLST

SEQ ID NO: 47380 - DNA, 711 bp, Zea mays
  misc_feature: Ceres CLONE 1454465-F
  misc_feature: Translation starting site: 438
  misc_feature: SWISSPROT Homolog: EC 1.10.2.2 Ubiquinol--cytochrome-c reductase
ggagctccccgcggtggcggccgctctagaactagtggatcccccgggctgcaggaattcgcacgagaccattacctagaacatcctaatcgaaaacggtacactacccggccgcgacgacgacgacacacgcgactgcagggcgcgtttcgccatcgaatctcccttcttcgccgctgccagagggttttctgcagagactcttgctccaagaaaccaggatgtgggcttatccgagctcccagcaactgtggcagctgtgaagaatccaagtggaaaaatcgtgtatgatgagtataaccatgagcgctacccgcctggagaccccagcaagcgtgcatttgcctactttgtgctgagtggtgggaggttcatttacgcatctttgctgcgacttctcgtcttaaaatttgtcctgagcatgtcagcaagtaaggatgttctcgcgcttgccctcacttgaggttgacctctcaagcattgagcctggaaccacggtgacggtgaagtggcgggtcaagccggtcttcataaggcgcaggactgatgatgatatccagctggccaacagtgttgacgtcccatccctcccgccccccgagcaggatgcaaagcgtgtcaagaaccccgaatggctgggccccctttggggcctgcccctcacctggggtgcctcccggttccctaaggggagaaatttgggtgggcggg

SEQ ID NO: 47381 - DNA, 660 bp, Zea mays
  misc_feature: Ceres CLONE 1454466-F
  misc_feature: Translation starting site: 169
ggatcccccgggctgcaggaattcgcacgagaccattacctagaacatcctaatcgaaaaaaaaatctggcagaagccgaaccgtatagcccgagcctcgcggtcgaggatccgtcctgcaaatctcctctcatacttctccaccggatccctgtaagattcccggagatgtcggacgaggagcaccagttcgagtccaaggccgacgccggcgcctccaagacctacccgcagcaggccggtaccatccgcaagaacggctacatcgtcatcaagggacgtccctgcaaggttgttgaggcctccacttccaagactgggaagcatgggcatgccaagcgccactttgttggcattgacgttttcactgcaaagaagcttgaggatattgttccttcttctcacaactgtgatgttccccatgttgatcgccctgactatcagctgattgacatcactgaagacggatttgtagagccttttgactggcagtggcatcactaaggatgacctcaggcttccgactggacgagctctggaaggccaaatcaagagcggatatgatgatggaaaggacctcctcctgacggggatggcttccatgggctaaggaacagacctcctctggtacagaagatcgggggcaagtaactaatcccg

SEQ ID NO: 47382 - DNA, 724 bp, Zea mays
  misc_feature: Ceres CLONE 1454467-F
  misc_feature: Encodes the peptide sequence at SEQ ID NO. 47383
ggagctccccgcggtggcggccgctctagaactagtggatcccccgggctgcaggaattcgcacgagaccattacctagaacatcctaatcgaaaaaacaagagagcgagatagagaaagaagagataaaataaaaattttaagaagataatggagaagagcgatgatcatcacaagactagccacggtggtgctgcggcggagaagtgggaggaggttagtactgcaatccgaactgcagagacaatgctccggttagctccggtggggctttgtcttgcggcgcttgttatcatgcttaaagactctcagaataatgagttcggttcagtttcttattccaatctctcagctttctggtacttggtgcacgcaaatggaatttgtgcaggctactctctcctgtcagcagctattgcagccatgcctggttctttctctacaatgcctcgtgtttggaactttcttctgtcttgaccaggttctaacataactgggtccttggctgctgagactgggcccaccggaattctggccttacccccaaaagggaaacaaggcctttcccggggagaagggcgggcacccccttggggaatttcccccaaaaaacccccggcttttgttaaaattaacactccccgcggggtgtggataaaaggcccttggggcccccaattcccccaaaaaaaccccttcccccgtgggagccccacccaccctt

SEQ ID NO: 47383 - protein, 108 aa, Zea mays
  misc_feature: Ceres CLONE 1454467-F
  misc_feature (24)..(107): Pfam Name: DUF588 Pfam Description: Domain of unknown function (DUF588)
MEKSDDHHKTSHGGAAAEKWEEVSTAIRTAETMLRLAPVGLCLAALVIMLKDSQNNEFGSVSYSNLSAFWYLVHANGICAGYSLLSAAIAAMPGSFSTMPRVWNFLLS

SEQ ID NO: 47384 - DNA, 783 bp, Zea mays
  misc_feature: Ceres CLONE 1454473-F
  misc_feature: Encodes the peptide sequence at SEQ ID NO. 47385
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (426)..(426): n is a, c, t, g, unknown, or other
ttttccccccnnnntctttcntcttttcccgggnnnnnntcaatnnnncaaagctggaactccccgcggtggcggccgctctataactagtggatcccccgggctgcaggaattcgcacgagaccattacctagaacatcctaatcgaaaaccatgcttcacaacaccaggatctgggtgagtcgcgtggcgcgctctatatacaagtgcggttctccactgcaggactctccctctccctcttcttcctcctcctcctcttcctctgttttgcttttgtgttgctgttaggttcttggatagtttgatgaatgatactgtgcagcagcagcagcagtagtaattcatagtgggcggtgtgatagcacccctgagatcgaggaaaggatggaggtgttcatccaccaggactacgtgaacaagcgnaacaagctgaggagggagcacaggcgccgggaactgcacacgctgcaggtggagagcaaccccgacgcgttccagggaggcgctggcaagcccggagaaccccgaggaaccccggccactggcctgaacgccgaaccggggtgttcccccctccaactttcggaaaccccaacttcaaaagaaccatcttgcaatcctcccggcccccaccggtggggcaaggccttcccggttgggcctacagaaaaaatccccccccctttcaaatggccttcaaggccgctccaaaaaaggccgcccgaaacgtgggaatggggctctcaattccggtttggtttacccaggctcggcaagtgg

SEQ ID NO: 47385 - protein, 132 aa, Zea mays
  misc_feature: Ceres CLONE 1454473-F
MEVFIHQDYVNKRNKLRREHRRRELHTLQVESNPDAFQGGAGKPGEPRGTPATGLNAEPGCSPLQLSETPTSKEPSCNPPGPHRWGKAFPVGPTEKIPPPFKWPSRPLQKRPPETWEWGSQFRFGLPRLGKW

SEQ ID NO: 47386 - DNA, 704 bp, Zea mays
  misc_feature: Ceres CLONE 1454482-F
  misc_feature: Encodes the peptide sequence at SEQ ID NO. 47387
tggagctccccgcggtggcggccgctctagaactagtggatcccccgggctgcaggaattcgcacgagaccattacctagaacatcctaatcgaaaagtccgtggctctcgcctgccacccaagcagccatggcggccgcgctgctccgccgtgcgctccacctccgtcgcgtgctcccctcgcccctcgcctccgcacagcgcctctcccccgccttctcggccactccgaccccaaagacctcccagcagaacgccgccatcaccacgatcgacctctcctccgacgagagtcgccgccgcctcctcaacaggttggtgtaccggagcaagcagcggggtttcctggagctcgacctggtgctgggcacctgggtcaaacagcacgtgcacgccatggacgagccccacatccgcgcccttctacaagtgctcgaccccgaaaaccagatttgtggaaatggttgactagccagaaccacccaccaaagatccgaattctaattccggggtttcccgcctccaaaacaaggggccaaaaaaacccgataaagactggttcctccccaaaacccaataaaacctggccaaccttgggttaaaaggagggggatacacaaaaaaaagggaaaaaagggcccctttctttgaaaataccgggagccctggtcttgaaaagggggataaaaaatttttccccccaa

SEQ ID NO: 47387 - protein, 112 aa, Zea mays
  misc_feature: Ceres CLONE 1454482-F
  misc_feature (55)..(111): Pfam Name: DUF339 Pfam Description: Protein of unknown function (DUF339)
MAAALLRRALHLRRVLPSPLASAQRLSPAFSATPTPKTSQQNAAITTIDLSSDESRRRLLNRLVYRSKQRGFLELDLVLGTWVKQHVHAMDEPHIRALLQVLDPENQICGNG

SEQ ID NO: 47388 - DNA, 702 bp, Zea mays
  misc_feature: Ceres CLONE 1454486-F
  misc_feature: Encodes the peptide sequence at SEQ ID NO. 47389
ctggagctccccgcggtggcggccgctctagaactagtggatcccccgggctgcaggaattcgcacgagaccattacctagaacatcctaatcgaaaagagtcgcgatctccacctccctcgaccaccactcccgtaacccacttccgggtgggccccacgtcgccgctggcgaccagcacctcccctccttgactccctcgctacccgccgcccgccgagcagcatgaggaagaggaggtgctggtgccgtatggcccgcacctggagttgcccaatggagcgcagccaatggaaggacttcagtgatcttttggtacatcgctgctaatacaaacaacctacccaaactgcttttgtgaagtgaaaccaaaaaaggaggtgtgctactgttcttctgtattgatgtcaatgcaacagcaggtcgctgaaattgaaattgatgtctacaaagtgcttcccatttcattattagattactgatataactatgcctagagagtggagataagtggaggtggcaccaccaattccttgatgtaccaggaatgtttggattgttgtattctgacattgtttggttcaacatattcaagttggagcgtcaggtctccaacaattaaactaaatggaggagtggagcttcatgttgggatgatgcatgcacctttcaagtttcggaatgttgtgctcaactgcaact

SEQ ID NO: 47389 - protein, 55 aa, Zea mays
  misc_feature: Ceres CLONE 1454486-F
MYQECLDCCILTLFGSTYSSWSVRSPTIKLNGGVELHVGMMHAPFKFRNVVLNCN

SEQ ID NO: 47390 - DNA, 696 bp, Zea mays
  misc_feature: Ceres CLONE 1454488-F
  misc_feature: Encodes the peptide sequence at SEQ ID NO. 47391
ggagctccccgcggtggcggccgctctagaactagtggatcccccgggctgcaggaattcgcacgagaccattacctagaacatcctaatcgaaaacacgattgcagagccagagcgagacgcgactgcttttctgcttcatccacattggtagctagcttacgacgttcacgcatcgctttccgggccgtctccggtggtttagctcagcagagcggggaaggaagaagatgacctccgtgagcgcgaggcccgttggcgtggggtactgcttcggcggggcgaggtgccagccacggtcgcgggtgcgggtttcggccgcggcctcggcagtgaccgcgcgcgcgcccacgatggcggcgaccatgtacgagcggcgcgccgcccaggagacggcggggccccaccacatcaaggcggcgtaaccggctcgcctcgcggtggtggccccctggacgcctgccccgtgcggcctcctatccgtttcatgtcgcccccggtaggcctaacaaggttccggtcccaccccccagcgccggcggcggctaacaacttcccagctccccttgctggtctccctctttctgccactcccgggtaccgcgccggccccccccccctccgttcccccccattgcgtacgtctccaaccaaccctctctttcctttagctcccccttccggttcggaccccct

SEQ ID NO: 47391 - protein, 64 aa, Zea mays
  misc_feature: Ceres CLONE 1454488-F
MTSVSARPVGVGYCFGGARCQPRSRVRVSAAASAVTARAPTMAATMYERRAAQETAGPHHIKAA

SEQ ID NO: 47392 - DNA, 701 bp, Zea mays
  misc_feature: Ceres CLONE 1454490-F
  misc_feature: Encodes the peptide sequence at SEQ ID NO. 47393
  misc_feature (683)..(683): n is a, c, t, g, unknown, or other
  misc_feature (685)..(685): n is a, c, t, g, unknown, or other
aaagctggagctccccgcggtgacggccgctctagaactagtggatcccccgggctgcaggaattcgcacgagaccattacctagaacatcctaatcgaaaacgccgcacgaaccgacgcactagaccgacccgcgaatcccccgcgcgcgcgccgtgcggtcaccgtccgaggccacggcaccgccggcccccgcccccgccccggccgccaagagcaaaggcaaggccgacgcttcctcctcgtcgtcctcctcctccactccaccgaggtcgcgccgcgcgcttgccgtcgtgatggccgcgtcgctgctcgtgctcgccgtggcgttcttggttggctctggctccggggggatcgatgggggcgcagcggctcccgtcgaggtggagggcaccgaggtggccttacgtaccgtgatctagctgatgcacgagaagacgaagcaccgtctggcctcgtaggatgtgccctacggctcaagcatggggtcagtattctgtcacctggtttcttgagggcgatgactcaaattggttccgggataataagggccacttccaaattcttcggtctaaaccaaggggaaagcccttcaaaacccgggggccctcttcaggtttgccataattttgaggaccccggaagtgggttggcaaagggtaccctgggcgccggttcangngttgtttctgtgctta

SEQ ID NO: 47393 - protein, 42 aa, Zea mays
  misc_feature: Ceres CLONE 1454490-F
MAASLLVLAVAFLVGSGSGGIDGGAAAPVEVEGTEVALRTVI

SEQ ID NO: 47394 - DNA, 885 bp, Zea mays
  misc_feature: Ceres CLONE 1454491-F
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (436)..(436): n is a, c, t, g, unknown, or other
  misc_feature (688)..(688): n is a, c, t, g, unknown, or other
  misc_feature (722)..(722): n is a, c, t, g, unknown, or other
  misc_feature (736)..(736): n is a, c, t, g, unknown, or other
  misc_feature (737)..(737): n is a, c, t, g, unknown, or other
  misc_feature (796)..(796): n is a, c, t, g, unknown, or other
tggtcccgcaggggggggngnnnnggggggggggggnnnnnnttnnnataaaaactggggctccccgcggtggcggccgctctagactagtggatcccccgggctgcaggaattcgcacgagaccattacctagaacatcctaatcgaaaaatggagctaactacccccacgctggttcgctacagtcgccgcagcacgcgtgggtatctgggcggcgccccgcggagaagaggaggcagcgggctctccgcccgccatggcgggctcttccgaccccgataagctcatgagcaaaggcgactaactaacaagattgagttttacaagatggaatgccgacttgtaaaagcgcgacctccttgtatgaccaagctgcaattgcgtataggtccaaaatggattatggtgaaagcagaggatgttttgtgagaaggnttcaactaggacagcgaaatgatctcccccaccatgggggaggggtgcttggcctgttggatatctgcctccctgccatacccccatactaacgcactggggagtacggcaactgtcagtcatccggtaatttctatcccgggaaaagcccttcccaaacatattccccgcgggaattgttggaataggggcactatcccactgctaacaagaaaccactccatcccagatggagtgacccgccatcacctntaaaggagaaagatcctgccaagcgaggaagtgntaggtaaacaggcnntaacaccaaggcgcgtgttactcgcacccaataaaagatcgacttactaaacgaaacanccatgcacctattcgtctgtcgaatcctaatgcccacacagtcggggttctcgctatatccttgtagttacgcaatgattgctgtgctg

SEQ ID NO: 47395 - DNA, 740 bp, Zea mays
  misc_feature: Ceres CLONE 1454496-F
ccccgcggtggcggccgctctagaactagtggatcccccgggctgcaggaattcgcacgagaccattacctagaaaatcctaatcgaaaaccgcactgctccagccgcgatggaacagtcccagacgaaacaagcctggtggtagtgggtaccttgccgttgccggcctggccggctggccctcgagtgcgttcctcgctcgatctccctccttcggtcaaaagccaacatgacaacacacgagtctgggtagctgtcccccgcgcggctcgccccctcgctcctcggcgccgctgccggcccgcgcctgcgtctgcggatcgcgccctctatacctccgcccgcccgtccccctggtgagggacagcctgcccccaaaattccccaccccatcaccaccgacactggttggaatcctgcgggtaaggtccaaatggcggtcactggatgctatgaaaattctttacccaccaagcgctcatttaatcccctcttcatgcggggactcgcgccctctaacaaacaacatacttcattcattttcgtttccctccactcaacctttaccgtgttaaatcctccccctccctccccccctgtagccatttaaaagcccacatacaattcggttttgagccgaatcaaatttctatccgtacacgaaaagcggtacgtaccctgataacccgtggtacaccctttatcgctagacactcccttgaatattatcactcccaact

SEQ ID NO: 47396 - DNA, 762 bp, Zea mays
  misc_feature: Ceres CLONE 1454506-F
  misc_feature: Encodes the peptide sequence at SEQ ID NO. 47397
  misc_feature (762)..(762): n is a, c, t, g, unknown, or other
tggagctccaccgcggtggcggccgctctagaactagtggatcccccgggctgcaggaattcgcacgagaccattacctagaacatcctaatcgaaaaatctatctttgtggtcgtggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagtcgcaggatggatggctgaataatggggacaaagttcctcctgctgagtttgctaacgtagcacaagagtattctgaattgccatcaggggagaaaagtgggagatcttggttggtttcccccggggcaagatggcttgtcccttccaggaggttgcttttcaacccactgaagggaactggttaccgccccattcaatccccccccgggtttcacttttttcctcctgccaggaagggaaaactgatcttgaaatgtccgttggggaaaatgcttcctccgttttattgaaacccatggaaatttacccccttttctaaaaacccgcgggacaagggcacttttgggtgggggccttctcgatttcttttcccaaaaattgccaaaan

SEQ ID NO: 47397 - protein, 167 aa, Zea mays
  misc_feature: Ceres CLONE 1454506-F
  misc_feature: SWISSPROT Homolog: EC 5.2.1.8 Peptidylprolyl isomerase
MGKDSKPKDAKGKGKQAAGSSGGDDGGGKGGKGKGKGKGGKSADGLGTCTYVKARHVLCEKQGKINEAYKKSQDGWLNNGDKVPPAEFANVAQEYSELPSGEKSGRSWLVSPGARWLVPSRRLLFNPLKGTGYRPIQSPPGFHFFPPARKGKLILKCPLGKMLPPFY

SEQ ID NO: 47398 - DNA, 757 bp, Zea mays
  misc_feature: Ceres CLONE 1454508-F
  misc_feature: Encodes the peptide sequence at SEQ ID NO. 47399
ctggagctccccgcggtggcggccgctctagaactagtggatcccccgggctgcaggaattcgcacgagaccattacctagaacatcctaatcgaaaaacacaaagaagctccataattaattattgccctttcagttcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgttccaataaattgctagtaaaaataatggcatcgtcggtatgcatgaataaaatgtatcagaatgttcatcctttcacgattggatatatgaaaattggatatatgaaaatgtgctcaaaaaaaaaaaaaaaaaagcttatcgataccgtcgacctcgagggggggcccggtacccaattcgccctaagtgagcgattacccgccctggcgcgttacacgctgctggaaactgcgtacaactatcgctgcgacatccctcgcagtgctatacgaagcccacgatcgctcacgtgcactgag

SEQ ID NO: 47399 - protein, 71 aa, Zea mays; identical to SEQ ID NO: 46326
  misc_feature: Ceres CLONE 1454508-F
  misc_feature (12)..(71): Pfam Name: potato_inhibit Pfam Description: Potato inhibitor I family

SEQ ID NO: 47400 - DNA, 808 bp, Zea mays
  misc_feature: Ceres CLONE 1454522-F
  misc_feature: Encodes the peptide sequence at SEQ ID NO. 47401
  misc_feature (466)..(466): n is a, c, t, g, unknown, or other
  misc_feature (808)..(808): n is a, c, t, g, unknown, or other
aaagctggagctccccgcggtggcggccgctctataactagtggatcccccgggctgcaggaattcgcacgagaccattacctagaacatcctaatcgaaaaacgagcacacatcccctcccttcttcggttattcctcgccgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcccgaacctgatggcgaggaagatgaatgacacggacccccaccccgagctcaaggaggcctttccgcgtcttcgacaaggaccagaacggnttcctctccggctgccgagctccggccttgtcatgaccaacctttggcgagaaacctgaccgacaaggaagcccaacaagataatcccgggaggcccaattctaatggccattggcccaaataaactcccaaaggagtttgtcaaggtttttaagggccacagggaggggacggcccccccgggaaaaacctttccctggggttggagggggattttccggggctgaaagtctggacttgtggcggggccctttaagaaaccccaccacgctctccgcggagggggatatttttctggagaggcggccctcttaaggggcgtttattcctgggaacccctan

SEQ ID NO: 47401 - protein, 118 aa, Zea mays
  misc_feature: Ceres CLONE 1454522-F
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (100)..(100): Xaa is any aa, unknown, or other
MADQLTDEQIAEFKEAFSLFDKDGDGCITTKELGTVMRSLGQNPTEAELQDMINEVDADGNGTIDFPEFPNLMARKMNDTDPHPELKEAFPRLRQGPERXPLRLPSSGLVMTNLWRET

SEQ ID NO: 47402 - DNA, 731 bp, Zea mays
  misc_feature: Ceres CLONE 1454527-F
  misc_feature: Encodes the peptide sequence at SEQ ID NO. 47403
aagctggagctccccgcggtggcggccgctctagaactagtggatcccccgggctgcaggaattcgcacgagaccattaactagaacatcctaatcgaaaaaattaccccgactgcccgagctcgccggctcgctgccactaacatgccaagagtaatccagcgcccaccgcatggccgcgcgcgcacctctcatcatgccgcgcgccgcctccagcgccggcccggtcccggctgcggcgacaaccgtggccaggacgccagtccgcgcagtgtctccacacgaggggggctgacgacggcctcttcatccaccagaggacagcgcgggcggtccaccacctcctccctggcgccaagttcggagtgattgggagcacctccaaggccgcgccgtcggaggggctcgcgcagaagctgcaggagatcgatgtgttcgatctgagcggcaagacggcgcccatccttgatctgtgcaacgaaaagaacgcagaggttgcctttgccctgcatttcgggtgcgtgctgtgccgaaagatggcggaccttctcgcctcgaaacaggatgacatgcaggctgctggaattgctcttgttttaactgcaccaggaagtgatgaacaagcaaatgcattttgtgagcaaaccaaattcaaaggagaagtgtatgctgaccctactcactcatcgtatgacgctcttgaatttgcattcgggttgttctcgaccttt

SEQ ID NO: 47403 - protein, 65 aa, Zea mays
  misc_feature: Ceres CLONE 1454527-F
MADLLASKQDDMQAAGIALVLTAPGSDEQANAFCEQTKFKGEVYADPTHSSYDALEFAFGLFSTF

SEQ ID NO: 47404 - DNA, 750 bp, Zea mays
  misc_feature: Ceres CLONE 1454532-F
  misc_feature: Encodes the peptide sequence at SEQ ID NO. 47405
  misc_feature (317)..(317): n is a, c, t, g, unknown, or other
  misc_feature (402)..(402): n is a, c, t, g, unknown, or other
  misc_feature (475)..(475): n is a, c, t, g, unknown, or other
  misc_feature (482)..(482): n is a, c, t, g, unknown, or other
ctggagctccccgcggtggcggccgctctagaactagtggatcccccgggctgcaggaattcgcacgagaccatacctagaacatcctaatcgaaaagaacaaacaaaacatttatataaccgcgcttggatcactagctagctctcgctcgtcgcaacaagcgaagagcttggtcgttttggttatggcggtgatgaagagcaggacggtcatcgtcgccgccgttctgttggcggttgtcattctgtcctcgctgtgtccatgctacgaagccggcggctgcatcgggaagccgcccaagacgccggcgccgaanaggccctgcttctcgccctactccgaggaccactgtgaccgccagaactgccgcttcgtctgcatgtcgcacgggtacagtgacngtggctggtgtgacaagaggggagtgcgcacaatgtgctgctgctaccataggtagaatacataccatagcancatgtantggttggtgcctgtgccatgaaatgaatcatccatctcttgctgcctggcctggttggggcaatttctgaaataaagaaactgtttttttttgttccaaccgcaaaaagccgcttaatgccccaggcccaaaaatgattcttggttagaaccccggcggtgttttgctttccccccccggaattggccccagaagttcccaaaagaaacaccccccgcccggggtatttttttcttttttaaaaaaacctccggggggaataccccgg

SEQ ID NO: 47405 - protein, 90 aa, Zea mays
  misc_feature: Ceres CLONE 1454532-F
  misc_feature (44)..(44): Xaa is any aa, unknown, or other
  misc_feature (73)..(73): Xaa is any aa, unknown, or other
MAVMKSRTVIVAAVLLAVVILSSLCPCYEAGGCIGKPPKTPAPXRPCFSPYSEDHCDRQNCRFVCMSHGYSDXGWCDKRGVRTMCCCYHR

SEQ ID NO: 47406 - DNA, 882 bp, Zea mays
  misc_feature: Ceres CLONE 1454542-F
  misc_feature (15)..(15): n is a, c, t, g, unknown, or other
  misc_feature (37)..(37): n is a, c, t, g, unknown, or other
  misc_feature (38)..(38): n is a, c, t, g, unknown, or other
gtttctttagaccanaggtttatttttatattccccnnccccaaaactggagctccccgcggtggcggccgctctataatagtggatcccccgggctgcaggaattcgcacgagaccattacctagaacatcctaatcgaaaacacctgaagatgcagatgttcatatagttctgggagtcttatacaacctatcaagagagtatgataaagctatagcttcatttaagacagcactacagctcaaaccacaggactattcactctggaacaagcttggtgcaccccaagcaaacagcatccagagtgctgatgcaatattggcgtatcatcaggctctggacttgaaacccaactacgtgcgtgcatgggcgaatatgggaatcacctatgccaaccgaggtttgtatgatttttttcccctcgatactatgtaagggcagttgcaatgtatttttccccctccacaatgcctggccagtacctggaggattctcttctctagcaatgccttccccaacccgacacataattggttgccatggcgaactccccccaacccttgaaccactctttcaaaaaaaagagtttttcctcctgtggaaccccctcccggggtccatagggcatttaaaacctttccctcgcggaaaggaatcccctcatcctttatcaaaccccgaagttaactgttcctctgtgggctaatggaaaattggtaattggcaagaccattaacccgttttttgacctttacaatgctcactccctatacttctactttctagagaaggcgcaggaaatgcgctaccatattatggaatcccaggcaatcaaccttcctacttgtttttgaactatttctagggatcactcagccctc

SEQ ID NO: 47407 - DNA, 738 bp, Zea mays
  misc_feature: Ceres CLONE 1454544-F
  misc_feature: Encodes the peptide sequence at SEQ ID NO. 47408
ctggagctccccgcggtggcggccgctctagaactagtggatcccccgggctgcaggaattcgcacgagaccattacctagaacatcctaatcgaaaagtacaacagtgcccagtgcccaccgcggcagatcttcgacgcctccgagggcgatggaggaggacggcggctccggcagcgatagcatggagttcgtcgcgggagcggagactagcgctggcgcaggcacaaacgccggcaggaaccgcggcgtgggttcagggaccagcgtaggcggtggcggcggcacgaagctgccgcatgtgctgcaaaagagtttcggcgaggtgcaagggattctggagcacaaccgcgtcctgattcaggagatcagccagaaccaggagacgcgcgacgctgacggcctcagccgcaacgtggcgctaatccgggagctcaacactaatatcgcccgcgtcgtggacctctacggcgacatgtcatggtccttcgcccgcgccgtcgccgccaagaaagacgccgcatgcgactagtcgggccctaagaggccccgctcccgcggcgctggagggcagcagcagtagagccggcgtcctatcccagttatccatcagaagaggctccgtcgtgattgacggcgggtcaggaaacttccggggtgggggtggggggccctgcattggaaccctcccctctttttttttctccccccggggaaaggggcctggaaaagtttccc

SEQ ID NO: 47408 - protein, 126 aa, Zea mays
  misc_feature: Ceres CLONE 1454544-F
  misc_feature (41)..(124): Pfam Name: DUF1313 Pfam Description: Protein of unknown function (DUF1313)
MEEDGGSGSDSMEFVAGAETSAGAGTNAGRNRGVGSGTSVGGGGGTKLPHVLQKSFGEVQGILEHNRVLIQEISQNQETRDADGLSRNVALIRELNTNIARVVDLYGDMSWSFARAVAAKKDAACD

SEQ ID NO: 47409 - DNA, 788 bp, Zea mays
  misc_feature: Ceres CLONE 1454547-F
  misc_feature: Encodes the peptide sequence at SEQ ID NO. 47410
  misc_feature (411)..(411): n is a, c, t, g, unknown, or other
  misc_feature (748)..(748): n is a, c, t, g, unknown, or other
  misc_feature (788)..(788): n is a, c, t, g, unknown, or other
aagctggagctccccgcggtggcggccgctctagaactagtggatcccccgggctgcaggaattcgcacgagaccattacctagaacatcctaatcgaaaaatttgtttggtgagccacgctcccatccggatccgcgggggaggacggcgatttcgtccccagcctcatgaggtcgggaaggggttcccgcacccacatttgtgaacctcgccggcgcccatcccctgccttcacgaacccgccgccgcccgtcccctactcttcctcgtgcacccaccgtcgctcgtcccctcgtcttccttgcgcactcgccgtcgcctcctcctcaccctcacgcacttgaggccagctgcagaacgaggtgggagggtgaaaacaaggtccaggtctactacctcctcaacttgcncaagactgccgagactgcagggaccaagttctttgctgcctcgccacctgctagcctgacttctcgtgataccacagggtttatcgtcaacaagtggtccccagaagaacttgaacagtcgcatgggcttttgcttttagggtcagcccttcccggaaggatgccaagcctagattcatccgcatgtccgcggggccctcggaattgtctttattacgacactagggtttctctctcggatgcacttggcaccttcgcttggtgtacccccgagctctccttttttcagaatccccgcgacaacccggtgtacttagggactcagccgcgtcctttngcttcagtttcccttcttttaacgcggagggcgcttccgn

SEQ ID NO: 47410 - protein, 58 aa, Zea mays; identical to SEQ ID NO: 46606
  misc_feature: Ceres CLONE 1454547-F

SEQ ID NO: 47411 - DNA, 743 bp, Zea mays
  misc_feature: Ceres CLONE 1454549-F
  misc_feature: Encodes the peptide sequence at SEQ ID NO. 47412
  misc_feature (365)..(365): n is a, c, t, g, unknown, or other
ccccgcggtggcggccgctctagaactagtggatcccccgggctgcaggaattcgcacgagaccattacctagaacatcctaatcgaaaaatttttgccacagcaccacttgctcctgcctcctgctgcttcttcccgagttcccgtgccgccgcgagcgctcccaaccaagcaacgagacaacaacaacaaccctgcaccgccgcagcacttgcgccgtccggtcctgtcctcccgcggtctcgacgccgtcccctaccgtcctaccttatcgcgcaccgctccatggccgccaagtgggcccagaagaccgtcgttatcccggcgcatcggcggggctgccacctcatcacccccaagattcngagggagatcgagggcgacctggccgggttcaagccccccctcccccatttcttccttcagcacacaagcgcatcgctgaccatcaacgagaactatgactctgatgtgcaagctgacactgagacttttcttaacagaattgttccagagggccacaatgctccttggaaacacactatggaaggacctgatgacatgccagcacaaattaaatcgttttatgtttgggttgttcccaaacgattcccctaactgatgggacgccccaaaacgggcccttggaaaggaaattatgctggtagcaaaatcgagtacaatgcccgcccatcgaaaaaatggggattactcctcaacggggggtaacttgaaagaatcta

SEQ ID NO: 47412 - protein, 110 aa, Zea mays
  misc_feature: Ceres CLONE 1454549-F
  misc_feature (19)..(105): Pfam Name: UPF0047 Pfam Description: Uncharacterised protein family UPF0047
  misc_feature (27)..(27): Xaa is any aa, unknown, or other
MAAKWAQKTVVIPAHRRGCHLITPKIXREIEGDLAGFKPPLPHFFLQHTSASLTINENYDSDVQADTETFLNRIVPEGHNAPWKHTMEGPDDMPAQIKSFYVWVVPKRFP

SEQ ID NO: 47413 - DNA, 750 bp, Zea mays
  misc_feature: Ceres CLONE 1454550-F
  misc_feature: Encodes the peptide sequence at SEQ ID NO. 47414
  misc_feature (648)..(648): n is a, c, t, g, unknown, or other
tggagctccccgcggtggcggccgctctagaactagtggatcccccgggctgcaggaattcgcacgagaccattacctagaacatcctaatcgaaaagatttgtttcttgctctcgtggtttcggacttctggtctggaggtcccccagcagcccaggctccacctctccacggcagcaccaacgctccattctgtcagccacagcccacgccgctgaacggccggagatcgccccccactccctctcgccggacggttgcagatcaggtctaccagatccgtctcagattaggtggcaggagaggaggaattcgggtctgaatctgatcgatatgcggcagcagcggggcggggccggggccgggaggagggcggacgacccggggctcctcaagagggccttcgacagggtgttccgcttcgtccgcctcgccgagttcgagatcttcttcgtcctcttcttcctcatcgccttcttcctcttcaaggacctcatggcacggcctcaatacaatcagctgtttgtcaagaagcctgatctagatgattcctggccttagtacccaaataacctggtatttttctttgagctgtgttgccagtacattctttgaaagcctgcgtggccggctggtcaccctcctttngtgtcaggagcatgttttatgattacctagagtattctcttcagtgacgatgattatatttagccagtcatttttcttcagttaaaaaaaaaaacaaaaaaa

SEQ ID NO: 47414 - protein, 75 aa, Zea mays; identical to SEQ ID NO: 6723
  misc_feature: Ceres CLONE 1454550-F

SEQ ID NO: 47415 - DNA, 779 bp, Zea mays
  misc_feature: Ceres CLONE 1454553-F
gctctagaactagtggatcccccgggctgcaggaattcgcacgagaccattacctagaacatcctaatcgaaaaacgagccttgcttcttcacgtcacctcctcctcacacattttccctctcacctctaaatccatggacaccctccctgctctgatcccccccgatgctcgctgtgggtgccgtttgcatgccacaacggcgttccgcgccccctccactccggccatgagctcctcccagcgaatccttctagtaccctgctcatctcccatgatggccgcaggaagctctgaatccatgcccgtcggcctcaggacgtgagcagtccttgtgtctttgttgttacaaaagactacctccacgatgtcttttttcgaaaaccacccccaccgcaaccctgctacttcattcggagaccctgtatcatggacggccgaacctcaggcaacctcttccctgtgggaaagagggccgaaaccctttgctgttcttccacttcggcattaggacagttaaaggttccttctcgacgaatacccgcgtgcaacccctgtactcagggcaaaatccattctcatttatttagtgtaaaaaacactaatcccgggattcccctccgccgttcggatgctcgcccattcctaatctgtggagaatcctaacccccggaaggtttagagccccctctgttccctctccccaaagtttcaggcgtttgggtggtctttgtttctttttttacaaagaatctcgctaagcaactttgtttaatattt

SEQ ID NO: 47416 - DNA, 763 bp, Zea mays
  misc_feature: Ceres CLONE 1454557-F
  misc_feature: Encodes the peptide sequence at SEQ ID NO. 47417
  misc_feature (213)..(213): n is a, c, t, g, unknown, or other
  misc_feature (243)..(243): n is a, c, t, g, unknown, or other
  misc_feature (281)..(281): n is a, c, t, g, unknown, or other
  misc_feature (309)..(309): n is a, c, t, g, unknown, or other
  misc_feature (737)..(737): n is a, c, t, g, unknown, or other
tggagctccccgcggtggcggccgctctagaactagtggatcccccgggctgcaggaattcgcacgagaccattacctagaacatcctaatcgaaaaatccatcacagctagctagcatacagacgaataatctcttcttcacctcactaacaccagctagcaactctttctctcctgcaataatgggcgctcgctcctcctcctccagccgnagctggtcgcggacgcggcggtcctggcancggccctgctgctgctggcggcggggcccggaacgcgntctgcgcggtgaactgcggccagtgacntctccgggggcccctggctcgggtacccgatgggaaggcggggttcccctcgcgggctgcttaaagggggtggtttcttaaaaagccggggcccccaaaggggaccggaaggcccttgaaattgcttaaaaaattaaaggccgtttcggggggggttcaaattggaaaaagccccaaaatcccctaaagagggggctcccctcgggggggccattaccccccccgttaagggcccaaaaaacggggtgaatgaaccctttgggaaaaactccccctttgaagggaaaaaagggcacaaaaaaaagaggcgcctctaaaaaaaaaaagcccaaaacaggggggggcgccccaaacccgccaaaaaaaaaaaaaaattgcccccccccagaggaccctcttagggccccccccccccccgggaaaccctnaagagagtcccacacactttctgaaa

SEQ ID NO: 47417 - protein, 68 aa, Zea mays
  misc_feature: Ceres CLONE 1454557-F
  misc_feature (20)..(20): Xaa is any aa, unknown, or other
  misc_feature (33)..(33): Xaa is any aa, unknown, or other
MGARSSSSSRSWSRTRRSWXRPCCCWRRGPERXLRGELRPVTSPGAPGSGTRWEGGVPLAGCLKGVVS

SEQ ID NO: 47418 - DNA, 744 bp, Zea mays
  misc_feature: Ceres CLONE 1454565-F
  misc_feature: Encodes the peptide sequence at SEQ ID NO. 47419
ctggagctccccgcggtggcggccgctctagaactagtggatcccccgggctgcaggaattcgcacgagaccattacctagaacatcctaatcgaaaaacgggttgccgtcggagctcggcgaatctgcgcagacgacgagggagcgcgatggaggcggcgctgcgcgggatcagggccaagctgacggagcaccgggagaaggtgatcagcggtctgctgctgggctcggcggtggcgctggggtggaagtcgtcggagcagcagcgcgagatccagagcctgttggccgagaagagctctctccgagccaccaacgcctctatgtccgccgccatgtgggcctggcgggaggagctcttcgccctcgccgccgcgccctcctcccccatttccgcgtcccggctccgccacatctacggcgaggaggagcccgcgccgctcgcgcccgcgcccgcgcccgcagggatctcaatcacattgtactaatggtctaatactggtacttgataacgaggatgcgaagaacaaatttattctatgtcagaacaattcatcgtcatagttgaatttaccatccagtccataatctcaatggtagatggtctgggttttcatgttctccggggtttcatggaaggggggagtatgcattcctgtctttctaatacaaggagcaaatgatggggaagaaaaggaaccaatctccaagcccgaactctttccgacttttttccggcgaggg

SEQ ID NO: 47419 - protein, 112 aa, Zea mays
  misc_feature: Ceres CLONE 1454565-F
MEAALRGIRAKLTEHREKVISGLLLGSAVALGWKSSEQQREIQSLLAEKSSLRATNASMSAAMWAWREELFALAAAPSSPISASRLRHIYGEEEPAPLAPAPAPAGISITLY

SEQ ID NO: 47420 - DNA, 763 bp, Zea mays
  misc_feature: Ceres CLONE 1454568-F
  misc_feature (703)..(703): n is a, c, t, g, unknown, or other
aaagctggagctccccgcggtggcggccgctctagaactagtggatcccccgggctgcaggaattcgcacgagaccattacctagaacatcctaatcgaaaaaggacgctgcagatgcagtcgtcgagctaacaagcagccggacaaggtaaaatgttcccgttaacatcccttgaggcctaccctaggcagcacaccaaatggggcaaccgccctgccgccggggagcattcaatcgtcggcggcacaccgtcccccattcttcccgttccccaacgtgaagtggcaccatggtcgccactcgccacgcgctcgccgcaggagcaggagcagcgactgcgggccagccagcctccggttgggtagctgttctgcgcaacagcccgagggcgcggatggagggaccaaacaggagcggaggggaaggcaggcggtacaactgatgagcgggtacctgttctacgatagcggtcgcttcagacacgaaagatgttcttgcgagggacatgctgatcatcgccttcgagtaagatgctccaaccatgaggagcataggcacaactagcagggagagcaggccgacctcccaacagcacgcgaaggcaacaatgatagcaactaagaacgtggaagagtttgacatgaagtgacccatctggagaaagcaataataagccaatttttttttttacttctctttggntagctagtgactctttgcagtgacatattatgaggaggaagagaaaaatcattacttttt

SEQ ID NO: 47421 - DNA, 716 bp, Zea mays
  misc_feature: Ceres CLONE 1454573-F
  misc_feature: Encodes the peptide sequence at SEQ ID NO. 47422
  misc_feature (472)..(472): n is a, c, t, g, unknown, or other
  misc_feature (508)..(508): n is a, c, t, g, unknown, or other
  misc_feature (584)..(584): n is a, c, t, g, unknown, or other
  misc_feature (587)..(587): n is a, c, t, g, unknown, or other
  misc_feature (588)..(588): n is a, c, t, g, unknown, or other
  misc_feature (651)..(651): n is a, c, t, g, unknown, or other
  misc_feature (654)..(654): n is a, c, t, g, unknown, or other
  misc_feature (657)..(657): n is a, c, t, g, unknown, or other
  misc_feature (659)..(659): n is a, c, t, g, unknown, or other
aaagctggagctccccgcggtggcggccgctctagaactagtggatcccccgggctgcaggaattcgcacgagaccattacctagaacatcctaatcgaaaacttctagaaccttctccacgatggcgttcctccgagccctccggcgagccctcccgccgctctactcgccggcggcgcctctttcccggcgcgcaccaggtcctcctccgctcccttcccgccctctccggctcctggatccgatcgggttccggccgttctccgccgcggccgccaccgccaccgccgtcgcgcgggtgccggaaatgggggccagcctcttcagagggctcacggagaccaggttccccaagcggcgcccggggttcgtgtcccggcgcaagagggccagcctgcgacccaaaggtccgcactactgggtgaggtgcacgccgggggagcctatcccttcgagccagccgaataaggncagcgtgcaggggaagaaggagaagaaagcgatcangcagcgcagggacttcatcatggctgaaaagaagaagcgcaaagcacagtattctgttgctgtgaaaaggaaggangcnnaacggacagaaagaaagatggctgcagtgccaagagacggggcatgggtggaaaagggtggcnaanctnangccgaattgagcagaaaagaaagctgcaatggcttggagagctcctctggaaaccgc

SEQ ID NO: 47422 - protein, 198 aa, Zea mays
  misc_feature: Ceres CLONE 1454573-F
  misc_feature (117)..(117): Xaa is any aa, unknown, or other
  misc_feature (129)..(129): Xaa is any aa, unknown, or other
  misc_feature (154)..(154): Xaa is any aa, unknown, or other
  misc_feature (156)..(156): Xaa is any aa, unknown, or other
  misc_feature (177)..(177): Xaa is any aa, unknown, or other
  misc_feature (178)..(178): Xaa is any aa, unknown, or other
  misc_feature (179)..(179): Xaa is any aa, unknown, or other
MAFLRALRRALPPLYSPAAPLSRRAPGPPPLPSRPLRLLDPIGFRPFSAAAATATAVARVPEMGASLFRGLTETRFPKRRPGFVSRRKRASLRPKGPHYWVRCTPGEPIPSSQPNKXSVQGKKEKKAIXQRRDFIMAEKKKRKAQYSVAVKRKXAXRTERKMAAVPRDGAWVEKGGXXXAELSRKESCNGLESSSGNR

SEQ ID NO: 47423 - DNA, 949 bp, Zea mays
  misc_feature: Ceres CLONE 1454584-F
  misc_feature: Encodes the peptide sequence at SEQ ID NO. 47424
  misc_feature (752)..(752): n is a, c, t, g, unknown, or other
atgaggtcagtttgtaggcatcgtgaagaattgtgggagggggtttaaaagtggggctccccgcgggggcggccgctctagaactagtggatcccccgggctgcaggaattcccacgagaccattacctagaacatcctaatcgaaaaagagtccggaccatagcctgcagccgcgaactcccgttctccatttccagccatggcggtgtcgatcgagctcaccaaggagtacggctacgtcgtgctggggctggtgggcctatgtcttcctcagcctttggatgggcttccatatcggcgaggcccgcagagactacaaggtgttctaccccaccatgtacgccatcttagtcggagaacaaggaactccaagcttctttcatctgctgtgcagagggagcaccaatagctctctgagaggggatgcccgtttttctttcgtcaaacgatgctgttgggacggtcttgtgctaccccgaactaatcgccgccgggtctggggcggatattctacgtcgggcggcgtaggtttctgtcttactgtcgaggtgaaagcgccacccgggctttattcaagagacggaccttagtcgcgagagattggggtggtgcatcaaactaactatgggagggatcgctctgggactgtgatgcattgtggccgcaagcgatctctttttatatggagtcaggccctgggcgtatgtcgaggggatgtaggccttcttagaggcttggtggggcgttaatnatgagtggaggtctccgcgggcgtggaggggtgtatgctgagagagtagatgaatctctcaggctcccctagaaagctgttagaagcctttctgatggtcatcactacattcgtctgttgtgggccctatttatattggtcgggagacaatacctgagtctcttatgttactattaacgcccgggtcagtttatatc

SEQ ID NO: 47424 - protein, 102 aa, Zea mays
  misc_feature: Ceres CLONE 1454584-F
MGFHIGEARRDYKVFYPTMYAILVGEQGTPSFFHLLCRGSTNSSLRGDARFSFVKRCCWDGLVLPRTNRRRVWGGYSTSGGVGFCLTVEVKAPPGLYSRDGP

SEQ ID NO: 47425 - DNA, 747 bp, Zea mays
  misc_feature: Ceres CLONE 1454585-F
  misc_feature: Encodes the peptide sequence at SEQ ID NO. 47426
  misc_feature (689)..(689): n is a, c, t, g, unknown, or other
aagctggagctccccgcggtggcggccgctctagaactagtggatcccccgggctgcaggaattcgcacgagaccattacctagaacatcctaatcgaaaaatctcttacccgcggtgcgacgccggcccgggcgtggcgcggtcgctgctggtgctggaggtggtggccttctcgtccttcctcttctccagcctggtggcgcagggcctgaagctggcgctcaacctcatcaactccaaggacccgcacgacgcggcgcgcgcccacatcgacgcccgcgtgctccgcctcggcatgctcgcctccgccgtcggatccgtcgtcggctgcgtcttcctcatgacgtccatggtcatggtcgtgcaggtccgcctcggcacgctgagctgccccaccgaccgcgccgccgccaaggccgccgcgggcctcgtcggcctcgtcaccaccgcgctcgccttctacgtgggcaccgtcttctacaccttcacccactgatgccagttccatgcgtccgtgcgctgcatcccaaatccatctagcgttgcgttgcgttgcaaagggcacatcgccatcagtggtgtcggtgtgcgaggaaattgaaaggagacctgcaatctgcgttaaaaaaaaaaaaaaaagcttatcgataccgtcgacctcgagggggggcccggtaccaattcgccntatagtgagtcgtattacgcgcgctcactggccgtcgttttacaacgtcgtgactgga

SEQ ID NO: 47426 - protein, 164 aa, Zea mays
  misc_feature: Ceres CLONE 1454585-F
AGAPRGGGRSRTSGSPGLQEFARDHYLEHPNRKISYPRCDAGPGVARSLLVLEVVAFSSFLFSSLVAQGLKLALNLINSKDPHDAARAHIDARVLRLGMLASAVGSVVGCVFLMTSMVMVVQVRLGTLSCPTDRAAAKAAAGLVGLVTTALAFYVGTVFYTFTH

SEQ ID NO: 47427 - DNA, 733 bp, Zea mays
  misc_feature: Ceres CLONE 1454587-F
  misc_feature: Encodes the peptide sequence at SEQ ID NO. 47428
  misc_feature (562)..(562): n is a, c, t, g, unknown, or other
  misc_feature (610)..(610): n is a, c, t, g, unknown, or other
  misc_feature (643)..(643): n is a, c, t, g, unknown, or other
  misc_feature (669)..(669): n is a, c, t, g, unknown, or other
aagctggagctccccgcggtggcggccgctctagaactagtggatcccccgggctgcaggaattcgcacgagaccattacctagaacatcctaatcgaaaaaatcaccttcttcgtttcatcctctgattctccccctgctggtctgctctgctcccatcccatggagcccgacgccgcccaaaaccctagccccagccccgtccccccgcccatctccgcctactaccagacgcgcgccgaacaccacgccgtcgtaactagcgactggctcgcccacgccgccgccgcagccgcagccttccccggcgccgataccgccgatgccgccccgcccccgtcccccgggggcggcggcgtgatcgaggagttcaacttctggcgccgcaagcccgaggccgccgaggcggtggccgccatcatggctctcgccgccgtcatccgctccagcagggccaccaccatgatggagctcgagatcgagctcaagaaagcatctgacaagctcaagtcctgggatgctacatccatttctctttctgctgcttgtgatttgttcatgncgtttgtaacgaggacctcacatctggagcatgagaaagttgatgcancaaaatcgcggctaattgagcgagaagaaaaantttgggagatatctttaaggctcgcnagacatttgcatgcttagtcagattttatttatgatgggtgtactatacttgtcatgggtattc

SEQ ID NO: 47428 - protein, 174 aa, Zea mays
  misc_feature: Ceres CLONE 1454587-F
  misc_feature (134)..(134): Xaa is any aa, unknown, or other
  misc_feature (150)..(150): Xaa is any aa, unknown, or other
  misc_feature (161)..(161): Xaa is any aa, unknown, or other
MEPDAAQNPSPSPVPPPISAYYQTRAEHHAVVTSDWLAHAAAAAAAFPGADTADAAPPPSPGGGGVIEEFNFWRRKPEAAEAVAAIMALAAVIRSSRATTMMELEIELKKASDKLKSWDATSISLSAACDLFMXFVTRTSHLEHEKVDAXKSRLIEREEKXWEISLRLARHLHA

SEQ ID NO: 47429 - DNA, 774 bp, Zea mays
  misc_feature: Ceres CLONE 1454590-F
  misc_feature (307)..(307): n is a, c, t, g, unknown, or other
  misc_feature (312)..(312): n is a, c, t, g, unknown, or other
  misc_feature (315)..(315): n is a, c, t, g, unknown, or other
  misc_feature (318)..(318): n is a, c, t, g, unknown, or other
  misc_feature (331)..(331): n is a, c, t, g, unknown, or other
  misc_feature (398)..(398): n is a, c, t, g, unknown, or other
  misc_feature (515)..(515): n is a, c, t, g, unknown, or other
  misc_feature (603)..(603): n is a, c, t, g, unknown, or other
  misc_feature (622)..(622): n is a, c, t, g, unknown, or other
tggagctccccgcggtggcggccgctctagaactagtggatcccccgggctgcaggaattcgcacgagaccattacctagaacatcctaatcgaaaaacctcacccctccccataaatgcactgtatcacccctgccttcctgctagttctccagagagagccgggagaacttggctgtctgccctgtctgcaagtacctcgtcttcttcctggagagaaaaacagaagacaatacaaagatgtccaagatggcggaggagaaggcggcggcagtgggcggactctgaggagccggggcggcggacncggcncancancagcagctggcancaggggaggccgcggccggcccggttgctgcccgtgcacaacctggtttgggcgggaccccttgggntttctccttggcccccaaaaccgtcatgctcccttaccgggcaaagcaccgagggcgggggccgtccccttattccgaggttgggggggtttcaggtcctttggctaaacccacaangcccttttgcctggcctaatccgtgggggttccgcggtttaaacgggccggggggaagggctcgccccgggtggggggtttctggggnggtgttttccgccgggcanaggggttccctaacctaatttcggggggggggaaaccgtggggggaaaaattttttttccccccctaaaagggggaacaagggggtggggggggggataagcattctcgggttttctcccccccccccccggcccgcccgtgtccccccccc

SEQ ID NO: 47430 - DNA, 762 bp, Zea mays
  misc_feature: Ceres CLONE 1454591-F
  misc_feature: Encodes the peptide sequence at SEQ ID NO. 47431
  misc_feature (296)..(296): n is a, c, t, g, unknown, or other
  misc_feature (598)..(598): n is a, c, t, g, unknown, or other
  misc_feature (600)..(600): n is a, c, t, g, unknown, or other
  misc_feature (601)..(601): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (629)..(629): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaaatccatcacagctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctgggcgcgggggccgggaacggcgtcgcggcngtgagctgcggcaaagtgacctcttcggtggcgcccgtgcctcggtacgcaatggggagcgcggttcccccctccccgcgtgctgaccgggggtgggttccttaaaagccggcccccccaaagggggaccggagggcaccgggaactggctcaaaaaaataaacggcccggccgggggggggttacaaatgaacaaacccacaaatcccccccaagggggggtgctcccgggggggcgcctaaccccccccgggggtgggcaaaataattttggtttgggaacctttgggggggtccccacncnngagagnnnnnnannnnnnnccccaaaangnnnnnccccccaaaaaaaaaactcccccccgggggggggggcgcacaccgcccaaaaaaagaaaaaatccccccccccacaaagtactcctgcgggcgcgcccccccccccccccacaaccacaaaagaaaa

SEQ ID NO: 47431 - protein, 70 aa, Zea mays
  misc_feature: Ceres CLONE 1454591-F
MAARSSSSQPQLVAAAAVLAAALLLLGAGAGNGVAAVSCGKVTSSVAPVPRYAMGSAVPPSPRADRGWVP

SEQ ID NO: 47432 - DNA, 769 bp, Zea mays
  misc_feature: Ceres CLONE 1454592-F
  misc_feature: Encodes the peptide sequence at SEQ ID NO. 47433
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaacgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctccctcatcctgctcacctactttgcggtcgtctccggactcgtgtacgacgtcatcgttgagccccctggcatcggcagcgcccaggaccccggcactggcgccgtccgccccgtcgtcttccttccagggcgcgtcaacggccagtacatcatcgagggactctcctccgggttcatgttcctccttggcggcattggcatcatcctcctcgacctcgccgtcgaccgcacgaggccccggagcctccgcgtctcgtttggaagcgccggcgcagtcgccgttgtcatcgcctacgccatggccatgctcttcctccgcatcaagatccccggctacctctggtgaggtgaataatcttgcctggtaactagaccagatccgtcgcgagatctcgctgcatctaattagacctgcgtgctgtgcagtgtgaactgtgctcttncattttggcaataatggtcatcaccacatttgtatggtatcactcgaactactgggtaaagatatcatttt

SEQ ID NO: 47433 - protein, 119 aa, Zea mays
  misc_feature: Ceres CLONE 1454592-F
MTVFSLILLTYFAVVSGLVYDVIVEPPGIGSAQDPGTGAVRPVVFLPGRVNGQYIIEGLSSGFMFLLGGIGIILLDLAVDRTRPRSLRVSFGSAGAVAVVIAYAMAMLFLRIKIPGYLW

SEQ ID NO: 47434 - DNA, 647 bp, Zea mays
  misc_feature: Ceres CLONE 1454667-F
  misc_feature: Encodes the peptide sequence at SEQ ID NO. 47435
aaagctggagctccccgcggtggcggccgctctataactagtggatcccccgggctgcaggtattcgcacgagaccattacctagaacatcctaatcgaaaaaataccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacaggttctgggcgggccgcgtgccgccgcgcactggatgcagctcccggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaagcggtgggcggcgggcagtgcccggccctggggtgcgcggcagacctcaacgccgggtgcccgccctcgcagcgcgtgccgggcgcccgggg

SEQ ID NO: 47435 - protein, 166 aa, Zea mays
  misc_feature: Ceres CLONE 1454667-F
  misc_feature (34)..(165): Pfam Name: Thaumatin Pfam Description: Thaumatin family
MAGTAKTPVLGFLLALALVATSTPAAATTLTLHNLCPYPVWPLVSPNTGFPAISENTGRLDGGGRGLVSFRFPDRFWAGRVPPRTGCSSRHSRCETGSAAPATVVQLVVHAEGQDLASYSVSLVDGFNVPAVVSPQAVGGGQCPALGCAADLNAGCPPSQRVPGAR

SEQ ID NO: 47436 - DNA, 646 bp, Zea mays
  misc_feature: Ceres CLONE 1454672-F
  misc_feature: Encodes the peptide sequence at SEQ ID NO. 47437
aaagctggagctccccgcggtggcggccgctctagaactagtggatcccccgggctgcaggaattcgcacgagaccattacctagaacatcctaatcgaaaaaccatggccgtcctgacgaaggtgcttctccgtctcttcttcactactggcggcctcatcgtcttcctgttgtgtcccgcgtcctgccttgctcgtcctcctcattccagcagcaactacaactactactgcgactggtgccctcgccgttccaccgcctcccccgacctcgacgcgtcgttgctgcgttcttgtggaactagtagagacggcgacgacggtggcttcggctgcgggtacgggtacggggctgcggagcagctggacggaggtggagctccccacgtcgccgccgcgggcgccgactccttcttccgcgccggcgccggctgcggcgcctgctaccagttgaggtgcagagaccggagggtgtgcggcaccggcgccgtcaaggtcgtcgtggtagccggcttggccaaccggacggggttcgtgctcaccagggaggccttcgctgcgatgatggcccggccgcgcgtgtcgtccgatgaccaactgctgcccggcttggatgccaatgttgttgaggtcgacttcaggagaa

SEQ ID NO: 47437 - protein, 180 aa, Zea mays
  misc_feature: Ceres CLONE 1454672-F
  misc_feature (96)..(178): Pfam Name: DPBB_1 Pfam Description: Rare lipoprotein A (RlpA)-like double-psi beta-barrel
MAVLTKVLLRLFFTTGGLIVFLLCPASCLARPPHSSSNYNYYCDWCPRRSTASPDLDASLLRSCGTSRDGDDGGFGCGYGYGAAEQLDGGGAPHVAAAGADSFFRAGAGCGACYQLRCRDRRVCGTGAVKVVVVAGLANRTGFVLTREAFAAMMARPRVSSDDQLLPGLDANVVEVDFRR

SEQ ID NO: 47438 - DNA, 620 bp, Zea mays
  misc_feature: Ceres CLONE 1454674-F
  misc_feature: Encodes the peptide sequence at SEQ ID NO. 47439
  misc_feature (468)..(468): n is a, c, t, g, unknown, or other
  misc_feature (469)..(469): n is a, c, t, g, unknown, or other
aagctggagctccccgcggtggcggccgctctagaactagtggatcccccgggctgcaggaattcgcacgagaccattacctagaacatcctaatcgaaaaagtcccagttccagcaaggcagtcgctttgggtgcggtgccatggcagcaggaggggcttggagtgatctgttgtttagtggaacggaggggttgttcgagatgggtggcgccgccggccgcggctggaacgcggccgcgagctcgccgccgcagctcctgcaggagctgggtgacaacagtgctgccggctcactacctgtggcgtctgcggggagtgcgagtggcggcgccggtcaggatgccccggcaatggctgcggcagcggcgtccggaaggaggaagcggcggaggatgaggccagtgaagaacgaggaggaagtggagagccagcggatgatccacatttgcggtggaagcgcaaccgnnccgcagcaaaatgaaagaagaacccttggccgggggtcttccgtatattttgggggcccgggggccccacaaaaaaaaaggggggggggaaaaaaaaaaacccccctcccccccgggggggggggggggggaaaaaaaaaatttaaaatat

SEQ ID NO: 47439 - protein, 159 aa, Zea mays
  misc_feature: Ceres CLONE 1454674-F
  misc_feature (109)..(109): Xaa is any aa, unknown, or other
MAAGGAWSDLLFSGTEGLFEMGGAAGRGWNAAASSPPQLLQELGDNSAAGSLPVASAGSASGGAGQDAPAMAAAAASGRRKRRRMRPVKNEEEVESQRMIHICGGSATXPQQNERRTLGRGSSVYFGGPGAPQKKRGGGKKKTPLPPGGGGGGKKKFKI

SEQ ID NO: 47440 - DNA, 786 bp, Zea mays
  misc_feature: Ceres CLONE 1454687-F
  misc_feature: Encodes the peptide sequence at SEQ ID NO. 47441
  misc_feature (26)..(26): n is a, c, t, g, unknown, or other
  misc_feature (27)..(27): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gaagaggaccccaaccccacccactnntgtgtttttttnnnnnnnnnnncccaagctggggctccaccgcggtggcggccgctcttcacacagtggatcccccgggctgcaggtttttcgcacgagaccattacctagaacatcctaatcgaaaaaactctcagcggctatgccgcgccccagccggctccccgagtcggggcgtggagctgtcgccgcagcagccggggccaccgcgccgggagggctgctccacgaggccatggccacgggcccgctggtccgagagggcgaaagggtggccccccccccgcccacctgggctgacgacaaggagtcaccggcgaggcccagcgggggcatggccacgcatgtcgacgaccagagctcgtcggtcgggaggggaaggagcggggagcacggtggggacccacggccacaaccacggaaagagctggggatccggggaaccaccgccacacaaccaaaatgatgtggggggaaggggctggccgactcgccggcgccacagcaaggggcggccgccgtgggggccccgagtgccggcggcccccccccccgctaaggaagggtaaggacggaacctagccctggagggcaagaaccccgaatccgtgcgggcgcgctctcgcagccaccatcagtgggagaagaagggccaccgccgcccccgcccgagggaggttcgcccgctgcttgactaccagagggggacgaacaggaaaggcgcaccttcgggaaataacctcggcccccccactcccc

SEQ ID NO: 47441 - protein, 107 aa, Zea mays
  misc_feature: Ceres CLONE 1454687-F
MPRPSRLPESGRGAVAAAAGATAPGGLLHEAMATGPLVREGERVAPPPPTWADDKESPARPSGGMATHVDDQSSSVGRGRSGEHGGDPRPQPRKELGIRGTTATQPK

SEQ ID NO: 47442 - DNA, 832 bp, Zea mays
  misc_feature: Ceres CLONE 1454698-F
  misc_feature: Encodes the peptide sequence at SEQ ID NO. 47443
  misc_feature (21)..(21): n is a, c, t, g, unknown, or other
  misc_feature (22)..(22): n is a, c, t, g, unknown, or other
  misc_feature (32)..(32): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
  misc_feature (352)..(352): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (526)..(526): n is a, c, t, g, unknown, or other
  misc_feature (567)..(567): n is a, c, t, g, unknown, or other
  misc_feature (591)..(591): n is a, c, t, g, unknown, or other
  misc_feature (600)..(600): n is a, c, t, g, unknown, or other
  misc_feature (616)..(616): n is a, c, t, g, unknown, or other
  misc_feature (621)..(621): n is a, c, t, g, unknown, or other
  misc_feature (651)..(651): n is a, c, t, g, unknown, or other
  misc_feature (666)..(666): n is a, c, t, g, unknown, or other
  misc_feature (677)..(677): n is a, c, t, g, unknown, or other
  misc_feature (685)..(685): n is a, c, t, g, unknown, or other
  misc_feature (702)..(702): n is a, c, t, g, unknown, or other
  misc_feature (718)..(718): n is a, c, t, g, unknown, or other
  misc_feature (735)..(735): n is a, c, t, g, unknown, or other
  misc_feature (740)..(740): n is a, c, t, g, unknown, or other
  misc_feature (778)..(778): n is a, c, t, g, unknown, or other
cggaggcaagaagaagggggnnggggtaaaangggggggggggggggnnggnggagaggggagctccccgcggtggcggccgctctagaatattggatcccccgggctgtaggaattcgcacgagaccattacctagaacatcctaatcgaaaatccatctttgctccctggggcgggtcggggcccacccgcccgcctcggctgctcagctctgctctgctctgctcctcgcctcccttcccttcccttcgcctcccccagccagccaggaatcgccaccggcggaagccaagcatcgtcccaacaccggatcgattcggcccgcccgccggcccgtccatggaatcgggnggccggagccggcggcgtggcccccggtggaagtcgctccctgcttgggggcgtttaaccgggggggcggaaacgtgggggggggtttgttcgtggcgttttttgggtggggttgttttttgttttttnnnnnnnttttgtggttgccctccggtcccgccgcggggggtcctnattccgaccttccctcgggggatcccgggggcgggcccggnttgggggtaggtagggcggccttntataaaagngacgacactcgttagnggagnccccccctggttagaagaaaaaaatataancatgtggaaaaaccnacgccatcccnccggtttnctagcgcgcccgacatngggaggggattgcccntaaggcaagcacaatancatcntattggggccggccactcaagtaatccggtgtggtcgnccccgaggagagcggggtcacctacaaaaacaaataagagcccagaccccccca

SEQ ID NO: 47443 - protein, 78 aa, Zea mays
  misc_feature: Ceres CLONE 1454698-F
  misc_feature (47)..(47): Xaa is any aa, unknown, or other
  misc_feature (48)..(48): Xaa is any aa, unknown, or other
  misc_feature (49)..(49): Xaa is any aa, unknown, or other
  misc_feature (76)..(76): Xaa is any aa, unknown, or other
MESGGRSRRRGPRWKSLPAWGRLTGGAETWGGVCSWRFLGGVVFCFXXXFCGCPPVPPRGVLIPTFPRGIPGAGPXWG

SEQ ID NO: 47444 - DNA, 673 bp, Zea mays
  misc_feature: Ceres CLONE 1454710-F
  misc_feature: Encodes the peptide sequence at SEQ ID NO. 47445
aaagctggagctccccgcggtggcggccgctctagaactagtggatcccccgggctgcaggaattcgcacgagaccattacctagaacatcctaatcgaaaaaggccgcggccgcttcctctccccatcggcagtcttcccccgggacgtctaaaccccaatccctagatccccgacgcagaccacacgacgcgcacctccgttcacgaggcggaagcatgagtcgccacccgatcactaagtgggcacagaggtccgacagggtgttcttgacaatagagctgcccgacgcccaggatgtgaagctgaacttgaagcctgaaggccatttcaacttctcagctaggggctcacatgacttgcgctatgagtttgacattgagctgtttgatgctgtgaatgtggaggatagcaaagcagctattgccccaaggaccatatgctacctgagaaagaaagctaagagtgggtggtggccaaggctgctgaagcgggagggcaaaccacctgtgttcttgaaggttgactgggacaaatggcaggacgaggatgatgaagacgctggattaaatgactttggtggtatggacttctcgagactggacataggaggtgctgatgactacgatattggggatgatgaagatgatgtggttgagagtgctaacaaagg

SEQ ID NO: 47445 - protein, 151 aa, Zea mays
  misc_feature: Ceres CLONE 1454710-F
  misc_feature (5)..(80): Pfam Name: CS Pfam Description: CS domain
  misc_feature: SWISSPROT Homolog: EC 5.3.99.3 Prostaglandin-E synthase
MSRHPITKWAQRSDRVFLTIELPDAQDVKLNLKPEGHFNFSARGSHDLRYEFDIELFDAVNVEDSKAAIAPRTICYLRKKAKSGWWPRLLKREGKPPVFLKVDWDKWQDEDDEDAGLNDFGGMDFSRLDIGGADDYDIGDDEDDVVESANK

SEQ ID NO: 47446 - DNA, 609 bp, Zea mays
  misc_feature: Ceres CLONE 1454711-F
  misc_feature: Encodes the peptide sequence at SEQ ID NO. 47447
  misc_feature (254)..(254): n is a, c, t, g, unknown, or other
aaagctggagctccccgcggtggcggccgctctagaactagtggatcccccgggctgcaggaattcgcacgagaccattacctagaacatcctaatcgaaaacccgcgtcccaccaacttccattccctaccgcccgcccaccccactccactccgctcctcccactcgagccatcatggccctcgcctcccgcgccgccgcagccgccgtggcgtgcgtcctcctggcgctcgccgcctccgccgcgggggcnggctccaactcccctgcaccggcgccggcgggtggactgtatctcccaagccgccagcctgatcgactgcatcgactacgtccagaaagggagcaacgcgcgccgtccgttcgcttgctggtggggggaagtccaaaacgcatgggcacgccccggatcgtggggttgctctggtcccctcgccggtcccaatccagaaacttgggctttccatcaaaatgaaagcgtggtggggctcccccgggcgtgggggggcgtccaagccgccttcacaaaatggacaatttcccggctccccccacagaaaaaactgtacctccgccgcggggggggcatccaacggtggggccgcggc

SEQ ID NO: 47447 - protein, 99 aa, Zea mays
  misc_feature: Ceres CLONE 1454711-F
MALASRAAAAAVACVLLALAASAAGAGSNSPAPAPAGGLYLPSRQPDRLHRLRPEREQRAPSVRLLVGGSPKRMGTPRIVGLLWSPRRSQSRNLGFPSK

SEQ ID NO: 47448 - DNA, 514 bp, Zea mays
  misc_feature: Ceres CLONE 1454714-F
  misc_feature: Encodes the peptide sequence at SEQ ID NO. 47449
tggagctccccgcggtggcggccgctctagaactagtggatcccccgggctgcaggaattcgcacgagaccattacctagaacatcctaatcgaaaaaccaattaccaaaccagccctgactccctgaggtttgacggaggttgggttggatgggtggcccttcctctccccgtcggggagaaacgacggcgaggggagtggcgggagatctccggctccggcgacatggaaggagcgcccgaggtccttcgacgagaagacaggacggcgtgttggcgtaaggcagcggtgctgtcggggacgccaccggaacgctggcggcaggacgccgtggggcacgtggtctgccgccgtttctggggctgccacggatggctctgctacaagtaaaccacttcgtccctttctcaaaggaggaaatccactgttgaaactgcccaaatcctccgaaaaaaggggggacccttttacaaatctttataaaacgggggtttccccccaccccaaattgcc

SEQ ID NO: 47449 - protein, 54 aa, Zea mays
  misc_feature: Ceres CLONE 1454714-F
MEGAPEVLRREDRTACWRKAAVLSGTPPERWRQDAVGHVVCRRFWGCHGWLCYK

SEQ ID NO: 47450 - DNA, 663 bp, Zea mays
  misc_feature: Ceres CLONE 1454717-F
  misc_feature: Encodes the peptide sequence at SEQ ID NO. 47451
  misc_feature (431)..(431): n is a, c, t, g, unknown, or other
  misc_feature (549)..(549): n is a, c, t, g, unknown, or other
  misc_feature (552)..(552): n is a, c, t, g, unknown, or other
ctggagctcaccgcggtggcggccgctctagaactagtggatcccccgggctgcaggaattcgcacgagaccattacctagaacatcctaatcgaaaatataagtccctcctccgctctcctctcccacctcaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgtcggcggcggcggcggggccggcggcccgcactacagaggcgtgaggaagcggccgtggggccggtacgcggcggagatccgcgacccggcgaagaagagccgggtgtggctcggcacctacgacancgccgaagacgccgcgcgggcctacgacgccgccgcgcgcgagtaccgcgggcgccagggcaagaaccaactccccttacccctcgtgcgtgcccctctccgcagccggtttgccggncancaaacagcaaaacggtcgagtccttcaaaaacgaccccgaaggccccatgaagggcagtgcccctccccccgctccctcgagctgggacttgttcccccgggggggggccg

SEQ ID NO: 47451 - protein, 122 aa, Zea mays
  misc_feature: Ceres CLONE 1454717-F
  misc_feature (33)..(84): Pfam Name: AP2 Pfam Description: AP2 domain
  misc_feature (66)..(66): Xaa is any aa, unknown, or other
  misc_feature (106)..(106): Xaa is any aa, unknown, or other
MAPRTSEKTMAPAAAAATGLALSVGGGGGAGGPHYRGVRKRPWGRYAAEIRDPAKKSRVWLGTYDXAEDAARAYDAAAREYRGRQGKNQLPLPLVRAPLRSRFAGXQTAKRSSPSKTTPKAP

SEQ ID NO: 47452 - DNA, 558 bp, Zea mays
  misc_feature: Ceres CLONE 1454719-F
  misc_feature: Encodes the peptide sequence at SEQ ID NO. 47453
aaagctggagctccccgcggtggcggccgctctagaactagtggatcccccgggctgcaggaattcgcacgagaccattacctagaacatcctaatcgaaaacagtcccgcagcaacgccgagggagagcgaggagagacagatacagatcgcgcgctcagatgtcgtcggactcctcgtcgtgggcgcgcgccctggtgcagatctcgccctacaccttctccgccatcggcatcgccgtctccatcggcgtctcggtcctcggcgcggcatggggtatcttcatcacggggagcagcctcatcggggccccgcatcaggcgcccaggatcacatctaagaacctcatcagtgtcatcttctggtgaggctgttgcatttatggtgtaattgtgggcatcatccctcaaacaagcttgaaagtgtgccacatcccaaatgtacgatcccggatctccttcgagctggctttgcggatctttgcatctggcccttatcggttgctttccctaaatctgttttgccggggattgttggggggataaacggaaaaccctt

SEQ ID NO: 47453 - protein, 68 aa, Zea mays
  misc_feature: Ceres CLONE 1454719-F
  misc_feature: SWISSPROT Homolog: EC 3.6.3.14 H(+)-transporting two-sector ATPase
MSSDSSSWARALVQISPYTFSAIGIAVSIGVSVLGAAWGIFITGSSLIGAPHQAPRITSKNLISVIFW

SEQ ID NO: 47454 - DNA, 653 bp, Zea mays
  misc_feature: Ceres CLONE 1454721-F
  misc_feature: Encodes the peptide sequence at SEQ ID NO. 47455
aaagctggagctccccgcggtggcggccgctctagaactagtggatcccccgggctgcaggaattcgcacgagaccattacctagaacatcctaatcgaaaaattatccttaggtcgaccaaatccttagaatgctcctgttcttatccagttgaggtctagaagcttactcatcacgccggagcagcagtagcagtcgagctcggcatcagctcccttgctgctcactttgcagcacctcgccagctccctggtaacactctgcacctgccgtcgaactctctcagaatgagcagtttggtcgtccccatctcgccgtggttcgtcctcaccatgttttcagatgtgtttgggctgagatgccattcaaaatcgatgatctgttcgtcgccaccggccgcaagcaccagttttgttgaacatacgtgattgaagatcctttgtggtgatgaaggtgaaatcagcatagcactcgccaagcattctacagaagagctcccaaaataaagagtgaagatttaagatgaagtggttgttgaagaggagtttactccagtgcctgttcatcaagtggatggagccatctaactgatcatcgtgttagaagtatctagaacctcttctctgcaacaaaggagaagttttattccctt

SEQ ID NO: 47455 - protein, 46 aa, Zea mays
  misc_feature: Ceres CLONE 1454721-F
MSSLVVPISPWFVLTMFSDVFGLRCHSKSMICSSPPAASTSFVEHT

SEQ ID NO: 47456 - DNA, 839 bp, Zea mays
  misc_feature: Ceres CLONE 1454732-F
  misc_feature: Encodes the peptide sequence at SEQ ID NO. 47457
  misc_feature (35)..(35): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (46)..(46): n is a, c, t, g, unknown, or other
  misc_feature (55)..(55): n is a, c, t, g, unknown, or other
  misc_feature (56)..(56): n is a, c, t, g, unknown, or other
gtgtgggtagggtccgtgcgttggggagggcgtgngctnnnngggnttaattttnnaaaaactggagctccccgcggtggcggccgctctagaactagtggatcccccgggctgcaggagattcgcacgagaccattacctagaacatcctaatcgaaaaccagattgcacgacgcaaccgatccccaaatccccgaatcttcgcagttccctcctcccgctcgacccagatcaaggcctcaatccaccggccatggcgctggagtgggtggtgctgggctacgcggtgggggcggaggcggtcatgctgctgctgctgacgctgccggggctggacggcctgcgccggggaatggcctcggtggtggggatgccgctcaagcccatgatgcccggggggccggctgtgcctcctcctgctcagggaaatttgtttgaaactacagagacgaggtcccaccttggtgaggaggtagaaccccccgcaatcccccgccgaggcaccatccgtcccaccagaaacggcccgtgtatggaaggagcggaagcgcgcaaaggggcttaccttaattctgcgtgccgggctgcgccccccgtcctacctgggaatacttgctttctcccggtcacccagaacctcgggggggtcggggttttcctcccacgatgggaaccccatttgaggtttggaaccaagcttcaatcctagcccttcgaacgtacttggattgaggggctgggaaagatttcataatcctcttccctcggaggcgcctagccgcaggggggggtggcgggatcctatcccgtgccttgtcggagaggagtctgcctagtct

SEQ ID NO: 47457 - protein, 151 aa, Zea mays
  misc_feature: Ceres CLONE 1454732-F
MALEWVVLGYAVGAEAVMLLLLTLPGLDGLRRGMASVVGMPLKPMMPGGPAVPPPAQGNLFETTETRSHLGEEVEPPAIPRRGTIRPTRNGPCMEGAEARKGAYLNSACRAAPPVLPGNTCFLPVTQNLGGVGVFLPRWEPHLRFGTKLQS

SEQ ID NO: 47458 - DNA, 603 bp, Zea mays
  misc_feature: Ceres CLONE 1454736-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (258)..(258): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggactccccgcggtggcggccgctctagaatagtggatcccccgggctgcaggaattcgcacgagaccattacctagaacatcctaatcgaaaaatcacaattcacaacaccagttgccaaccccacgcacgctctgcgacgcgcgaagtccccttncccactcccaggcttcccgtttccctcggaaccccaccacggggccccccattctcagagctcaaatgcagccgcaccccgccaaaatggaccccggcggtcaagccctccgcctcccccggggagggcgaaatccaaaggtaggggccggcggtccccggaacccaaatccctccccgccccctgggggggccggaagagttaaaaaaagttaaatttggggcccccccggggcggggaaaaaaggcccaaaaaaggggtcccctggggggggaaaaaatcccttttccaaaatcccccaaaaaccgtgttcccccccccccctcttgggggagaaaaaccccc

SEQ ID NO: 47459 - DNA, 687 bp, Zea mays
  misc_feature: Ceres CLONE 1454740-F
  misc_feature: Encodes the peptide sequence at SEQ ID NO. 47460
  misc_feature (436)..(436): n is a, c, t, g, unknown, or other
  misc_feature (613)..(613): n is a, c, t, g, unknown, or other
acagctggagctccccgcggtggcggccgctctagaactagtggatcccccgggctgcaggaattcgcacgagaccattacctagaacatcctaatcgaaaaaaggaaaaaacaatggcggtgctactccgccgcgccgcggcgctcctcgtcgtcgctgctgtctgcgcggacggcgcctccacgttctactcctccgaccccaacctcggatccgcccgcgtcgtcttccagacgaattttggtgatattgagtttggcttctttcctcatgttgcacctaagactgtcgaacacattttcaaacttgtgcggcttggatgctacaacacaaatcacttcttccgggttgaccagggtttcgttgcacaagttgctgacgttatgtcaggtcgaaccgcccctatgaatgaggaccccacaaaagaagcggagnaaacaattgttggtgaatttagtagtgtcaagtatgtcaggggaatcctctccatgggaaggcactctgacccagacagtgctggctccttccttttctattcttctggggcaattcccgcattcttgatgggccagtatgcctgaatttgggaaggttaattacaggtgaccaatncattgaagtaaatttaaagaggctttctaacccaggagagaaaggcattcttttgtaatgccccaacacacccc

SEQ ID NO: 47460 - protein, 155 aa, Zea mays
  misc_feature: Ceres CLONE 1454740-F
  misc_feature: SWISSPROT Homolog: EC 5.2.1.8 Peptidylprolyl isomerase
  misc_feature (108)..(108): Xaa is any aa, unknown, or other
MAVLLRRAAALLVVAAVCADGASTFYSSDPNLGSARVVFQTNFGDIEFGFFPHVAPKTVEHIFKLVRLGCYNTNHFFRVDQGFVAQVADVMSGRTAPMNEDPTKEAEXTIVGEFSSVKYVRGILSMGRHSDPDSAGSFLFYSSGAIPAFLMGQYA

SEQ ID NO: 47461 - DNA, 641 bp, Zea mays
  misc_feature: Ceres CLONE 1454743-F
  misc_feature: Translation starting site: 499
  misc_feature: Pfam Name: DUF1794 Pfam Description: Domain of unknown function (DUF1794)
  misc_feature (641)..(641): n is a, c, t, g, unknown, or other
tctgaactagtggatcccccgggctgcaggaattcgcacgagaccattacctagaacatcctaatcgaaaagaggaggcggccggttcggtactgagtgctgagttgttgaccaacgggaagtccagtacccaagcggagccaccaaggaaaggaggaatggaagccaccggcgcagcctcgcagccctcggcgccgcagacaactcacccggcggtggcgccgctggccttcctactggggaagtggcgcggggaaggcgagggcagcttccccaccatatcctccttccggtacggcgaggagctcctcttctcgcatcatccctccaaggcgtgtggccctctctacctgcgatgtttctctcgcgagaaaatcttcccttcggctgccaaattcttagagctttttctttggcttacggatcggcggtggtgggtggctgcagccagtgatctcgtacacgcagaagacgtggaagacggcgtctggcgagccgatgcacgccgagagcgggtactggcggccccgccctgacggctccgtcgacgtggtcatcgctcagagcactggcctcgccgaggtccagaaaggttcatttgatgctgaaaagaaacagtgacactccaaagcgaacccgtn

SEQ ID NO: 47462 - DNA, 608 bp, Zea mays
  misc_feature: Ceres CLONE 1454756-F
  misc_feature: Encodes the peptide sequence at SEQ ID NO. 47463
ggcggccgctctagaactagtggatcccccgggctgcaggaattcgcacgagaccattacctagaacatcctaatcgaaaacttttttccccactcgacgtcctccctcgccccctcctcctcctgttaggccgagtggcaaacccctagctactacctcgctccagaagctttctttcccctagatctcccatcccatccccatgtccggccgcgctgccgatccggcggccttggcggcgaaggggaagttaggggagctaatgtgggagcaccgggtgcaggcggccgtagcggtggcgctggtggccgcggccgccgtctcgatctccgtcgtggggcccaggctcagcgccctggtgtccttcttctggccgctgctcctctccacgggcttcttcctggtggcggtcgccgtgctgctccggatctcgccgccgcccgcgggcgacgacgacgagtccggcaaggagctcgtcgacttcgtcgcctggtgccgcccgggacacctcgtcccggacgcggcggcccgtgaaggctcccgctggagccggagacctgacgggaatcccggaagaaggaatccggaaaggagggccaaccgccac

SEQ ID NO: 47463 - protein, 135 aa, Zea mays
  misc_feature: Ceres CLONE 1454756-F
MSGRAADPAALAAKGKLGELMWEHRVQAAVAVALVAAAAVSISVVGPRLSALVSFFWPLLLSTGFFLVAVAVLLRISPPPAGDDDESGKELVDFVAWCRPGHLVPDAAAREGSRWSRRPDGNPGRRNPERRANRH

SEQ ID NO: 47464 - DNA, 680 bp, Zea mays
  misc_feature: Ceres CLONE 1454775-F
  misc_feature: Encodes the peptide sequence at SEQ ID NO. 47465
  misc_feature (431)..(431): n is a, c, t, g, unknown, or other
  misc_feature (434)..(434): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (677)..(677): n is a, c, t, g, unknown, or other
  misc_feature (679)..(679): n is a, c, t, g, unknown, or other
aagctggagctccccgcggtggcggccgctctagaactagtggatcccccgggctgcaggaattcgcacgagaccattacctagaacatcctaatcgaaaagtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgtcgcagatctacgccatccgccaggccgtcgccaaggggctcgtcgcctactaccagaagtacgtcgacgaggccgccaagaaggaggtcaaggacatcttcacccggtacgaccgcacccttctcgtcgccgaacccaccccctcccacccnaanaagttcggtggtcgtggcgcccgcgccaggttccagaagtcctaccgttgagcgctcggctgcccgcgcttgccggaccgttgcctgtgttgtcccaacctgccagttcgatgcctgtacgtgctattcaccacctaggtcaacaaggtctatagggctatgcactgactgtattnnnnnnnnnnnnnnnnnnnnnnnnnnnnnnnnnncnnnnnnnnnnnnnnnnnnnnnnnnnnnnnnncngng

SEQ ID NO: 47465 - protein, 160 aa, Zea mays
  misc_feature: Ceres CLONE 1454775-F
  misc_feature (32)..(160): Pfam Name: Ribosomal_S9 Pfam Description: Ribosomal protein S9/S16
  misc_feature (144)..(144): Xaa is any aa, unknown, or other
AGAPRGGGRSRTSGSPGLQEFARDHYLEHPNRKVAVAYTKPGRGLIKVNGVPIELIRPEMLRLKAFEPILLAGRSRFKDIDMRIRVRGGGKTSQIYAIRQAVAKGLVAYYQKYVDEAAKKEVKDIFTRYDRTLLVAEPTPSHPXKFGGRGARARFQKSYR

SEQ ID NO: 47466 - DNA, 808 bp, Zea mays
  misc_feature: Ceres CLONE 1454790-F
  misc_feature (21)..(21): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ccccgcctgtttcccctctcnggggaaaggcggggccccaccannnngtctgcattagcattttcccccctcccccccggtgggggccgctctataactagtggatcccccgggctgcaggaattcgcacgagaccattacctagaacatcctaatcgaaaaactcccagaggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgtcagaacaacgcaggcctcccggacggcggtgaagagcccttccgtctcgaggcttctacaggcgagggtgccaacgggtccaagcgcggaataatataaaaggaaacctggatggtctaccgctcataggcaggcatcccaacggggaaggctaggtcgcgcccctcgaaaggtgcaagaaggcccggagttttggatggctgcactgacgaaccccgctaccgtccttcgatcgcccgccccaccccttgcaccgtggggtcaaatgcgcccatcccaccacgcccggggtgatgggggcctccccccccccccccttttcgggcgccctatgcccgccctttggtgccccccccccccgcgtttctccatgagccgcggccggtcttgtggtccacccggactcgccgcgccgcccacg

SEQ ID NO: 47467 - DNA, 669 bp, Zea mays
  misc_feature: Ceres CLONE 1454821-F
  misc_feature: Encodes the peptide sequence at SEQ ID NO. 47468
tccccgcggtggcggccgctctagaactagtggatcccccgggctgcaggaattcgcacgagaccattacctagaacatcctaatcgaaaaaatcagcaataatctcgccgtctcatcgcaaaacccagcgccccaagagcgaccccaccgaagcgtcccagcccgaccggaatggcgatggcaccgtgcgcacccgcctccgtctcctccttccccgcccgtccagtgcggaccccttccgctgtccggccgcgcggcgccgcgatccgcgcctctgcggcggcggtggagggtggcaggtggtgggcgccactactggggtggtcggggaaggccgactaccttgaggccccggcctcggccccggcggtgccgcaggacgacgacgcgaacgcggcgcgcaagcagttcgtggggcgcctgacggaggaaaaggcccgccagctgctggcgcggatggcgcagacagagtccttgcacgacgccatgtgccactccgacatcgcctcacgccttgcccgctccgcctaaacaggctggccgcccgcccgcacgctcgccgccgaagatcaagaagctccgcacgcttttgtcgatactggtttcgaccttcatttactgggaatgtctttggttgccactacccccattgtctgcctcgtccatcg

SEQ ID NO: 47468 - protein, 119 aa, Zea mays
  misc_feature: Ceres CLONE 1454821-F
MAMAPCAPASVSSFPARPVRTPSAVRPRGAAIRASAAAVEGGRWWAPLLGWSGKADYLEAPASAPAVPQDDDANAARKQFVGRLTEEKARQLLARMAQTESLHDAMCHSDIASRLARSA

SEQ ID NO: 47469 - DNA, 476 bp, Zea mays
  misc_feature: Ceres CLONE 1454822-F
  misc_feature (184)..(184): n is a, c, t, g, unknown, or other
ccccgcggtggcggccgctctagaactagtggatcccccgggctgcaggaaatttgcacgagaccattacctagaacatcctaatcgaaaaaacaaaaaacctcggagctagcagcaagatcttagcacaaacaccacaccccacagggctgattaatcactcccaagactaatcaaaacgaancgcttaaggcttaaatagcgcggcgattcttttttttcccccttcccccttctttggacctgggccaaaaaaaaaaatgggggccttaaaaacggggggcaaaaaactttttggttcccgggggcccaaggaaaaaaaccccccccccttttttctttctctaaaaaaaaaagaacccccccgcggagaaaaaaaaagtttttttttccccccccccccggggaaaaaaaagagggttgttctccccccgggggaaaaaaaattttttttttttttttgggggggggggggg

SEQ ID NO: 47470 - DNA, 780 bp, Zea mays
  misc_feature: Ceres CLONE 1454829-F
  misc_feature (20)..(20): n is a, c, t, g, unknown, or other
  misc_feature (21)..(21): n is a, c, t, g, unknown, or other
  misc_feature (44)..(44): n is a, c, t, g, unknown, or other
  misc_feature (63)..(63): n is a, c, t, g, unknown, or other
cgctgtctttactgataagnnaccccccccatgagccccgaaancccccccccacaaaccccnggtactccccgcggtggcggccgctctagaactagtggatcccccgggctgcaggaattcgcacgagaccattacttagaacatcctaatcgaaaaagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggctggtggtggtgttaaccccccctccctcttcaggtttagggtggagcgatccgtgcaggccaacgcgggggtgcctgacccccaaagggaaaccgcccgccttttttcctccttctgccgccccgctttttcccaacccctccctcaacctcattcggcccgggttggaaccatcacaaaaaaaaggtaccccgccttctttctccctctttcccctctgacctctgccctgtccgctttgctcgtagctccccccaacccccttttttggaacccagatagggggatcccttccctccggccccagcagccccaccgtttactggcccaaacccgcctggtggcccgccaatgaatgagccccccataaaaaatccccctccacgggcgggcgggccctctctttcccacattctaagaggaaacggccccctataaaacccctctgtgttaacacccaccgc

SEQ ID NO: 47471 - DNA, 665 bp, Zea mays
  misc_feature: Ceres CLONE 1454838-F
  misc_feature: Encodes the peptide sequence at SEQ ID NO. 47472
ctggagctccccgcggtggcggccgctctagaactagtggatcccccgggctgcaggaattcgcacgagaccattacctagaacatcctaatcgaaaaatccaccttgtccctcccggagaaccagaaggccacccaccttccaaggcaggggccatggacgaccccgtcgagcgcttgaaggacgggttccacaagttcaagaccgaggtctatgacaagaagccggagctgttcgagcctctcaaggccggccaggcccccaagtacatggtgttcgcctgctccgactcccgcgtgtgcccgtcggtgaccctgggcctgcagcccggcgaggcattcaccgtccgcaacatcgccgccatggtcccagcctacgacaagaccaattacaccggcatcgggtccgccatcgagtacgccgtgtgcgcgctcaaggtggaggtcctcgtggtcattggccatagctgctgcggtggcattagggcgctcctctccctccaggacggcgcacctgacacattccacttcgttgagaactgggttaagatcggcttccctgccaagattaaggtgaagaaagaccacgcatcggtgccgttcgatgaccagtgctctattctagagaaggaggcccgttacctgtccctggagaacctcaagacc

SEQ ID NO: 47472 - protein, 170 aa, Zea mays
  misc_feature: Ceres CLONE 1454838-F
  misc_feature (31)..(170): Pfam Name: Pro_CA Pfam Description: Carbonic anhydrase
  misc_feature: SWISSPROT Homolog: EC 4.2.1.1 Carbonate dehydratase
MDDPVERLKDGFHKFKTEVYDKKPELFEPLKAGQAPKYMVFACSDSRVCPSVTLGLQPGEAFTVRNIAAMVPAYDKTNYTGIGSAIEYAVCALKVEVLVVIGHSCCGGIRALLSLQDGAPDTFHFVENWVKIGFPAKIKVKKDHASVPFDDQCSILEKEARYLSLENLKT

SEQ ID NO: 47473 - DNA, 640 bp, Zea mays
  misc_feature: Ceres CLONE 1454839-F
  misc_feature: Encodes the peptide sequence at SEQ ID NO. 47474
ggtggcggccgctctagaactagtggatcccccgggctgcaggaattcgcacgagaccattacctagaacatcctaatcgaaaaattctttccgtcctcatcccggccattccttgcctgcccgccgcgcggactctatataagccttgtgccccatctcatcagcatccatcaccaccatctccgatccatctcttcggctgcctgtgctacccttcccttcacctcacacaggaatactacaggataaagcagctccttcgatacatatatacttttttccagaaaaaaaaaggctgagccggtgcgagcgaggcttgaccgcttgagcaatggcgagcgcttttagctcgagggcatgcgcgctggtggcgctgctaatggggctctgcaccgccggcgcggcggcgggcaggatcgacgacgggctggaggtgacgtggggcgacggccgcgggagcgtctcgtccgacggccaggtgctgacgctgtcgctcgaccgcacctccggctccgggttccgctccaaggacacgtacctcttcgcgcgcgccgacgtgcagatcaagctcgtccctgacaactccgccggcacggtcaccaccttctacgtaagcttccttctcttctcttctttctc

SEQ ID NO: 47474 - protein, 102 aa, Zea mays
  misc_feature: Ceres CLONE 1454839-F
  misc_feature: SWISSPROT Homolog: EC 2.4.1.207 Xyloglucan:xyloglucosyl transferase
MASAFSSRACALVALLMGLCTAGAAAGRIDDGLEVTWGDGRGSVSSDGQVLTLSLDRTSGSGFRSKDTYLFARADVQIKLVPDNSAGTVTTFYVSFLLFSSF

SEQ ID NO: 47475 - DNA, 650 bp, Zea mays
  misc_feature: Ceres CLONE 1454847-F
  misc_feature: Encodes the peptide sequence at SEQ ID NO. 47476
ctagaactagtggatcccccgggctgcaggaattcgcacgagaccattacctagaacatcctaatcgaaaactcgtggcctctctcccctcctcaccgggcacacacgcactttctgtcagcttcctcccctgagccgataagcaagtccgtgagccaacggtggtgtcagcagcccgagcggcgaggatgcacatcggagcgaggaagctcatgtgggggaccatcccggacaggctcgacgaccacgacgtggtcatcgtgctcgcctcgctgctgtgcgcgctcatcaccgtcctcggcatcggcctcttggcgcgatgcgcgtgctctcccgcgcccagcgcgcaggcggcggcagcagccaacaggggcgtcaagaagtcagcgctgcgcaggatccccaccgtgccgtaaatccgcttccgcccgcgccttgaagtcaaggggtaagggtacgacgcgaacgaatgcgccatctgccctggcggagatcaaggagggctattccacccgcgggctggcccagtggtggtcactttttttcaggccaactgttgaaaacccggtgggttgcgcttccacctcggtcctgtcccttcttgccttcgtgaaccctccccctcccagttggcccccttggccaagcgg

SEQ ID NO: 47476 - protein, 75 aa, Zea mays
  misc_feature: Ceres CLONE 1454847-F
MHIGARKLMWGTIPDRLDDHDVVIVLASLLCALITVLGIGLLARCACSPAPSAQAAAAANRGVKKSALRRIPTVP

SEQ ID NO: 47477 - DNA, 621 bp, Zea mays
  misc_feature: Ceres CLONE 1454851-F
  misc_feature: Encodes the peptide sequence at SEQ ID NO. 47478
ctagatctagtggatcccccgggctgcaggaattcgcacgagaccattacctagaacatcctaatcgaaaaagttggaaccctctttggcgtcgagactctctccggcgttcttgctggtgccctggtttctggagtgcagatcgccatctctgcttccaacaccggcggtgcatgggacaatgccaagaagtacatcgaggctggtgccagcgagcacgcgaggaccctcggtcccaagggatccgactgccacaaggccgctgtgatcggtgacaccattggtgaccccctgaaggacacctccggcccgtccctcaacatcctcatcaagctcatggccgtggagtccctcgtgtttgcccccttctttgccacccagggtggacccccccctcaagtacctgtaaaagggacaacaccaagcacacaccagaagtatacgatctcccgaccgaccgtggacaatatcgaataactcctgccaaatcgccagttccttttgtggactgtgcgctagccgccgcccagctgcactgctgtatttttgtttcccgaatgcctgccgctgttcccattcaatctttgggccttcccggacccttcggaaggtttgttttac

SEQ ID NO: 47478 - protein, 46 aa, Zea mays
  misc_feature: Ceres CLONE 1454851-F
MAVESLVFAPFFATQGGPPPQVPVKGTTPSTHQKYTISRPTVDNIE

SEQ ID NO: 47479 - DNA, 645 bp, Zea mays
  misc_feature: Ceres CLONE 1454874-F
  misc_feature: Encodes the peptide sequence at SEQ ID NO. 47480
  misc_feature (536)..(536): n is a, c, t, g, unknown, or other
tggcggccgctctagaactagtggatcccccgggctgcaggaattcgcacgagaccattacctagaacatcctaatcgaaaaaaaaaacagaagcagttctccaggcaatagactagctagatgcgcatcaccaaagagtagctttcgtctagaacgaagaaacaccccccactacatggccgcgctcagttcttgtgttgcttctggaggcctggcacttcaggccacccttgtggtttctcctcctcgccgccgcgggactccagtcgtcatctccgtatcatctcatggtcgccgcccaagtcttatcggctccaccatgaatccttcaggcatggctccgatcaaaagaactacacgaattcgtgcggttcatccatgccctgcaaattcgttaggaggaagcctcaccatcatcccaatacctgacctgctttcatcatggctctggatgttcggagcggccatagctgcagcagtgcctctttacagaaggttcagagcattagaagataacgtagagaagacggcggangcggcgatcgaggtgatcgactcggtggcggaggcgaccgagaaggtcgccgacgaagttgcgcaaagcgttccccggcagtgaaactctcaagcaggcagcctccaag

SEQ ID NO: 47480 - protein, 147 aa, Zea mays
  misc_feature: Ceres CLONE 1454874-F
  misc_feature (120)..(120): Xaa is any aa, unknown, or other
MAALSSCVASGGLALQATLVVSPPRRRGTPVVISVSSHGRRPSLIGSTMNPSGMAPIKRTTRIRAVHPCPANSLGGSLTIIPIPDLLSSWLWMFGAAIAAAVPLYRRFRALEDNVEKTAXAAIEVIDSVAEATEKVADEVAQSVPRQ

SEQ ID NO: 47481 - DNA, 671 bp, Zea mays
  misc_feature: Ceres CLONE 1454877-F
  misc_feature: Encodes the peptide sequence at SEQ ID NO. 47482
  misc_feature (505)..(505): n is a, c, t, g, unknown, or other
aaagctggagctccccgcggtggcggccgctctagaactagtggatcccccgggctgcaggaattcgcacgagaccattacctagaacatcctaatcgaaaaatcaccaagttttggattccagcagcggcgcccccaggccaggccccacccgctcagcctcctcagctgcccaaccttctccccatctgctcagcctcagctgtcattcccgcgaagcgccgtctcccggctctatcgatggaccgagtcgccgccctcgtcgtcgcgctcctcgccctcttcttcgccgccggggccacggcgcaggccccggcctcgtcgcccaagcgcactccagcgccagcgccacccaggacggccttcctcccgccgccgccggccagggcgcctatggcctccccgccctcgcctcccgtgatggcgccggtgcccgcgccctccgccggcgtgccggccacgagccccgtcggcgcgggagctggtgacaacgcgatggcccccngccggagccgcggcggctctgacttcggctgccgcgcccctcacggagaagagcgccgccgtttaaggctccgccgccggcgccagcctggtggccatctttcccgcctgggcaacccccctccctttcaaaccggggaccgaacttgggaaaacttaaaagggcg

SEQ ID NO: 47482 - protein, 143 aa, Zea mays
  misc_feature: Ceres CLONE 1454877-F
  misc_feature (89)..(89): Xaa is any aa, unknown, or other
MDRVAALVVALLALFFAAGATAQAPASSPKRTPAPAPPRTAFLPPPPARAPMASPPSPPVMAPVPAPSAGVPATSPVGAGAGDNAMAPXRSRGGSDFGCRAPHGEERRRLRLRRRRQPGGHLSRLGNPPPFQTGDRTWENLKG

SEQ ID NO: 47483 - DNA, 687 bp, Zea mays
  misc_feature: Ceres CLONE 1454879-F
  misc_feature: Translation starting site: 137
  misc_feature (1)..(1): n is a, c, t, g, unknown, or other
  misc_feature (195)..(195): n is a, c, t, g, unknown, or other
  misc_feature (314)..(314): n is a, c, t, g, unknown, or other
  misc_feature (372)..(372): n is a, c, t, g, unknown, or other
  misc_feature (401)..(401): n is a, c, t, g, unknown, or other
  misc_feature (407)..(407): n is a, c, t, g, unknown, or other
  misc_feature (413)..(413): n is a, c, t, g, unknown, or other
naacagctgaagctcaccgcggtggcggccgctctagaactagtggatcccccgggctgcaggaattcccacgagaccattacctagaacatcctaatcgaaaacttctctctctcgcccacccgccccggccccaatgtcgccgcccctcgagccccacgactacatcggcctctccgccgccgccgccgcggngccgccgacaccgacctcctcctcgtcgtcctcgtcctcgccggcgccccgcctcaccctccgcctcggcctgccgggctccgagtcccccgaccgcgaccgcgacggggaccgctgcnagaacttctcctccgcgctctccctcggcccgttgcctgctacccttttgccccacantgcgggggggcagaaggggggctttcccnaacccntcccanttccttggggttgcaaaggcaaaagacaacaggcggggggcccccggccgccccaccggtctgcaaaggggcaggggttggaatggccccccccctcccaaattacccgaaaaaccacccccgcccgcgaggtccctcccggaagcaagggccccgcccctgaaaaaacccccccacttccgtccctgggcccatgaccttggaaaggcaaacaatggatggcccccccccccacccttcgggggggggggcaattacacgaatgggacccccc

SEQ ID NO: 47484 - DNA, 635 bp, Zea mays
  misc_feature: Ceres CLONE 1454890-F
  misc_feature: Encodes the peptide sequence at SEQ ID NO. 47485
gcggtggcggccgctctagaactagtggatcccccgggctgcaggaattcgcacgagaccattacctagaacatcctaatcgaaaaacatcgcattaacgaattctttttctttctctcgagagacttctgcatcaatggcggggatcgcaagccctagccctacggctctttatttcaccagtaatctcggcgcaaggaggttgaaagcggcgagctggtcgggaaagagcctccctggtaacgttctccgccggagaagcctgagagttgcggcggaggtgaagttcgtgaacgcagaggaagcaaagaagttgatagcagcggaaggttacaaggttgtggatgtaagagacaagactcagttcgagagagctcatataaagtcttgccaccacatccctctcttcatcttcaacgaagacaacgatcttgggacgatagtgaagaggacagtgcacaacaacttctcagggctcttctttggtttgcctttcacaaaactgaatccggagttcgttaaatccgttagaaacgagttttcacaggatagcaaactattactagtttgccaagaaggtctcagatctgcagctgcagctagtagattggaggaagcaggttatgacaacatag

SEQ ID NO: 47485 - protein, 166 aa, Zea mays
  misc_feature: Ceres CLONE 1454890-F
  misc_feature: SWISSPROT Homolog: EC 2.8.1.1 Thiosulfate sulfurtransferase
MAGIASPSPTALYFTSNLGARRLKAASWSGKSLPGNVLRRRSLRVAAEVKFVNAEEAKKLIAAEGYKVVDVRDKTQFERAHIKSCHHIPLFIFNEDNDLGTIVKRTVHNNFSGLFFGLPFTKLNPEFVKSVRNEFSQDSKLLLVCQEGLRSAAAASRLEEAGYDNI

SEQ ID NO: 47486 - DNA, 663 bp, Zea mays
  misc_feature: Ceres CLONE 1454894-F
  misc_feature: Encodes the peptide sequence at SEQ ID NO. 47487
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaatacgacaaagaaaagaagccgtcacattgaagaattgaagaatagaacaagtgctgtgaagcctgaacaatcattacgcactgcagccattggcggtccattcaagcttttgaatcatgatggaaaacctgttactgaaaaggatttcttgggcaaatggaccctgctttattttggatttacacactgtcttgacgtttgtccagatgaactccagaaaatggctgctgcgattgacaaaattaaggaaaaggcaaaagtggatgttgcgccagtttttattacagtggatcctgaaagagatactgtagagcaggttcgggactatgttaaagagtgccatccatatctagtaggcctcacgggcacgacagatgaagtaagacaagttgcacgtgcttatcgagtttactatatgaagacagaggaggagggttctgactaccttgttgatcactcaattgccatgtacctgatggacccacacatgaaatttgtcaacttttatggcaggaactacgacacatattccttgctgacggtatcgttaaataaatcaan

SEQ ID NO: 47487 - protein, 113 aa, Zea mays
  misc_feature: Ceres CLONE 1454894-F
  misc_feature (1)..(101): Pfam Name: SCO1-SenC Pfam Description: SCO1/SenC
MAAAIDKIKEKAKVDVAPVFITVDPERDTVEQVRDYVKECHPYLVGLTGTTDEVRQVARAYRVYYMKTEEEGSDYLVDHSIAMYLMDPHMKFVNFYGRNYDTYSLLTVSLNKS

SEQ ID NO: 47488 - DNA, 674 bp, Zea mays
  misc_feature: Ceres CLONE 1454902-F
tggagctccccgcggtggcggccgctctagaactagtggatcccccgggctgcaggaattcgcacgagaccattacctagaacatcctaatcgaaaacaaagttagtaaaggatggcaggaagagtacgatgcttcatcgaagcagtgtatgcatggatctaaatgtaaaattgggagctactgtactgtaggaagaaggttgcaagagcttaatatattgggtggcctcatacttccagtttggggtacaatagaaaaggccctggccaagcaggaacgcctcattcacaagagaatacgggttgtccgtttagtcacaacaaatgacagtcagcgaatcgttgggctgctgattccgaattcagcggtagagtcagtactaacaggtttgcagtgggtgggacattgatgactgacatggaaaggcttgaattttgtttctcagctgcattcagtttgctgggctttttttaacttcgtggcacggttctgatattagatgcagcaacatctagtgccacacttgattttgttagtagggagatagcaaggtaactcacccgaagcgatgaaattcttagcttacaggtcaggcaggtatatgctgaacaactttggtatgtaaaataccccggtccggtgttgtaccgtctggttcccatagaaaaaatgt

SEQ ID NO: 47489 - DNA, 637 bp, Zea mays
  misc_feature: Ceres CLONE 1454914-F
  misc_feature: Encodes the peptide sequence at SEQ ID NO. 47490
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaatcctgggtcctggcttctccttccactccggagatcgacggctgcttgccgcactcgcgctcgctcccacggccggcaaccatggccgccgccgctgccgcggtgccagccaccttcctctcgggcctcccctctccacggaccccgtctcctgtgctccactcgcccgtacagagagcccatcccgtcgccgctcctctcttcctctccgccaagcgccgcgcctatgcctgcgccgccacgggctccggctccttctattcctccaactcaggaaatcaaacctcactgatgccgtcgttcagctttgcatttgacgaaggttcttctagttccaaaaggctatatagatggaagagggtattgcttaaagtaagtggagaagctcttgccggcgaccacacagaaaacatcgacccaaagattacaatggctattgcaagagaggttgcttctgtcaccaagctaggtgtagaggttgctattgttgttggcggtggcaatatctttcgtggggcctcttnggctggatgtagtggtc

SEQ ID NO: 47490 - protein, 153 aa, Zea mays
  misc_feature: Ceres CLONE 1454914-F
  misc_feature (148)..(148): Xaa is any aa, unknown, or other
MAAAAAAVPATFLSGLPSPRTPSPVLHSPVQRAHPVAAPLFLSAKRRAYACAATGSGSFYSSNSGNQTSLMPSFSFAFDEGSSSSKRLYRWKRVLLKVSGEALAGDHTENIDPKITMAIAREVASVTKLGVEVAIVVGGGNIFRGASXAGCSG

SEQ ID NO: 47491 - DNA, 657 bp, Zea mays
  misc_feature: Ceres CLONE 1454918-F
  misc_feature: Encodes the peptide sequence at SEQ ID NO. 47492
tggagctccccgcggtggcggccgctctagaactagtggatcccccgggctgcaggaattcgcacgagaccattacctagaacatcctaatcgaaaaaaccgaactcactgcaggaggactcgcacagatcggtgagcgagcaagcgagagatggctgggaggctaaccgcggcagggtcccgcatcctgggcggcggcggcgcacgcgccgcgtcttccgccctccgacaccgcgccggtatgggcctccccgtcggccgccacatcgtccccgacaagcccctccccgtgaacgacgagttggtatgggataacggcacgcccttcccggaaccctgcatcgaccgccttgccccgcacatcggcaagtacgaagcgttggcgtggctgtgcggatgactagagttctccactgccctcggtatggctgctgttgtgaacaacaagactccaatataccatatacctcccaaagtctaccccgtacgacaacttgagagctgagcttggtgataaccataaaagggtttttgtctgtttgaccaggcactttgatgaatatgatctgagatctatatctcctttccatcaaagagagcaggggggaacttattaccctggtttttttgggactgccttgtagaaacccccggtat

SEQ ID NO: 47492 - protein, 82 aa, Zea mays
  misc_feature: Ceres CLONE 1454918-F
MAGRLTAAGSRILGGGGARAASSALRHRAGMGLPVGRHIVPDKPLPVNDELVWDNGTPFPEPCIDRLAPHIGKYEALAWLCG

SEQ ID NO: 47493 - DNA, 779 bp, Zea mays
  misc_feature: Ceres CLONE 1454924-F
  misc_feature: Translation starting site: 228
  misc_feature: Pfam Name: DUF833 Pfam Description: Protein of unknown function (DUF833)
  misc_feature (22)..(22): n is a, c, t, g, unknown, or other
  misc_feature (23)..(23): n is a, c, t, g, unknown, or other
ggcgcacgcgaattaaaataannaaccaaaagaatacatgggggcgggtgcccgaactccttggggggcgcaacgcggtggcggccgctctaaaacagtggatcccccgggctgcaggaatgcgcacgagaccattacctagaacatcctaatcgaaaaagctaagatagctgcaaaacaagcgagttacttacaaccaaacagaagggtagaaaccacctgaagccatgtgcattgctgcatggatttggcaggctcaccctgtgcaccaactcctcctgcttctcaacagagatgagttccacagcaggcctacaaaagcagtaacgatggcggggtgaaggctcaaagaagatccttggtggcagggatgtgcttggcggaggaacatggatggggtgccccaaggacggaaaggttgccttcctgaccaatgggcttgaagtacaaccccatgaccggtgcacggaccagggggagaacccccctcgtcaattccctgctcagccccaagaacccccctcgaaggttgccaagtgaaatgggccgaagaaatgtggatcgaatacaaaccgggttcacccacccgtagacaccccccccctaatcccccccaccatcgggcgccccactatttttaaccctcggcccctctattgccccccccctgcccacccaatacccctaataaaaggccccccttatgcccccccccatttttgcgctgcaaaaatactggaaaaagggccacaaagacccgcaaatttgggaccccaaaa

SEQ ID NO: 47494 - DNA, 637 bp, Zea mays
  misc_feature: Ceres CLONE 1454927-F
  misc_feature: Encodes the peptide sequence at SEQ ID NO. 47495
tggagctccccgcggtggcggccgctctagaactagtggatcccccgggctgcaggaattcgcacgagaccattacctagaacatcctaatcgaaaagtcgatcagtactactacacagtaggaagctaggaggaaatcaaagcaacaaagttgccggccgatagaaccaaaccatgaggcctcaggtgttactcgtcacactggctgttatcgtcgtccttgcagctctgccactcagcaaagggacggaagaggaagacggagggtcggtagtcgcctccgtggacgacgccggatcgagctcgtggccatgctgcaacaagtgcggtttctgctacctgtcttacccgccgtagtgccaatgcctggacttctcgacggtcggctgccacccagagtgcaagcagtgcatcaggtacaccgacgacgatggcttctaacatcccgcccgtgcacgactaccgctgcgaccgacatcctcgatcactttctgcgagtgctgctgcactcccgacagcagctgctttcaatgtctagccgctagcccaacgtaaaaggaaggatgcatggaatcctcgtacaatcgccatttgccggggttcccgtttctggggaaaaaaccaaataaatggttgg

SEQ ID NO: 47495 - protein, 60 aa, Zea mays
  misc_feature: Ceres CLONE 1454927-F
MRPQVLLVTLAVIVVLAALPLSKGTEEEDGGSVVASVDDAGSSSWPCCNKCGFCYLSYPP

SEQ ID NO: 47496 - DNA, 728 bp, Zea mays
  misc_feature: Ceres CLONE 1454932-F
  misc_feature: Encodes the peptide sequence at SEQ ID NO. 47497
  misc_feature (24)..(24): n is a, c, t, g, unknown, or other
  misc_feature (36)..(36): n is a, c, t, g, unknown, or other
  misc_feature (47)..(47): n is a, c, t, g, unknown, or other
  misc_feature (51)..(51): n is a, c, t, g, unknown, or other
  misc_feature (53)..(53): n is a, c, t, g, unknown, or other
  misc_feature (54)..(54): n is a, c, t, g, unknown, or other
gtttttttcctcccccccctcctnctctcctcccgnccgttcttttntttntnnaaagctggagctccccgcggtggcggccgctctagaatagtggatcccccgggctgcaggaattcgcacgagaccattacctagaacatcctaatcgaaaacacattctgcccagctaagctaagctccctccgtccatcggcatggcgactaccactactaccatcctcctcctcctcctcgtcgcagccacagccgtctcggcggacgacctctccgtgtaccacaacgagcacccgccgtccccgtccccgctcgagtctatcatcgggctcgcccgctccgacgacacgcggctcctcttcctctcacccaaggcggcctcgtccggcggagtgtcgtccgctcccggcgcctccggcctgactctggactcgaacgtcattggcgcggggctcgggaccccggtccaccacctgctcctcccgctaggagaccagggccaacgccacctggtccgtactgcacgccgagcgaaatgtggctcgtccggctgcgcgttttatcacgggcaggtcatcctcgaacgcctccctcccgtgcgcctcccaactggtgccagctcattcaggggcctgcccttgcccggcgaatcaggaaccctcaaaccccgatgacaggggtgtcccattcttcaaagccgttaagcgcaaaccctctttaccaaggaaaaa

SEQ ID NO: 47497 - protein, 157 aa, Zea mays
  misc_feature: Ceres CLONE 1454932-F
MATTTTTILLLLLVAATAVSADDLSVYHNEHPPSPSPLESIIGLARSDDTRLLFLSPKAASSGGVSSAPGASGLTLDSNVIGAGLGTPVHHLLLPLGDQGQRHLVRTARRAKCGSSGCAFYHGQVILERLPPVRLPTGASSFRGLPLPGESGTLKPR

SEQ ID NO: 47498 - DNA, 635 bp, Zea mays
  misc_feature: Ceres CLONE 1454933-F
  misc_feature: Encodes the peptide sequence at SEQ ID NO. 47499
aagctggagctccccgcggtggcggccgctctagaactagtggatcccccgggctgcaggaattcgcacgagaccattacctagaacatcctaatcgaaaatttagtcattcacgtagtggaactggattctctttgaaaagcaagccaaattctgaccttgaaaatgctatgggcaattctcttggccaaggaatgacatcgactcaaacattggattctgttgtaaagcctagacgtgtcagtaacagcttagggactacagttatgggtgtcataagacgttctgctagaggagtgatcaagtcagatactacgtttcacgcattatctgatgctggtagcactgattcccgcaccactataaccacaagagcaagtgggttaatgacaagttctgaagcacttataactcctgcacccttcaaaactgatgtgtctgctttagtctctatactccatcgggagtttctgggagtggtaaacgtctgttttctgaggcaccgggacaatccctgtacagggatcgagctgcaaaagacgaaatctgaatggatcatctcaggcaactgatactgttggattgaattcacctggtgactatccccccccaaagggttcaagggaaatagggcc

SEQ ID NO: 47499 - protein, 189 aa, Zea mays
  misc_feature: Ceres CLONE 1454933-F
AGAPRGGGRSRTSGSPGLQEFARDHYLEHPNRKFSHSRSGTGFSLKSKPNSDLENAMGNSLGQGMTSTQTLDSVVKPRRVSNSLGTTVMGVIRRSARGVIKSDTTFHALSDAGSTDSRTTITTRASGLMTSSEALITPAPFKTDVSALVSILHREFLGVVNVCFLRHRDNPCTGIELQKTKSEWIISGN

SEQ ID NO: 47500 - DNA, 661 bp, Zea mays
  misc_feature: Ceres CLONE 1454941-F
  misc_feature: Encodes the peptide sequence at SEQ ID NO. 47501
  misc_feature (382)..(382): n is a, c, t, g, unknown, or other
  misc_feature (385)..(385): n is a, c, t, g, unknown, or other
  misc_feature (496)..(496): n is a, c, t, g, unknown, or other
aaagctggagctccccgcggtggcggccgctctagaactagtggatcccccgggctgcaggaattcgcacgagaccattacctagaacatcctaatcgaaaagtaaaaaaaaaaccttgacaagaacgaattcgcctccggctctcctcttctcgagcgttttcggcaccacggcgcagtaggatggcggcggcggccccgacgagagcagaggtgctgtcgctcttccgttccttactccgcacggcgaagaagttctcggactacaacatccgcgagtacacgcgccgacgcgccgcggactccttccgcgaaaacgcgccctcgccgatgcgtcggccgccgccgcggcgttctcggaggggaagagcagctagagttngcnaagcggcaggcggtggttactctctctacgccccaagggccagagcgtgatggagttgaaggtgcagtgatggctgcaaccttttctcccccccggtccccgtccagattncgtgcttttgggggtgatgaaactataaactgctcccgtgtcccattttctggatgaatgtcatgatatagttccggtctgggcataaattactaaattctaccgccaaaaaaaaaaaaaaaaaagttatcgataccgtccacctcggagggggggcccggtacc

SEQ ID NO: 47501 - protein, 83 aa, Zea mays
  misc_feature: Ceres CLONE 1454941-F
  misc_feature (6)..(82): Pfam Name: Complex1_LYR Pfam Description: Complex 1 protein (LYR family)
  misc_feature (67)..(67): Xaa is any aa, unknown, or other
  misc_feature (68)..(68): Xaa is any aa, unknown, or other
MAAAAPTRAEVLSLFRSLLRTAKKFSDYNIREYTRRRAADSFRENAPSPMRRPPPRRSRRGRAARVXXAAGGGYSLYAPRARA

SEQ ID NO: 47502 - DNA, 652 bp, Zea mays
  misc_feature: Ceres CLONE 1454944-F
  misc_feature: Encodes the peptide sequence at SEQ ID NO. 47503
  misc_feature (611)..(611): n is a, c, t, g, unknown, or other
  misc_feature (646)..(646): n is a, c, t, g, unknown, or other
ctggagctccccgcggtggcggccgctctagaactagtggatcccccgggctgcaggaattcgcacgagaccattacctagaacatcctaatcgaaaagaagaaaaggaaggaagaagggcctcctgtctcctctcacttcctcagtcctcgtccgtctctgctccctcctctctctacctagctagctagccagccttcctgtagcgcggcagagatggctgcccctgcatccaccacggcggcggcggcggcggcgctgctgcttctgctcgtgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgccgacgcgggcgtccactccttccgcctcggcctcaaccgcttcgccgacctcaccaacgacgagtaccgcgccacctacctcggcgccaggaccaggccgcagagggagaggaagctcggcgccaggtaccacgcccgcgacaacgnagaccctgcggagtccgtcgactggagggccaggncgccgc

SEQ ID NO: 47503 - protein, 145 aa, Zea mays
  misc_feature: Ceres CLONE 1454944-F
  misc_feature (45)..(105): Pfam Name: Inhibitor_I29 Pfam Description: Cathepsin propeptide inhibitor domain (I29)
  misc_feature: SWISSPROT Homolog: EC 3.4.22.14 Actinidain
  misc_feature (132)..(132): Xaa is any aa, unknown, or other
  misc_feature (144)..(144): Xaa is any aa, unknown, or other
MAAPASTTAAAAAALLLLLVSLAAAADMSIVSYGERSDEEARRMYAEWMAAHGRTYNAVGEEERRYQVFRDNLRYIDAHNAAADAGVHSFRLGLNRFADLTNDEYRATYLGARTRPQRERKLGARYHARDNXDPAESVDWRARXP

SEQ ID NO: 47504 - DNA, 674 bp, Zea mays
  misc_feature: Ceres CLONE 1454950-F
  misc_feature: Encodes the peptide sequence at SEQ ID NO. 47505
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaaatagatcagagcctagccagagccagagctgagagccgaggagggaaacgaagaagcggccatggcgatgaagcggccggcgcgcagcgacccacacctgccacccgaggaggcggcacgggtggaggccgaggttcggagctacttcgacagcgtcgcgccgaggcgcccggccaagccgccgcgcagcgacccgtcggtggacaccttcgcggaacccgccgccgtcgacgccggggaccacgacttgccggagctccgcaagctgcgcgacctcgaggcgaagccccaacggtgttttttggaacggagggggnaggggaacgtggatggccggggaaggatttacgtggagacgcgatactacgatggcctcataggcatcgacaagcagcatcacacgactgggacaggctttatcaaagtggagagatccaatggcagcaccttcagtgtgatgactaacggctacccacctgccagctctgtccgctgcacgagcaatcctgcgacaaatgattggataccatcttctgaatcgatcatccctgcttcgacaagcccagcaggagc

SEQ ID NO: 47505 - protein, 170 aa, Zea mays
  misc_feature: Ceres CLONE 1454950-F
  misc_feature (86)..(86): Xaa is any aa, unknown, or other
MAMKRPARSDPHLPPEEAARVEAEVRSYFDSVAPRRPAKPPRSDPSVDTFAEPAAVDAGDHDLPELRKLRDLEAKPQRCFLERRGXGNVDGRGRIYVETRYYDGLIGIDKQHHTTGTGFIKVERSNGSTFSVMTNGYPPASSVRCTSNPATNDWIPSSESIIPASTSPAG

SEQ ID NO: 47506 - DNA, 630 bp, Zea mays
  misc_feature: Ceres CLONE 1454962-F
  misc_feature (212)..(212): n is a, c, t, g, unknown, or other
  misc_feature (213)..(213): n is a, c, t, g, unknown, or other
  misc_feature (221)..(221): n is a, c, t, g, unknown, or other
  misc_feature (223)..(223): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (279)..(279): n is a, c, t, g, unknown, or other
  misc_feature (342)..(342): n is a, c, t, g, unknown, or other
  misc_feature (343)..(343): n is a, c, t, g, unknown, or other
  misc_feature (357)..(357): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (369)..(369): n is a, c, t, g, unknown, or other
  misc_feature (384)..(384): n is a, c, t, g, unknown, or other
  misc_feature (389)..(389): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (468)..(468): n is a, c, t, g, unknown, or other
  misc_feature (529)..(529): n is a, c, t, g, unknown, or other
  misc_feature (599)..(599): n is a, c, t, g, unknown, or other
  misc_feature (600)..(600): n is a, c, t, g, unknown, or other
  misc_feature (608)..(608): n is a, c, t, g, unknown, or other
aagctggagctccccgcggtggcggccgctctagaactagtggatcccccgggctgcaggaattcgcacgagaccattacctagaacatcctaatcgaaaaaacaagcgaaccggcggcgtcatcggaccgagtggcgtcttcctcctcccttcgtaaccttccagacccgaccgcagcagcccggggcaacaagcgaaccggcggcagcgnnatgggggngnaatcggtgnnnagcacttcgaggggcgtcaagcagcactggggcgagcaacttcgnctttcctcgactacttcagaaagtcttaggggcggccaaaaaccccccccccggggggggggnnaaaaaaaaaaaaanaannnnaccaancccccacccccgggncgggnaaaaaaaaaaaaaaaaatatttttttttttttttttnnnnnnaccacccccgggtttgtggggccccccccaaaaaagngggggcggggtgggggaaaaaaaaaagaaaattttcgctcccgggggcgggccccctttgnggcgggggcccccgcccccccccgcggggggggggtggggtatattttttttattataacataaaaacanngggccccnccccccgtttttgggtggtgtg

SEQ ID NO: 47507 - DNA, 646 bp, Zea mays
  misc_feature: Ceres CLONE 1454963-F
  misc_feature: Encodes the peptide sequence at SEQ ID NO. 47508
  misc_feature (571)..(571): n is a, c, t, g, unknown, or other
  misc_feature (646)..(646): n is a, c, t, g, unknown, or other
acccgcggtggcggccgctctagaactagtggatcccccgggctgcaggaattcgcacgagaccattacctagaacatcctaatcgaaaaagcatccatcgtccatcgacccacccaaccacctcctccgccccgcgcttcgcctgggtaccggcgtccgccgcgccccgtcccgtccaggaacaggaagagcagtaacccatccacccatccatcggggatcaccaggggagcaagatgtcgactgccaccgccgcaagattgcccgctcccagatccggggcaagctatcactatcagaccgcggctccggcggccaacaccctctccttcgccggccacgcgaggcaggcggcccgcgcgtccgggccacggctgtccagcaggttcgtggcggccgcggcggccgtgctgcacaaggtgaagctggtcggcccggacgggacggagcacgagttcgaggcccctgacgacacctacatcctcgaggcggccgagaccgccggggtggagctgcccttctcctgccgcgccgggtcctgctcccactgcgccggggagatgtcggccngcgaggtcgaccagtcggaggggtctttcctcgacgacggccagatgggcgaggggtacctcctcacctgcatcn

SEQ ID NO: 47508 - protein, 136 aa, Zea mays
  misc_feature: Ceres CLONE 1454963-F
  misc_feature (65)..(136): Pfam Name: Fer2 Pfam Description: 2Fe-2S iron-sulfur cluster binding domain
  misc_feature: SWISSPROT Homolog: EC 1.14.13.7 Phenol 2-monooxygenase
  misc_feature (112)..(112): Xaa is any aa, unknown, or other
MSTATAARLPAPRSGASYHYQTAAPAANTLSFAGHARQAARASGPRLSSRFVAAAAAVLHKVKLVGPDGTEHEFEAPDDTYILEAAETAGVELPFSCRAGSCSHCAGEMSAXEVDQSEGSFLDDGQMGEGYLLTCI

SEQ ID NO: 47509 - DNA, 540 bp, Zea mays
  misc_feature: Ceres CLONE 1454969-F
aaagctggagctccccgcggtggcggccgctctagaactagtggatcccccgggctgcaggaattcgcacgagaccattacctagaacatcctaatcgaaaaaacagaaaacctcgcagctagcagcaagatcttagcacaaacaccacagcccacaggctgattaatcactccaagactaatcaaacgaaacgctttaaccttatagcgcgcgatctttttttccccctccccttccttgagtttttttgacccgtccaaaaaaaaattggcttaagggggaaaacaactttggggaaaaaaagaaaaaaccactttttcggggaaaaccccccagaaaccctttccacggggggagggggggggggaaattttttttggggttcaaaaaggcccacggggcttttttcccccccggggggtgtgtggggaaaaaaaaccccccccccctctttgtttcacccgggggggtttcaaaaaaaaaacccccccccggccctttttttctatggggcgccaaaaaaaaaaaaactccccgag

SEQ ID NO: 47510 - DNA, 665 bp, Zea mays
  misc_feature: Ceres CLONE 1454977-F
  misc_feature: Encodes the peptide sequence at SEQ ID NO. 47511
  misc_feature (541)..(541): n is a, c, t, g, unknown, or other
  misc_feature (556)..(556): n is a, c, t, g, unknown, or other
  misc_feature (557)..(557): n is a, c, t, g, unknown, or other
  misc_feature (660)..(660): n is a, c, t, g, unknown, or other
caattgggtaccgggccccccctcgagccctgcagtggtaaaggcgtcagggcctctcgatcgctcatcagtcgccagaggagtagttgatcgaggtgagtgaggttgaaaagcaggcggcgaacaaaggcaccatcgtcatggacggcggatactacggcggccgcgatcagcgctacagcggcggatactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacgccatgagcgtccgcgacgggaaggtggtgctggcgccggcgaaccccaaggacgagtaccagcactggatcaaggacatgcggtggagcacgagcatcaaggacgaagaaggttacccggcgttcgcgctggtgaacaagcgaccggggaggccatcagcactcgctggggcagtcccacccggtgcgcctggtgccctacnacccggactttttgnnacgagtcgtgctgtggacggaaagccgcgacgtcggcaacggcttccgctgcgtccgcatggtcaacacatctacctcaacttcaacgcccctcacggcgacnagtgc

SEQ ID NO: 47511 - protein, 175 aa, Zea mays
  misc_feature: Ceres CLONE 1454977-F
  misc_feature (134)..(134): Xaa is any aa, unknown, or other
  misc_feature (139)..(139): Xaa is any aa, unknown, or other
  misc_feature (174)..(174): Xaa is any aa, unknown, or other
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKRPGRPSALAGAVPPGAPGALXPGLFXTSRAVDGKPRRRQRLPLRPHGQHIYLNFNAPHGDXC

SEQ ID NO: 47512 - DNA, 641 bp, Zea mays
  misc_feature: Ceres CLONE 1454982-F
  misc_feature: Encodes the peptide sequence at SEQ ID NO. 47513
caattgggtacgggccccccctcgagccctgcagtggtaaaggtacaggcacgctctctcgagtcggcgacgatgagtcgtttggcgccactcaacgccaggtcttcgtgaatcccatcgacggagatgagtttctctcagtgtactgtcacggtgaaggccaggagggagaggcctaggattcgccctcttggcctgacgcagcatacgatgccttaaataagggaagtctttgatctgcttgatacagataactctggaacggttgatgcacacgagctcatcgttgacctgagagccttgggatttgagatgactgaccagcaaattacgcaaatgattgctgatgttgacaaagatggcgatggagcgatcaactacgatgagttggatcacatgatcactgccaaaatctgggacaggcatatcaacgaggagctgtcacaagcattccgcattcttgatcaatacgcaaatgccaggatgtctaacattgatatcctcaagattgccagatacctgggtgtcaatctcaccctcgatgagatcccatacatggtgcaccaggctgatataaatggttgacgatgaaacatactttcaccagttcctcatgatgatgacgaggaccttctttggcc

SEQ ID NO: 47513 - protein, 90 aa, Zea mays
  misc_feature: Ceres CLONE 1454982-F
  misc_feature (5)..(33): Pfam Name: efhand Pfam Description: EF hand
MTDQQITQMIADVDKDGDGAINYDELDHMITAKIWDRHINEELSQAFRILDQYANARMSNIDILKIARYLGVNLTLDEIPYMVHQADING

SEQ ID NO: 47514 - DNA, 659 bp, Zea mays
  misc_feature: Ceres CLONE 1454987-F
accgggccccccctcgagcactgcagtggtaaagggctgattcacgtcgctacttcggccacatggctgcagcggcggcgtgaaccggcgccgcatcccccaactcgctgctgctctcgcgttcgcctccccacgccgccgtgctcgcgccttcgtcggggagctccatgcggaggcgtgctcctgctcggcgtcggcaccccggccgtggtggcgctggcgaccgcggagccgccggcggtgctgcaggacggggcaggcactgtgctcatcaccgccggcgcctactctcttgtgggcgtcttcaagaagctcagcgagcggcggctcatcaaaaagagcttgaacaggaatgttgtgcacgtgctgtccggcgtcctgttcatgacatcatggaccctgttcaagtattcgctgtccctggcatgcatcgaggttctcagattcataaggtttcacactgcgaagccacgaccatagtgtgctctgcccacagcaattcgacaggaacacggtatttcgccgcgcttgtcgcgttcctgaactccatgaggcttctgagatatggactccgtctctacactgatcgatctctgggaattgctgataggtccactctattatgtccctgggctactgttcacgtattgagtctgcgg

SEQ ID NO: 47515 - DNA, 651 bp, Zea mays
  misc_feature: Ceres CLONE 1454997-F
  misc_feature: Translation starting site: 138
  misc_feature: SWISSPROT Homolog: EC 6.3.2.19 Ubiquitin--protein ligase
cgattgggtaccgggccccccctcgagccctgcagtggtaaaggaggtcggacgcgccttccgtacgcgtgcgcacgacgcacatatacctttcctctcttctcccgacccctcttacgcggcaaccccggcgcggcatggcgagcccgtcctcctcctctttcccgacccggaaggacatgatcaacatcgcctgcatgcgcctggagaaggatctaagggattggcatgtcaacccgcccgccggctatctaaaccagggatctaccgactacctccagagttccttggcggcggcagctacctcacttcgcgaataaccctcgtcggggggcaacggtcgttacaggatgaaacccaccacaaaagatctcccgcctatgtagccggggcagcaggtaaactctaaactggcgagacctacgaactgcacggggatttctccgagcattatcccatgtaggcatctcacgttatatttctgcctccagcatcgatggatccgcccgtttagcctaatggacacatctagtttacatatattgcatgactcctcgctcccccacattcgactgtcggaatctatctcgtatcagcatatttatctatactcggccaactccacaggcaaaagaccggctcaccctaata

SEQ ID NO: 47516 - DNA, 649 bp, Zea mays
  misc_feature: Ceres CLONE 1455010-F
  misc_feature: Pfam Name: Acylphosphatase Pfam Description: Acylphosphatase
  misc_feature: SWISSPROT Homolog: EC 3.6.1.7 Acylphosphatase
cgaattgggtaccgggccccccctcgagccctgcagtggtaaaggaaggaaacaggtttatacccacaatctggcatgaattccaacccaagcagatagcaaagcttttcaggaattcaggtaaacagactacggtacattagatgtcgcctctgatctttaatcgcagattcgcagtagtagtgcacgaatagaccgttcaagaccgcgcggcgagacgcgaacctgtcgcgggacgggggggtcagacggtgaacttgatctcgaagccggtggacggatccacgggctcggccgtggacgggacgacggcggtgacggtggcggctggggggccgacggggaggcggcgggttatcatgtcttcgatcttcgcggggtctccggagaggagggcctccacactgccgtcacggcggttgcggacccagccggcgaggccgagcgactcggccgtggacgcagtccagtcgcggaaccccacccccgtgacgcgccccttcaccaccacgcggactgccttccgtgcgggctccggctgcggcgcggatggtggcgtggcggcatcgggatcggcggaggacgccatggcgcggtggtgctggtacggttgtggacttgtggaagcagcgagactggagaccggaga

SEQ ID NO: 47517 - DNA, 658 bp, Zea mays
  misc_feature: Ceres CLONE 1455015-F
  misc_feature: Translation starting site: 172
  misc_feature: Pfam Name: DUF1000 Pfam Description: Domain of Unknown Function (DUF1000)
  misc_feature (658)..(658): n is a, c, t, g, unknown, or other
caattgggtaccgggccccccctcgagccctgcagtggtaaaggagccggattcgctcgtccagctacccggacgcgcgcacgcagagcaaaacgctcccctcccggccttcccttcctccccgccctccaaagtccgaaggccagaagcttccggaagccagcccaagccatgaacgccgccagcaccgccgccgcggcccccgcgcctgcagcgaccgtgcaggtgccgcgcggtcaggtggatctgatcgacttcatcgactggaccggcgtccagtgcctcaaccaggacgcgtcccacagcatcgacaacgcgctcaagcagagtttgagagacgacgaggggctgtacctcgccagcgattcacacgagcagctgctgatctacatccccttcatgcatgtagacaaactgcattccgcgctagttcagacgtcccgaggaagagggtcccaaaacagtaaaactcttctccaacaaagagcatatgggtttcagcaatgtcaatgactatccacaaagtgacaccctcgagctatcatccgatcatttgatagagaatagacttttgccactaaagtatgtcaagtttcaaaatgttcgcagactgactatctttattgaggacaaccaaagtgcaagtgatgtctccaan

SEQ ID NO: 47518 - DNA, 698 bp, Zea mays
  misc_feature: Ceres CLONE 1455022-F
cgattgggtaccgggccccccctcgagccctgcagtggtaaagggcgggacgatctgttcgtccctctcatccacgtcgaggccgcgcgcgggaacgacgactgcgacaccagcgccagcccgccgagctacgcggacacgctccgcgcgctgcgagtgcccgaggagggggaccgcccgctcacggacgccgagatggtcagcctctgctccgagttcctcaacggcgggacggacaccacggtgacgctggtgtagtggatcatggcggagctcgtacaccacccggacgtgcatgtcgatgtgcacgaggatgtcatcaggtcgccgtcctcgtcaaagctggcagaccacggtgacgatgacttccagtcggtccggaaatgccgaacctcaagcccgtggtggtggagggccttccccggaacccgaccgggcccgttccggctcccgctggggtggaaaacggagggggcccaaattgggggtttaacttgtccccggggggggggaattgaatttcctggggcaaaaagatgggggggaccacccggggggaaaaaagggggggagtttccccccggcgcccttttctagagaggagggggggggggggggggaaaaactctccggggggggggaaaaaaaaaaaattttttggggcgcgggggggattttcccccccagacacccggcgg

SEQ ID NO: 47519 - DNA, 657 bp, Zea mays
  misc_feature: Ceres CLONE 1455025-F
  misc_feature: Encodes the peptide sequence at SEQ ID NO. 47520
ccgggcccccctcgagccctgcagtggtaaagggttcttcttcccacccagccgcgctccctcttcctcttccccttctctctcggcgacgactgggtggccgtagctgcctccatacgcctggtgccctggtcttcttcgggccattcgccggccgcgagcaccaccaagtacgcccacctcatgaagggagagcttcccaggtagagaaacagtttctccgtactctagcagatggcaaggataaagcctaagcaattgctaatccaaagcaaaacaaagaaggctccatctcgaatcagctactctactatcatcacatggaacttgattgtcatattggttgtgctatctctctatgctacctacagccattggcatcaaaggttaatgtcctttccggaaacctttattgggtttaatttactattttttttgcacctagcacacttatatattgcaataagttgagatgaagtaagctcatgccgatctttctgtagttgttgaataagtagtgcaatatatatttctgctcagcattcctctattgatgagttcaacctcaggtctacccaagacttcgaaatggagcttcatgaagctgagcttgctgtgagaccggaggatcaaaaatgataagtagaccaagatatg

SEQ ID NO: 47520 - protein, 78 aa, Zea mays
  misc_feature: Ceres CLONE 1455025-F
  misc_feature: SWISSPROT Homolog: EC 5.2.1.8 Peptidylprolyl isomerase
MARIKPKQLLIQSKTKKAPSRISYSTIITWNLIVILVVLSLYATYSHWHQRLMSFPETFIGFNLLFFLHLAHLYIAIS

SEQ ID NO: 47521 - DNA, 754 bp, Zea mays
  misc_feature: Ceres CLONE 1455036-F
  misc_feature: Translation starting site: 182
  misc_feature (286)..(286): n is a, c, t, g, unknown, or other
  misc_feature (324)..(324): n is a, c, t, g, unknown, or other
  misc_feature (325)..(325): n is a, c, t, g, unknown, or other
  misc_feature (351)..(351): n is a, c, t, g, unknown, or other
ctggagctccccgcggtggcggccgctctagaactagtggatcccccgggctgcaggaattcgcacgagaccattacctagaacatcctaatcgaaaaaaaaccctactaaccgcgtctcctctccagcgcccgccgtcgccgccgccctcctcttggtcccgccgtccgtcgaggtcatcatggtgagggtcagtgtgctcaacgatgcgctcaagtccatgtacaatgcagagaagaggggcaagaggcaggtcatgatcaggccgtcgtccaaggtgatcatncagttcctgacggtcatgcagcgtcatggatacattgnncgagttcgagtacgtgaatgaccacngagctggggaaaattgtgttggaactgaacggcaaactaaaacaatgcggtgtaattagcccccggggttgagtgttgggggtaagggaaatccaaggggtgaatggcaaggctgcttccgtccccccaggttggttatatccgggctaaaccccttgggggaattttgggttccaaaggggcccccaacccaaaaactcgaagagaaaactcttttttctttttttaaaataaagggggcccccaaatttttcttattaaagggggggggccccccaattttttttttttttttttgcccaaaaaaaaaaaaaggtgttctcttctaaaaagaggggggtgttttttcttttttttaaaaaagctcccccggggggggggtcttttttttgtaaaaaaaaaa

SEQ ID NO: 47522 - DNA, 699 bp, Zea mays
  misc_feature: Ceres CLONE 1455039-F
  misc_feature: Encodes the peptide sequence at SEQ ID NO. 47523
ctggagctccccgcggtggcggccgctctagaactagtggatcccccgggctgcaggaattcgcacgagaccattacctagaacatcctaatcgaaaaaacaacgggtacaacctaacgatacgtgccgacggggacacagtgaaaatctcgtctgcatctgccagcgccgccacggtgaccaagacgctgctcgacaagggggcgctctccgtctacctcatagacgcggtgctcctgccaaggcagcagtctaacgacgaccagggacacactgcgcccgcccctgcgccggcctcctcgcctgcacatgcacctacacctgcccttgcaccggtctcgccgtcgcctgctcctgtaccggtctcgccgtcagcgtcggcgtcgcctgcacatgcacccacacacccacttgcccctgctccggtgactgcacctgcgtcaagttgtcgcccaaggccttcgccagagaaactaccccagcttctttcctggaatgggaccgccaaccgcctgcaaattaaaaaaactacccccagggggcacgggcttcttgggattttggcccgggccctgggaaacggtggccccttgttccgaaagggtttaagggtttaaactttaaattttggggccccatggggaactcgtaatttccccccgcaataccggggacccttgaaaaaaggtttttgggggg

SEQ ID NO: 47523 - protein, 204 aa, Zea mays
  misc_feature: Ceres CLONE 1455039-F
GAPRGGGRSRTSGSPGLQEFARDHYLEHPNRKNNGYNLTIRADGDTVKISSASASAATVTKTLLDKGALSVYLIDAVLLPRQQSNDDQGHTAPAPAPASSPAHAPTPALAPVSPSPAPVPVSPSASASPAHAPTHPLAPAPVTAPASSCRPRPSPEKLPQLLSWNGTANRLQIKKTTPRGHGLLGILARALGNGGPLFRKGLRV

SEQ ID NO: 47524 - DNA, 716 bp, Zea mays
  misc_feature: Ceres CLONE 1455041-F
  misc_feature: Encodes the peptide sequence at SEQ ID NO. 47525
  misc_feature (555)..(555): n is a, c, t, g, unknown, or other
  misc_feature (572)..(572): n is a, c, t, g, unknown, or other
  misc_feature (573)..(573): n is a, c, t, g, unknown, or other
aaagctggagctccccgcggtggcggccgctctagaactagtggatcccccgggctgcaggaattcgcacgagaccattacctagaacatcctaatcgaaaattccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttcctccactccttctcggttgtcttcctctactggttttatgtgatctcataacttgccctcccccggatccgccattcccccgtgccctctctccgtcccctcaaccttctccctccntttcgtggctcccctcnnacatcgccaaataacagcactagccggcagcgggtagaggatccttttcgaggtaagctagggcccggctggttccctgcgggaaaaaaaaaaaaaaaaaagcttatcgatacccgtcgaccctcgaggggggggcccggtac

SEQ ID NO: 47525 - protein, 162 aa, Zea mays
  misc_feature: Ceres CLONE 1455041-F
KAGAPRGGGRSRTSGSPGLQEFARDHYLEHPNRKFRLRLSGSPSFPASTSLQASELLRFQLASPPEVEQTRLLRPKLYHFPVSLSRNCLAGDPNKPLCWGSPGFLALEGGFVLAGHGLAEKQQRQHLDAKSLSFMKIATHLRRSCFLHSFSVVFLYWFYVIS

SEQ ID NO: 47526 - DNA, 708 bp, Zea mays
  misc_feature: Ceres CLONE 1455046-F
  misc_feature: Encodes the peptide sequence at SEQ ID NO. 47527
  misc_feature (443)..(443): n is a, c, t, g, unknown, or other
  misc_feature (447)..(447): n is a, c, t, g, unknown, or other
  misc_feature (507)..(507): n is a, c, t, g, unknown, or other
caaagctggagctccccgcggtggcggccgctctagaactagtggatcccccgggctgcaggaattcgcacgagaccattacctagaacatcctaatcgaaaaacaacgatctcctatgcacaaacatccacaaaaacaaaagaagggaaaaaccacaagctagccatggttagcagcaagattagtattatcggagccatcacatctccaattgtggttatagtggcactgacactattgatcacacttttggcaccgacagtagatgcacaaccatactcaacaatgccacctagcatgatcggagatttattgccacggacgagagtacctccgtctgggcctagccatcctccacccatggcggcgatgccaccatcatggagaatgccatctgctggacctatgaagcctccttcccatggcgcgatgtcacctgatngtgntggggatttgctaccagaggaagagtaccaccctcggggctagccatccacaaccctggntgcaatgtcacctgatgtgttggggatttgctaccacaaggactacccatcgccaccaaggtgccatgcccctgaagtgtttgggaattgcatcccgaggactaccctcccccccaaggaagcgattcccctgagtttttgggaatttccaccaaaggaacaccctccccccaggggggggaacccccaaattttggggat

SEQ ID NO: 47527 - protein, 107 aa, Zea mays
  misc_feature: Ceres CLONE 1455046-F
  misc_feature (93)..(93): Xaa is any aa, unknown, or other
  misc_feature (94)..(94): Xaa is any aa, unknown, or other
MVSSKISIIGAITSPIVVIVALTLLITLLAPTVDAQPYSTMPPSMIGDLLPRTRVPPSGPSHPPPMAAMPPSWRMPSAGPMKPPSHGAMSPDXXGDLLPEEEYHPRG

SEQ ID NO: 47528 - DNA, 737 bp, Zea mays
  misc_feature: Ceres CLONE 1455053-F
  misc_feature: Encodes the peptide sequence at SEQ ID NO. 47529
  misc_feature (362)..(362): n is a, c, t, g, unknown, or other
  misc_feature (424)..(424): n is a, c, t, g, unknown, or other
aaagctggagctccccgcggtggcggccgctctagaactagtggatcccccgggctgcaggaattcgcacgagaccattacctagaacatcctaatctaaaaattatatacatccatcggcatagcacgtgcgaggatgcgacagcgagcagcggtgtcgatttttagggcattgtgatttgttgagaaattcgtagggtatacgaaaacctctccgccgaactcctgcagatcctaattaacctccaccagctgcaccaattgccgctggcgatggatggtagcggacgagctctcgattgccgcagcttctggaaggccggcgcgtacgaagcccccactgctccgaccagggagttccnagatgtccttgagacgggagacttcgaccgcgcgcgcgtgcaccccaagtccctccacaccnacgccacctcccacaagtgggctttcggaggtccgggatgcccttcggagggtccactcctatggggggtaccctattaagggcaccctttgcggcaaaaaaaaaaaagaaaatccctttaaactgggggggtccccccaccccaaaattgtttttcctgggccttaagggcccaaaaccggggcccccgggggctttttccaaatttttttttggcccaaacccccaaaaaaaaattttttggtttttttccaaagggtcccccccccaaaaaaaaaaaggggaaaccctctttccaaaaaaaaaaaaagat

SEQ ID NO: 47529 - protein, 76 aa, Zea mays
  misc_feature: Ceres CLONE 1455053-F
  misc_feature (30)..(30): Xaa is any aa, unknown, or other
  misc_feature (51)..(51): Xaa is any aa, unknown, or other
MDGSGRALDCRSFWKAGAYEAPTAPTREFXDVLETGDFDRARVHPKSLHTXATSHKWAFGGPGCPSEGPLLWGVPY

SEQ ID NO: 47530 - DNA, 738 bp, Zea mays
  misc_feature: Ceres CLONE 1455055-F
  misc_feature: Encodes the peptide sequence at SEQ ID NO. 47531
  misc_feature (1)..(1): n is a, c, t, g, unknown, or other
  misc_feature (413)..(413): n is a, c, t, g, unknown, or other
  misc_feature (414)..(414): n is a, c, t, g, unknown, or other
  misc_feature (418)..(418): n is a, c, t, g, unknown, or other
  misc_feature (466)..(466): n is a, c, t, g, unknown, or other
  misc_feature (474)..(474): n is a, c, t, g, unknown, or other
  misc_feature (487)..(487): n is a, c, t, g, unknown, or other
  misc_feature (516)..(516): n is a, c, t, g, unknown, or other
  misc_feature (542)..(542): n is a, c, t, g, unknown, or other
nagagctggagctccccgcggtggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgtcctactacgccgggtgtgggcagccgagcgccatgttccagcccgctccgnnacantgcttgcagcagcaaatgaagatgatggacgtgcattccgtcccgcancaactgcnaatgatgatgcanctggagcgtggccgttgcccccacaaaanccttgacaaaccattttttaatgcancaaaagcaaaagcggctgggaccccagggttcaaacccctgggcattaaaaaaggccaaaaaaaccccggccgggggggggaatttacaaaaaaaatttgcccgttttccgcacccaccccttgggggggctccccggggtttttccccccaatatttggttttcaggaattttgggaaaccccttcccttttccc

SEQ ID NO: 47531 - protein, 192 aa, Zea mays
  misc_feature: Ceres CLONE 1455055-F
  misc_feature (85)..(85): Xaa is any aa, unknown, or other
  misc_feature (86)..(86): Xaa is any aa, unknown, or other
  misc_feature (102)..(102): Xaa is any aa, unknown, or other
  misc_feature (105)..(105): Xaa is any aa, unknown, or other
  misc_feature (109)..(109): Xaa is any aa, unknown, or other
  misc_feature (119)..(119): Xaa is any aa, unknown, or other
  misc_feature (128)..(128): Xaa is any aa, unknown, or other
MKMVIVLVVCLALSAASASAMQMPCPCAGLQGLYGAGAGLTTMMGAGGLYPYAEYLRQPQCSPLAAASYYAGCGQPSAMFQPAPXXCLQQQMKMMDVHSVPXQLXMMMXLERGRCPHKXLDKPFFNAXKAKAAGTPGFKPLGIKKGQKNPGRGGEFTKKICPFSAPTPWGGSPGFFPPIFGFQEFWETPSLF

SEQ ID NO: 47532 - DNA, 704 bp, Zea mays
  misc_feature: Ceres CLONE 1455075-F
  misc_feature: Encodes the peptide sequence at SEQ ID NO. 47533
ctccccgcggtggcggccgctctagaactagtggatcccccgggctgcaggaattcgcacgagaccattacctagaacatcctaatcgaaaagtgttatccagtccagtatcctcgacggtcgacgccggcgcgagcagcaaatggccaccgcggcggcgacgatgaccatggcgacgcaccacccccgcgcccgcgcacccctccgcgtctgcgccgcctgggacatgaacccgggagccgccaccgtggccacgcccaagccctccaaggccaaggccaagccgccgcccgcgaccacaaccccggcccgcccgcctcctctgacccacgccgatctcttcgcgcgctccagcgaggcgcaaggaggggtgaagagagcacatatatgggctttgagaaacgccgttgccacctgcgccagtgtgaagaaaccccgatcgctctacagggcggtgtcacggccttacttgggagactgcatatataaacttatgctcggaggcccttcttctttcccccttcgagcatcaatgagtcacaccaacgtgtgatgaattttggaaaggggaatccaaggaccttttggtgaaaaatcttttgggaaaaaaatttcaaccgaaaaaaaaagggacttctttcgtggggggggaaaattgtttacacaaaaactccccccacaaaacgggggagaatttcgtctcc

SEQ ID NO: 47533 - protein, 136 aa, Zea mays
  misc_feature: Ceres CLONE 1455075-F
MATAAATMTMATHHPRARAPLRVCAAWDMNPGAATVATPKPSKAKAKPPPATTTPARPPPLTHADLFARSSEAQGGVKRAHIWALRNAVATCASVKKPRSLYRAVSRPYLGDCIYKLMLGGPSSFPLRASMSHTNV

SEQ ID NO: 47534 - DNA, 695 bp, Zea mays
  misc_feature: Ceres CLONE 1455077-F
  misc_feature: Encodes the peptide sequence at SEQ ID NO. 47535
aagctggagctccccgcggtggcggccgctctagaactagtggatcccccgggctgcaggaattcgcacgagaccattacctagaacatcctaatcgaaaaaagctgcccccgtccgtggaataaaatgtcgtacctgctgccgcatctgcactcggggtgggcggtggaccatgccatcctcgccgaggaggagcgcctcgtcatcatccggttcggccatgactgggacgagacctgcatgccaatggatgaagtggtggtagccgtacctgagaccatgaagaactttgcggtcatctaccttgttgacatcacacaggtccctgatttcaacaccatgtatgaactgtactacccttcgacagtgatgttcttcttccggaacaagcacatcctgattgatctcgggactggaaacaacaccaagatcaactgggccctgaaggacaagcaatagttcatcgacattgtggagaccgtatactggggcgcccggaaaggccgtggtctggtgattgctcttaaggactactccgcccagtaccgttactaagaagggaggcattccccttatgcaatctattggggatgtttacacggacagttagtccgacgggtgatccctaactgtatcttggcataccctagaaattcacgttgctggctggagtgatgcttatccatgtcttggca

SEQ ID NO: 47535 - protein, 110 aa, Zea mays
  misc_feature: Ceres CLONE 1455077-F
  misc_feature (4)..(111): Pfam Name: DIM1 Pfam Description: Mitosis protein DIM1
MSYLLPHLHSGWAVDHAILAEEERLVIIRFGHDWDETCMPMDEVVVAVPETMKNFAVIYLVDITQVPDFNTMYELYYPSTVMFFFRNKHILIDLGTGNNTKINWALKDKQ

SEQ ID NO: 47536 - DNA, 731 bp, Zea mays
  misc_feature: Ceres CLONE 1455078-F
  misc_feature: Encodes the peptide sequence at SEQ ID NO. 47537
  misc_feature (373)..(373): n is a, c, t, g, unknown, or other
aagctggagctccccgcggtggcggccgctctagaactagtggatcccccgggctgcaggaattcgcacgagaccattacctagaacatcctaatcgaaaaatcgccatggatttctcttaggctcacccgtccgctcggctcgcttccttccccactctctctgatcccgtcgcacttccctcctcgctgcagcccctctattattgcgattaccgtttcctcactgccctttcctttttcggtcggcagcaatcaccggggcaagcgaaccctcgatttgcgtccccgctctctgctagcgcccctaaaagaggagcgaagcgatgtctatgccggagacgggtcaggccgcggagagggatgagcagcancagtcccgagggatagcactgatgcagggcatctgcgccgtggtgtaccgcagggccgataacacgccctgccccatcaagcagggtctctacttgggatctggtggagcagcattcaatagggacgcctcacggagcttgacctcacccatatcttgaccgtggcaaagcccctggatcccggattcccggctggattttattttcaaaaaaatccgaagttcttggaatccccaaaccagggattcggaaaaagctttcggaagaaagggcttgggtttcccaaagaaaaaccttaaaattttcggaggggaagggtttgggcccattggtttttgcgggggcgccccaggggggg

SEQ ID NO: 47537 - protein, 68 aa, Zea mays
  misc_feature: Ceres CLONE 1455078-F
  misc_feature (16)..(16): Xaa is any aa, unknown, or other
MSMPETGQAAERDEQXQSRGIALMQGICAVVYRRADNTPCPIKQGLYLGSGGAAFNRDASRSLTSPIS

SEQ ID NO: 47538 - DNA, 736 bp, Zea mays
  misc_feature: Ceres CLONE 1455079-F
  misc_feature: SWISSPROT Homolog: EC 1.11.1.6 Catalase
  misc_feature (273)..(273): n is a, c, t, g, unknown, or other
  misc_feature (309)..(309): n is a, c, t, g, unknown, or other
  misc_feature (311)..(311): n is a, c, t, g, unknown, or other
  misc_feature (323)..(323): n is a, c, t, g, unknown, or other
  misc_feature (384)..(384): n is a, c, t, g, unknown, or other
aaagctggagctccccgcggtggcggccgctctagaactagtggatcccccgggctgcaggaattcgcacgagaccattacctagaacatcctaatcgaaaagttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgntagatcgacgaggaagaaagcaggcaccggtggccnangatgcaacgcancatggagcgtgtgatgtttaccccaatataattgataaacaggggagtgccgcgtccttgnacttatgctgatgctgaaggccgggggcccattaataaacgggaactctgggggaagcccttccttccgggggaacttaatgaacaaaaaaaaatggccttttgggcccggggaaaaaccccggtggggatggggccgtgctaaaaaaaccccgaaagccgggggcttttttttcgaaatttttttttcgaggcgccctctttttttttaaaaaaaaaaaaaaaattttttttttcccccccccccggggggggggcgcgcgcccccttcccccccaaaagaggataaaaaacccgcgcccgcggggggcttttttttcaacggggggggagaaaaaccccgttttcccctt

SEQ ID NO: 47539 - DNA, 711 bp, Zea mays
  misc_feature: Ceres CLONE 1455080-F
  misc_feature: Encodes the peptide sequence at SEQ ID NO. 47540
  misc_feature (389)..(389): n is a, c, t, g, unknown, or other
  misc_feature (390)..(390): n is a, c, t, g, unknown, or other
ctccccgcggtggcggccgctctagaactagtggatcccccgggctgcaggaattcgcacgagaccattacctagaacatcctaatcgaaaaattcattcatcactcaccagtcaccaccactgccgcgaccgagagagtcagagagagcaggcggcggcaatggctggcgctggggacgagtactactacggcgggccgggccagcgcggcgcgccccacggcctgctgctggcggtggtggtgggcctcgtggtggcgggcccgctgttcctgggcggcggcggcgaggcgctgacggaagccgtggcggagctgctgagcccggtggggctcctcctccctcccgtgtgcctgctggtcctcatccgcctcctctcgtccgaacgnngggccgggggctcgccgacccttcgctttggggggtcccccaggccctccccgggggggaggtcccggtcggggtccggttttggcttccctatcctgggtggctaaaaagatcccccttttggggggaagggggaaaaaaaaaaaaaaagaaacgcgggggggcaatcccggggccgggggggggtgttttaaaaagaggtctcgagggggctttttaaaattgggggtaaaacccgggggggggaatcttgtttttttggggggggtggaccaaaacctctgggggtgtgcccccccctaaggggggctcgtggccccc

SEQ ID NO: 47540 - protein, 111 aa, Zea mays
  misc_feature: Ceres CLONE 1455080-F
  misc_feature (77)..(77): Xaa is any aa, unknown, or other
MAGAGDEYYYGGPGQRGAPHGLLLAVVVGLVVAGPLFLGGGGEALTEAVAELLSPVGLLLPPVCLLVLIRLLSSERXAGGSPTLRFGGSPRPSPGGRSRSGSGFGFPILGG

SEQ ID NO: 47541 - DNA, 689 bp, Zea mays
  misc_feature: Ceres CLONE 1455084-F
  misc_feature (284)..(284): n is a, c, t, g, unknown, or other
  misc_feature (393)..(393): n is a, c, t, g, unknown, or other
caaagctggagctccccgcggtggcggccgctctagaactagtggatcccccgggctgcaggaattcgcacgagaccattacctagaacatcctaatcgaaaacgaaaaactactctctctctctgcctgcaaagctgcttgatccatcatcgatcacatcactccaccagccgcagcgcacgaacgtacgactcatggcaaactcgaccgcagcggcatctacggcggcggcgcctacgggcagcagcaggggggcggccgcccgatgggtgacaggtgaagncatgatccacgacaggggccgaggcgtccaggcgctacggtggcaagctgttcctctgggcggctgctcctgtatcgatacgtcgacctcgagggggggcccgtacccnaattcgccctatagtgagtcgtaatacgcgcgctcactggccgtcgttttacaccgtcgtgaccgggaaaaaccttggcggtaacccaatttaatccctttggaaacaaatcccccttttccccagttgggcaaaaaaacaaaaaggcccgaccgaattccccttttccaaaatttgcccaacccggagggggaaaggaaaattttaaccctttaaaattttttaaaaaattccggtaaaattttttggaaaaccccctctttttttttaaccaaagggccaaaagggggaaaaac

SEQ ID NO: 47542 - DNA, 742 bp, Zea mays
  misc_feature: Ceres CLONE 1455086-F
  misc_feature: Encodes the peptide sequence at SEQ ID NO. 47543
aaagctggagctccccgcggtggcggccgctctagaactagtggatcccccgggctcaggaattcgctcgagaccattacctagaacatcctaatcgaaaaatgttctcctgcctccgctccgccgccgcaacaaccatttccttctctagccgccgcctccgatcccctcccgaggctacagaaccagttcatccaggcgcgaatggcggcggcgaggagcctgcttctgaggcacctccgcttggcggcggccccgtcagcggcgtccgtgaggccgacggcgtcgttgcatgaggccctgtgggggcagcggtggatgtctttcggagatgcaagggctctttcctgaaaagagcgaggtcccggaccgctccatcaggtcgtcaagagctcccgaagatcgatgacccttcaaggggaccccgaaggcctttccaaaaggatttggccaaacattttggaacccggggaggttcccgggccctgaaaaaaaaattaaaatcaaaacctcgaaatggggctaaaaaaattgccccccccaaggggggggtgaacttttggcccccccccccaaaaaaaaaaaaaaaagggggcgccggggaaaaaaaaaaaaaacccccaaaatccctgttaaaaaaaaaatcttttatgaaaaaaacccccccccggcccttttataaaattggggggggagacgcttttttttaaaaaaaaaatttggtggggggggggggcgacaa

SEQ ID NO: 47543 - protein, 48 aa, Zea mays
  misc_feature: Ceres CLONE 1455086-F
MAAARSLLLRHLRLAAAPSAASVRPTASLHEALWGQRWMSFGDARALS

SEQ ID NO: 47544 - DNA, 688 bp, Zea mays
  misc_feature: Ceres CLONE 1455093-F
  misc_feature: Encodes the peptide sequence at SEQ ID NO. 47545
  misc_feature (604)..(604): n is a, c, t, g, unknown, or other
  misc_feature (649)..(649): n is a, c, t, g, unknown, or other
  misc_feature (664)..(664): n is a, c, t, g, unknown, or other
  misc_feature (666)..(666): n is a, c, t, g, unknown, or other
ctccccgcggtggcggccgctctagaactagtggatcccccgggctgcaggaattcgcacgagaccattacctagaacatcctaatcgaaaaattcattccgcacggcatccgggaaggtctgcgtcgtcgccatggccaccgaggaagtcgccaagccgtccccgatcccgccctaccccgagatgatcctggcggcgatcgaggacttaggcgacaagagcgggtcgaacaagtcggccatctccaggtacatcgagggcaagtacgacggcgacctgccgcccgcgcacgcgtcgctgctggccgcgcacctggcgcgcatgaaggagtcgggtgagctggtcttcgtcaagaacaactacttccgcgccgacgcgcccgacgcgccgccgaagcgcgggcgcgggcggcccccgaaggcgcgggaccccggcgcgccggtgtcgccgccatcggggcgcgggcgcgggcgcccgcccaagcccaaggacccgctggacgccgccgtgaagcaggccaccgcgggcatgcccagggcccgcgaccgcccgcccaagaagccaagacgagggcggcgcgtccccggccctcgcggaggaccnctccacccccgtcaagcgcggctgcggccgcccactcaaggtacncctcgtcgtgcctancnagacggccgcgacttgaacgac

SEQ ID NO: 47545 - protein, 185 aa, Zea mays
  misc_feature: Ceres CLONE 1455093-F
  misc_feature (13)..(81): Pfam Name: Linker_histone Pfam Description: linker histone H1 and H5 family
  misc_feature (177)..(177): Xaa is any aa, unknown, or other
  misc_feature (178)..(178): Xaa is any aa, unknown, or other
MATEEVAKPSPIPPYPEMILAAIEDLGDKSGSNKSAISRYIEGKYDGDLPPAHASLLAAHLARMKESGELVFVKNNYFRADAPDAPPKRGRGRPPKARDPGAPVSPPSGRGRGRPPKPKDPLDAAVKQATAGMPRARDRPPKKPRRGRRVPGPRGGPLHPRQARLRPPTQGTPRRAXXDGRDLND

SEQ ID NO: 47546 - DNA, 704 bp, Zea mays
  misc_feature: Ceres CLONE 1455094-F
  misc_feature: Translation starting site: 336
ggagctccccgcggtggcggccgctctagaactagtggatcccccgggctgcaggaattcgcacgagaccattacctagaacatcctaatcgaaaagaatttcgaaggagactgtttcataaacaggagccaggcaccggactttccaggaggataccacctcccgaacatggtgcgtcgacgacccgccaccggggcagccccgagaccccacctcgccgccgtcggtcgcgggctgctcctcgcgtccgtcctcgcggccgcttgcctcctccctcccagtagccgagtcgtcctgcccgcgagacaactcactggtgagagacataagccgaatgcagcagcgcaactacgggagggaaggattctcgcatataactgtcacggggtgctcttgctcacgggacaaaggagggggaagtgtggctacaaacatttggtcccaggtcaaaggaccccaatccacacggatttcttggtgaaaaggttttctttgtcctcaggggggaaaggcacgctccttactcggggtcgagctcccctaaagtacccaggaaacgccgcaggaagttccttgtcctttcagaaataccccatttttccattccctggaaaatgattccacatccggggccgggaatttctaaatgaagccaccaaaattttgcaaggtccttggggaatcatatccgcggccccaccag

SEQ ID NO: 47547 - DNA, 689 bp, Zea mays
  misc_feature: Ceres CLONE 1455095-F
  misc_feature: Encodes the peptide sequence at SEQ ID NO. 47548
  misc_feature (511)..(511): n is a, c, t, g, unknown, or other
  misc_feature (689)..(689): n is a, c, t, g, unknown, or other
ctggagctccccgcggtggcggccgctctagaactagtggatcccccgggctgcaggaattcgcacgagaccattacctagaacatcctaatcgaaaacgaagccgtctccgttcctcctcgacgcgtctcttccacagccgcaacctctatccctcgtctggtatcgtctcccacacccctctgccccaactcagaaaaaccctcgaaaagcggcggcggcgcgacatggcggaggtcgaggctccagctgctgcggttgcggcggcgacccctgaggtggcgacggtgaccgagggcggagccgctacggaggcgaagggtccgcacaagctgcaccgccagtggaccttctggtacgacatccagtccaagcccaaacccggcgctgcgtggggcacctccctcaaaaaggcgtacaccttcgacaccgtcgaggagttttggggcttgtatgatcatgttttccgtccaagcaagttgcctgggactgctgattttcacctattcanggctggagtaaagcaaaaatgggaagacccagagtgtgcaaatggtggcaaatggactgtcccaatgcacaaaaagccaacctttgagaccatgtggcttggaacgttgatggctcttgttggggagcagtttgatgaaacaaatgacatttgtgaaattggtgctagtgtccgcccn

SEQ ID NO: 47548 - protein, 154 aa, Zea mays
  misc_feature: Ceres CLONE 1455095-F
  misc_feature (6)..(154): Pfam Name: IF4E Pfam Description: Eukaryotic initiation factor 4E
  misc_feature (95)..(95): Xaa is any aa, unknown, or other
MAEVEAPAAAVAAATPEVATVTEGGAATEAKGPHKLHRQWTFWYDIQSKPKPGAAWGTSLKKAYTFDTVEEFWGLYDHVFRPSKLPGTADFHLFXAGVKQKWEDPECANGGKWTVPMHKKPTFETMWLGTLMALVGEQFDETNDICEIGASVRP

SEQ ID NO: 47549 - DNA, 688 bp, Zea mays
  misc_feature: Ceres CLONE 1455105-F
  misc_feature: Encodes the peptide sequence at SEQ ID NO. 47550
  misc_feature (372)..(372): n is a, c, t, g, unknown, or other
  misc_feature (469)..(469): n is a, c, t, g, unknown, or other
tggagctccccgcggtggcggccgctctagaactagtggatcccccgggctgcaggaattcgcacgagaccattacctagaacatcctaatcgaaaaatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcttcggtggcgccgtgcctcgggtacgcgatgggcagcgcggcttccccctccgncgcgtgctgcagcggggtgcgctcgctcaacagccgcgcgtcgtcgacggcggacaggcatgccaccctgcactgcctcaagagcatgacgggcccngctcggcggcggcgtcagcatggacaaacgcgccaacatcccctggaagtgcggcgtctccgtcagcgtgccatcagccccaccgtcgactgcaccaagatcatctgatcgatggaccgtagtggatgtagctatgcctctgcatgctcgctggatggcagcgtggccatcaacagcatgcggtcgtcgtcatcgtcctagagatgtcctagctacgtg

SEQ ID NO: 47550 - protein, 126 aa, Zea mays
  misc_feature: Ceres CLONE 1455105-F
  misc_feature (36)..(122): Pfam Name: Tryp_alpha_amyl Pfam Description: Protease inhibitor/seed storage/LTP family
  misc_feature (59)..(59): Xaa is any aa, unknown, or other
MAARSSSQQLVAAAVLAAALLLLAAGAGTASAAVSCGEVTSSVAPCLGYAMGSAASPSXACCSGVRSLNSRASSTADRHATLHCLKSMTGPARRRRQHGQTRQHPLEVRRLRQRAISPTVDCTKII

SEQ ID NO: 47551 - DNA, 681 bp, Zea mays
  misc_feature: Ceres CLONE 1455107-F
  misc_feature: Translation starting site: 252
ctggagctccccgcggtggcggccgctctagaactagtggatcccccgggctgcaggaattcgcacgagaccattacctagaacatcctaatcgaaaagctctgctctgctctcctcgcatatagggtttatcttctcccctcctctgcccccatctcgcttctcgcacacggcagccggattccgaagcgcaccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtaccctggtcgttaaggctgcaactgtcgtcccccaaagtacacttcactgaagcctctgggagatagggtgcttgtgaagcttggtgccgcaaagaaaaagacagttggtgggattttgctttcatctactgcccagactaaccacaaggaggtgaggttgttgctgttggaacagaaggaccatcggggacagaaaatagctgtgaattagagactggacacaagtagtatactcaaagtatgctgggactgaggttgaattcaatgactcaaagcatcttattctacaagaaaacgatatcattgggaatcctg

SEQ ID NO: 47552 - DNA, 697 bp, Zea mays
  misc_feature: Ceres CLONE 1455108-F
  misc_feature: Encodes the peptide sequence at SEQ ID NO. 47553
  misc_feature (649)..(649): n is a, c, t, g, unknown, or other
ggagctccccgcggtggcggccgctctagaactagtggatcccccgggctgcaggaattcgcacgagaccattacctagaacatcctaatcgaaaaattttttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctggggctttcaagatcaatggagtaccgatccgccgtgtgaaacagaacctatgtcattgcctcctcaaccaaaggttgaaatctcctggtggttgatgtcccccaagttttgatgacaagtacttgtgcccggggagaaaaagccagagaggtgaaaaaaaaacngaggggcgaaacttttttaaaacacagaaagggaggccttccagagtc

SEQ ID NO: 47553 - protein, 138 aa, Zea mays
  misc_feature: Ceres CLONE 1455108-F
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGAFKINGVPIRRVKQNLCHCLLNQRLKSPGG

SEQ ID NO: 47554 - DNA, 684 bp, Zea mays
  misc_feature: Ceres CLONE 1455116-F
  misc_feature: Encodes the peptide sequence at SEQ ID NO. 47555
  misc_feature (352)..(352): n is a, c, t, g, unknown, or other
tcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccggcgaggcccccgccccggctcccgggtccgacgccgcggccgccgtacccttcgccggggtttccctgggaggcgccgccttggggtacctcttctnctaaatccgcgctgccacccccccgtggtggtgcgaaaatacgattcgtctgggcatgggcccccttaaatcccccctctcggctcccggtgaagttcctgtcagaaggcgtccacaagctggtttcggggtcttccgcgaatccctgcccaggtggggggaggcctaatcaagtggaccctcctgcaggggtggtaactgtgccttcagccccccaactggttttggggtggaaatatcctgttaaaccaccgcgctccttgttctcgtctgcccgtgccccagagcgtgtcgtaataatgacgaaaaccaatgcgctctaccgctcccgg

SEQ ID NO: 47555 - protein, 56 aa, Zea mays
  misc_feature: Ceres CLONE 1455116-F
MAGLRMKFVAVAAMAAALVASAAAGEAPAPAPGSDAAAAVPFAGVSLGGAALGYLF

SEQ ID NO: 47556 - DNA, 610 bp, Zea mays
  misc_feature: Ceres CLONE 1455123-F
  misc_feature: Encodes the peptide sequence at SEQ ID NO. 47557
tggagctccccgcggtggcggccgctctagaactagtggatcccccgggctgcaggaattcgcacgagaccattacctagaacatcctaatcgaaaactcctaccgtgccgccgccggcctctccaccgttcattctcctatggcatctactcacgcaagcagtcctattcctgattccttgctcggcttgcgtggccatgggatcgatgcatatctgtgtggtttgcccacccgctgttccaaatccgggccaatggcgggttcctcccaaaattaataaaatatccccgaaagaaagttcccccgggggaaagccccccccccccccccggggggaaaaaaaaaatttgggggcccccccccccaaaaaaaatctttgaaaaaagggggggggaaaaaaaaaaaaaaaagtcctttttttttaaaaaaaaaaaaaaataattttttttttaaaaaaaaaagaggggggggggtttttccctcccccccccaaaaaaaaaaaaaaaaaaaaaacaaagagggggggttttttttttatttattttccgcgccaaagaaagagaaccccccccccccccccacccccttttttactgaaaaaaaaaaaaa

SEQ ID NO: 47557 - protein, 60 aa, Zea mays
  misc_feature: Ceres CLONE 1455123-F
MGSMHICVVCPPAVPNPGQWRVPPKINKISPKESSPGGKPPPPPRGEKKNLGAPPPKKNL

SEQ ID NO: 47558 - DNA, 644 bp, Zea mays
  misc_feature: Ceres CLONE 1455140-F
  misc_feature (144)..(144): n is a, c, t, g, unknown, or other
  misc_feature (211)..(211): n is a, c, t, g, unknown, or other
  misc_feature (212)..(212): n is a, c, t, g, unknown, or other
ccccgcggtggcggccgctctagaactagtggatcccccgggctgcaggaattcgcacgagaccattacctagaacatcctaatcgaaaacggccaggcggagcgcgagctggcgttccaggccccgccggcgttgaacgcttncgacatcatctccatgtccccccgggctggacctgtcggggctgtttcgcgagggcaggccccgccnncaagaagcgggtcatgacgacggcgtcccccggaacgggcggtggatcggctccccccagcccggcccaaggctccgttactttatttggggggaaaaaagggcccaaacccctgcccttgggggtccttgccgggccccggggccttttaaaagaaaatatccgaagggccccccgaaattaaatttggggaaaaaaaaacttgaaggggcgccccccaaaaaaaaaaaaaattttgggggggaaaaaccccccggttataatgggggacatgtaaacaccccggcccgggggggaaaaaagtgttaaaatttcccccgaaagaaaaggggagaaattttttcggggggggttccgggggaggggttttcccccccaaaaagggggggcccccccccccccccccccctggtgttggggggtggggggtgg

SEQ ID NO: 47559 - DNA, 729 bp, Zea mays
  misc_feature: Ceres CLONE 1455144-F
  misc_feature: Encodes the peptide sequence at SEQ ID NO. 47560
ggagctccccgcggtggcggccgctctagaactagtggatcccccgggctgcaggaattcgcacgagaccattacctagaacatcctaatcgaaaaggagactggaaatcgggagggagaccggagacgagaccgccggagatggagccgagatctgcaatctacagatccggcgccctccttctcctcgccgccatccttgcggaggtcgtcatccccgcatccgccatcggagacaagtgcgccgcctgcaaggccgttgctgcggagctagagattggaatttcgagtgagaagccgagaaatcacttggacttgcgcaaccgcttaaattctaaaggccagagggaggggaaggtcattgattatagggtcagtgagcttcgggttgtggaacttctgggaccccctatgcaataggatggaagaatattcctttaaagaagttggaatccggccgaaaggggatgggttaaggaaacggaaggggaaaagctttccaaactggaaaaaaagggagcgccaaaaaccttcctcccaaaaaattggccccccttcttgggaaagccttacgggaagaaaacgggggaagagattttccggaggggagaaaaaacaccccccccccaaaccccaatatggaaacccagagccccttttggaaaatattttggcaaacccggggcgaattctaaggtgggcacccccccaaaatgggagagggctctc

SEQ ID NO: 47560 - protein, 92 aa, Zea mays
  misc_feature: Ceres CLONE 1455144-F
MEPRSAIYRSGALLLLAAILAEVVIPASAIGDKCAACKAVAAELEIGISSEKPRNHLDLRNRLNSKGQREGKVIDYRVSELRVVELLGPPMQ

SEQ ID NO: 47561 - DNA, 731 bp, Zea mays
  misc_feature: Ceres CLONE 1455147-F
  misc_feature (1)..(1): n is a, c, t, g, unknown, or other
naaagctggagctccccgcggtggcggccgctctagaactagtggatcccccgggctgcaggaattcgcacgagaccattacctagaacatcctaatcgaaaaccttaggaagttgtcactcaccaaggccaaaagttaccttgaggatgtgatcgcccacaagcaggccatcccgttccgcaggtattgtggtggtgttgggcgcactgctcaggctaagtctcgccactcaaatggtcagggacgctggcctgtcaagtctgctaaattcattctagaccttctcaagaatgcagagagcaatgctgaggtgaaaggacttgatgtggataccctctatgtgtcgcacatttcagttaatcaggctcagaggcagcgacgcaggacatacggtgctcatggacccatcaacccttacatgtcctccccatgccacaaaaacttcatcttgccggaaaagggaaaacccttgaaaaaagaaggcccagtcccaaatcccaaccggaaagggttagaaaaagggccccatcttcggggaaagggctaaaaaaagtttttgggaaaaaaattttgggcccccaaaggtttccccgaaaatttttgggagagggttttttccggtgccaaaaagggggggaaatttccgggggaaaaaaaaatttgcgcgggggatgttatatatttattggggaggggcgccgcggggtttttttttttttattttacaaaa

SEQ ID NO: 47562 - DNA, 739 bp, Zea mays
  misc_feature: Ceres CLONE 1455149-F
  misc_feature: Encodes the peptide sequence at SEQ ID NO. 47563
  misc_feature (408)..(408): n is a, c, t, g, unknown, or other
  misc_feature (409)..(409): n is a, c, t, g, unknown, or other
ccccgcggtggcggccgctctagaactagtggatcccccgggctgcaggaattcgcacgagaccattacctagaacatcctaatcgaaaaagatcgaggcctcgatccaccggccatggcgctggagtgggtggtgctgggctacgcggcgggcgcggaggcggtcatgctgctgctgctgacgctgccggggctcgacggcctgcgccggggcatggtctccgtggtgcggagcgcgctcaagcccatgatgtccgtggtgcccttctgcctcttcctgctcatggacatctactggaagtacgagacgcggcccacctgcgacgacgagcacgcctgcaccccctccgagcatctccgccaccagaagtccgtcatgaagtcgcattgaaacgatctccaccaccnnccgcgggctcgtcctctagtgggatcctctttctcgtcacccacctcgtcttaaggtttcaaccaaatgcatgagcctggtcgaacaactccaaaaaacccaaccactggatgggggtttgggtttgggcccttcccccggggccacccggggggcccggtttctccctcgggccccaaattttcggggtttttttttcccgggggggaggggggggtggcttaaaaccccccgccgttttttgggggggggggggttcctttttgccccttcccgccctacaaaaaaaaaaaaaaaggcccctttttaaaaggagtattttcttggggg

SEQ ID NO: 47563 - protein, 91 aa, Zea mays
  misc_feature: Ceres CLONE 1455149-F
MALEWVVLGYAAGAEAVMLLLLTLPGLDGLRRGMVSVVRSALKPMMSVVPFCLFLLMDIYWKYETRPTCDDEHACTPSEHLRHQKSVMKSH

SEQ ID NO: 47564 - DNA, 698 bp, Zea mays
  misc_feature: Ceres CLONE 1455158-F
  misc_feature: Encodes the peptide sequence at SEQ ID NO. 47565
agctccccgcggtggcggccgctctagaactagtggatcccccgggctgcaggaattcgcacgagaccattacctagaacatcctaatcgaaaactagccgccgccagaccattcgtttctcgcgagccatcgcttcggcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagttggtgttactgtatgatggcaaggaccttttgctgccgaaggttatgttttgaagttcatgctaccttttaaattacggattaccttgtgctatgttcattatttttgcctttggcagcgaaatttggatttctagactgcggctgttttttgaccaaaaaaaaaaaaaaaaaagtttttcttacgcgcaaccttcaggggggggcccgggacccactttcccttaagaggggcgaaaaaaccgccccccccggggggccgcttttttaacccgcgcgg

SEQ ID NO: 47565 - protein, 60 aa, Zea mays; identical to SEQ ID NO: 2158
  misc_feature: Ceres CLONE 1455158-F
  misc_feature (3)..(42): Pfam Name: Ribosomal_L29e Pfam Description: Ribosomal L29e protein family

SEQ ID NO: 47566 - DNA, 721 bp, Zea mays
  misc_feature: Ceres CLONE 1455162-F
  misc_feature: Encodes the peptide sequence at SEQ ID NO. 47567
  misc_feature (400)..(400): n is a, c, t, g, unknown, or other
tccccgcggtggcggccgctctataatagtggatcccccgggctgcaggaattctcccgagaccattacctaaaagatcctaatcaaaaatttatggacccggcttttgacgtcatcaaagcttaaactgagtcgccgacccccctgaatatcaccccgcatgagataaaattaaaccacaacacgttctccgatgacatgatcgagattcgtggtgtgccgcctcaaaagttcacagccgtctgctcgcttcttgacaacctggacggccaaacactttgcacaggttactcaaataactgggggatgagaaaggtatatcaaacgaccctgcggacgaccttcgccatttactgaagactagatgagccctcttgaaaaccaacatggagttgagaanacccacccctaactttaccattaatgaaggatccgtcgcttccactaaatgacctgcacatataattcaaggatgtggacacctgatatggaaaagacatgatactttttgattcaggattggtcacggccctcaatcacgtaatggatatcatatttgaagccctcttttaaggtttctcctcaagtggaccccctttccccccggggtgtcgtgaccgaaaaacctttggggtctgcatcatccgttaaacaaaaccaccccctcttctcgtccccccttcaaaaagggaaaaacgtccttaataaatccggggggggg

SEQ ID NO: 47567 - protein, 52 aa, Zea mays
  misc_feature: Ceres CLONE 1455162-F
MIEIRGVPPQKFTAVCSLLDNLDGQTLCTGYSNNWGMRKVYQTTLRTTFAIY

SEQ ID NO: 47568 - DNA, 696 bp, Zea mays
  misc_feature: Ceres CLONE 1455163-F
  misc_feature: Encodes the peptide sequence at SEQ ID NO. 47569
aagctggagctccccgcggtggcggccgctctagaactagtggatcccccgggctgcaggaattcgcacgagaccattacctagaacatcctaatcgaaaacttcttgtgcgccgccaacgcgccggcgccctccgcccctgcgcctcagcctggtaccgtgcctgtgccgccctgtgcctccggtcctccgccctccgcatctgcctggtaccgtgctagtgccgcctgcgcatccgtcttccgcctgggtctccgccctccgcggctccgccttgcgactttaccctgcacggcccgccgccggccggtcgcccgtctggagccactgacccgagtttccgtccagcactccagggaccagcgcctgttcgtccagagtaccaacagatctcgtcaagaggtctgaaggatgaggaagggactgcatcctcagatgcaatggatttcatatgtgacgcagagtggtaggctgatcaatatcatgatgaccaaggtgaaccatactggcaaagtgtaccacatgagggccaagcggcaaatggctcaaagcctcggccagattgcgaagttcaaacgtcgatatgagcaggaagcagagaaaagcaaagacaagtaggatggtgttggggaaggaggtgtagcctctgtggtcttagtcagttctgttgactgcgaagttttcagctaaggaact

SEQ ID NO: 47569 - protein, 68 aa, Zea mays
  misc_feature: Ceres CLONE 1455163-F
MRKGLHPQMQWISYVTQSGRLINIMMTKVNHTGKVYHMRAKRQMAQSLGQIAKFKRRYEQEAEKSKDK

SEQ ID NO: 47570 - DNA, 685 bp, Zea mays
  misc_feature: Ceres CLONE 1455164-F
  misc_feature: Encodes the peptide sequence at SEQ ID NO. 47571
ggagctccccgcggtggcggccgctctagaactagtggatcccccgggctgcaggaattcgcacgagaccattacctagaacatcctaatcgaaaaccgagtcacccgaccgttttccatcttcactcccaaccgtttcattcccacctaacttactttttccgatttcaactcgattctgcattccaaacaggacaccgaatgcacaatcgatcccacgagccgcagccaccggaggctggcgagggcgccggcggcgagaacctggatcaagtgctcttcaggaacctcgtctagatggtgccgctcgtcgagtcgctcatggaccggagggtcaactcggcctactcgcgacacacttcgctagtctacacgccggcgccgcccaagaatgccagcgaattggaaagactcaaattgccacagagcgtatctcccaaaaaccgtagagaccctgacgatgtatccaacaaaagcacccctgattctaacggcgacaacggcttggttgtgccattgtctcaatcgggtgctgaaaataaacccaaggatgatgttgctgggctgcacgagcatgtcgattacctgcaaaaaaaactgctctagaaggaggaggctctgaggtccgcagagagcctcgtgactgagatgaacgcggcatatgcaaccatcgatgaactccgac

SEQ ID NO: 47571 - protein, 102 aa, Zea mays
  misc_feature: Ceres CLONE 1455164-F
MVPLVESLMDRRVNSAYSRHTSLVYTPAPPKNASELERLKLPQSVSPKNRRDPDDVSNKSTPDSNGDNGLVVPLSQSGAENKPKDDVAGLHEHVDYLQKKLL

SEQ ID NO: 47572 - DNA, 693 bp, Zea mays
  misc_feature: Ceres CLONE 1455166-F
  misc_feature: Encodes the peptide sequence at SEQ ID NO. 47573
acccgcggtggcggccgctctagaactagtggatcccccgggctgcaggaattcgcacgagaccattacctagaacatcctaatcgaaaagtttttccccttcgcgtatcttcgtccgccgcaacccttcagcgtatcgtctctctctcacacggtcacaccctgacctcccccctccccctcccagaaaagacccctcgaaaaacggcggcgctgcgacatgacggaggtcgaggctccagctactgcggtcgaggctccagctgctgcggtcgcgacgacgacccctgaggtggcggcgcccaatgccggagccgctacagaggcgaaaggtccgcacaagcttcaccggcagtggaccttctggtacgacatccagacgaagaccaagtccggggctgcatggggcacctccctcaaaaaggcctacaccttcgacaccgttgaggagttctggagcatgtatgatcagatttttcgtccaagcaagttgtctgggaatgctgattttcatctattcaaggctggattagagccaaaatgcgaagacccagagtgtgcaaatggtggcaaatggactgtcccatgcaacagacaggcaacctttgagaccatgtggcttgagacgttgatggctcttattggggagcagtttgatgaaacacaggacatttgtggaattgttgctagtgt

SEQ ID NO: 47573 - protein, 157 aa, Zea mays
  misc_feature: Ceres CLONE 1455166-F
  misc_feature (13)..(157): Pfam Name: IF4E Pfam Description: Eukaryotic initiation factor 4E
MTEVEAPATAVEAPAAAVATTTPEVAAPNAGAATEAKGPHKLHRQWTFWYDIQTKTKSGAAWGTSLKKAYTFDTVEEFWSMYDQIFRPSKLSGNADFHLFKAGLEPKCEDPECANGGKWTVPCNRQATFETMWLETLMALIGEQFDETQDICGIVAS

SEQ ID NO: 47574 - DNA, 725 bp, Zea mays
  misc_feature: Ceres CLONE 1455167-F
  misc_feature (725)..(725): n is a, c, t, g, unknown, or other
caagctggagctccccgcggtggcggccgctctataactagtggatcccccgggctgcaggaattcgcacgagaccattacctagaacatcctaatcgaaaaaatctctgtgctgatcctgcggaacctaaaggagtcccttctcgcccacatcccatccttatcattgatttcgtgtggttcgaatacgcgcttgatttgacagaggaggaccagggcaaccatgtctcccctttaggaggtgctatgaccaaggatttactcgatgaggacaacacgcctcggctagaaggtatttctgtgcttgcgggcgccgaggatgagatacaacttgattcccagcgtcttgggttgcgagaagggggttaaaagagtctcctaaagaaaatttctacaaggactgaggccccccccgggggaggcaatccttttgcttttaataaacgagtctgacaagggccgatcccttttcctggatttgggttacagggtaaccggaggtggcccttccttccccgaaaaatagtgggctattggtttaaccccaaagattcggaaaaaggttccaattcggttgggggaccaacccccatttgggtatatttgaaagattccccccttggggggaaagggaaacccccctcaaagaaaccacattttgggccccccggggggggcccatcttctttggaaaaaccccccgtttagaaccccggtctcttttn

SEQ ID NO: 47575 - DNA, 697 bp, Zea mays
  misc_feature: Ceres CLONE 1455169-F
  misc_feature: Translation starting site: 134
aagctggagctccccgcggtggcggccgctctagaactagtggatcccccgggctgcaggaattcgcacgagaccattacctagaacatcctaatcgaaaacacgatcgttcccggattaataaaagactatcatgcgcatggcggcggtcagtagattgctcttggcccacctccgcgtggaggtggtccaccctgtatcgggagctgcgaccatccacgcggaagggcggctcctgtcgtcgacgacggaaacaaaggggtcattcctcgacaagggcgagggcaataaccgtgtcctctccgtcatcaggaacttccagagaggatgaaccctcaaaggtgacacctaccgctcattttcagaaggaccttgaacttgatagcttggacattgtgtagatcgtgatggcgtaacagcaagaattttcctttgacattcctgacaacgatgcatagaacattgactccgtcaagacagcggatgatttcattgcttcgcatcgtcaccctaaagaagaggatttctttttttttcgaatataagaatgtgaattgttgttttgcatccagaactttatgcaacgccggactgcttttatctagcgttgcttctgtagataggacctgctttctttacctttctgaatccgcgagtacataacaactgttgtgttcttgtcaactcatcgatacgc

SEQ ID NO: 47576 - DNA, 727 bp, Zea mays
  misc_feature: Ceres CLONE 1455170-F
  misc_feature: Encodes the peptide sequence at SEQ ID NO. 47577
  misc_feature (293)..(293): n is a, c, t, g, unknown, or other
  misc_feature (314)..(314): n is a, c, t, g, unknown, or other
  misc_feature (328)..(328): n is a, c, t, g, unknown, or other
aaagctggagctccccgcggtggcggccgctctagaactagtggatcccccgggctgcaggaattcgcacgagaccattacctagaacatcctaatcgaaaaatcgccatggcgtctcgtctcgttgcggcggcggcctcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcacttttgtctagncagccctctcatgtggggggntattttttatggtntggtacagctttttagtggaaagaaggaagccaagactgaggcggcatcaccacaggcataggtggcggaaaagggagttatacccgtatctggggccctggcaccattgttaaataaaaggaatggtttaggttggggctttcaagtgaaaaaattgggggcacgggaattttgctttccctaggcaaatattggagaagcttcctttacccccccccccgggaaaacttttggggggggggaatttttgttggggaaaaaatggaaaattttattttttttcgggggaggagaaagggaggtttttttctggttgccccaccaattaaaccccttttttggaaaaaaaaaaaaccccccggcctcctttaaaaaaaaaaaaaaaaatctttcttctt

SEQ ID NO: 47577 - protein, 93 aa, Zea mays
  misc_feature: Ceres CLONE 1455170-F
  misc_feature (62)..(62): Xaa is any aa, unknown, or other
  misc_feature (69)..(69): Xaa is any aa, unknown, or other
  misc_feature (74)..(74): Xaa is any aa, unknown, or other
MASRLVAAAASSSSLSSASPLARLISRRGLAGAADGHGSAKVPLWKDPLSPSKWKEEHFCLXSPLMWGXIFYGXVQLFSGKKEAKTEAASPQA

SEQ ID NO: 47578 - DNA, 705 bp, Zea mays
  misc_feature: Ceres CLONE 1455176-F
  misc_feature: Translation starting site: 206
  misc_feature (454)..(454): n is a, c, t, g, unknown, or other
  misc_feature (459)..(459): n is a, c, t, g, unknown, or other
aaagctggagctccccgcggtggcggccgctctagaactagtggatcccccgggctgcaggaattcgcacgagaccattacctagaacatcctaatcgaaaaatgaaacggcggccgaggccgcaagcttctcactggccgctagcaaaccgaacgaacccaaccgaagcgagagctgagcaaggcagaggcggcgtgaccggcgatggagcggctgcagcggatctttggcgcctccggcatggggcagccgccgacggactcgccgctgctcgattcctccgagcaggtctacatctcctccctagcgcttctcaagatgctcaagcacgggaagggctggggtgccccatggagtcatgggcctcatgctcggcgagttcgtcgacgactacaccgtcagggtccgtcgacggtctttcgccatgcccgcaaagcggggactgggtgtcancgtcnaaggccgtcgaccacgtcttccagacaaacatgctttgacttgcttaaaccaaacccggcagggccaaaaaaggggttgaaaggttgggtacccccccacatcccggggcttcggaaggcgggcaatatcgggggcccaaattcaaactccccccaaaaatttttaaacttttgaaccccccaaacccctttttgttttggaaaaacccccccccccaaaagttgtaaagggaaaagggtgttttt

SEQ ID NO: 47579 - DNA, 725 bp, Zea mays
  misc_feature: Ceres CLONE 1455177-F
  misc_feature: Encodes the peptide sequence at SEQ ID NO. 47580
  misc_feature (436)..(436): n is a, c, t, g, unknown, or other
  misc_feature (476)..(476): n is a, c, t, g, unknown, or other
aagctggagctccccgcggtggcggccgctctatacctagtggatcccccgggctgcaggaattcgcacgagaccattacctagaacatcctaatcgaaaatcttttgcagttgcagacttgcaggtaagcaagcagaacagagtggcatggcacatctctcaagtcccaactgactgcctgccatgcccaggtgcatgttgtccagagataagcaggtgatggctgcgccgatggccgcggcggacggcgggctgaggcggctgttcgagaagccgctgccggagaacccgacgctgctggaggcgctctcggcgtggaaccgcaacgtgcaccaccccagcagcaagcccatcgacacggcgtccttcacggagatcttcggcgagctccactttcagagaagcagcagcccgaccgaagcgcccctcctgcgnctgtcgcgtcgcccccgcgaagccgcttccttcttccggnaggtgtcgtgctcgacatcccggcgaagcgaaaaaaacaaggacactcctccctgaacccctgtgagggccaagcaggaacccgtggcccaggtaaaaagaaaccgaattttgccccaaaagggtccctccggttctttgtgtctgactaaggggctcgtctccaaaaacccgggaccttaaaaattttttagggggggaccccaaggcaaaagaaaaaccccccccctccttaaaggaaaaaaaaaaa

SEQ ID NO: 47580 - protein, 115 aa, Zea mays
  misc_feature: Ceres CLONE 1455177-F
  misc_feature (98)..(98): Xaa is any aa, unknown, or other
MPRCMLSRDKQVMAAPMAAADGGLRRLFEKPLPENPTLLEALSAWNRNVHHPSSKPIDTASFTEIFGELHFQRSSSPTEAPLLRLSRRPREAASFFRXVSCSTSRRSEKNKDTPP

SEQ ID NO: 47581 - DNA, 769 bp, Zea mays
  misc_feature: Ceres CLONE 1455179-F
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (357)..(357): n is a, c, t, g, unknown, or other
  misc_feature (437)..(437): n is a, c, t, g, unknown, or other
  misc_feature (442)..(442): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (604)..(604): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (726)..(726): n is a, c, t, g, unknown, or other
  misc_feature (730)..(730): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (749)..(749): n is a, c, t, g, unknown, or other
  misc_feature (750)..(750): n is a, c, t, g, unknown, or other
  misc_feature (769)..(769): n is a, c, t, g, unknown, or other
aagctggagctcaccgcgggggcggnngntttattctaaaaggaggcccgggctgcaggaattcccacgagaccattacctagaacatcctaatcgaaaagattctcggcggtcgttctgtgccctatccgtcgtcggatatcgcaacagcaacgcctcttccctgtcgacctgactcctccctagaatcataaaaccggcggaaagtcttccgtggcggagaaaataggccaaggctttgcctgagataatgctggacccaagggataatgatttcttggcgccaaagttgcataaaaagaaggttgtctaccggccgcatccatcaggccatctgaagggggaaccattaacttntgcggaaagagtttccagtaatggggaagcccccccccttagttttggtttgttgtgggagggttgccccccccaaactngaaangcccccctttctgacaggggggagcccgcgatttcccgggctgaaatctggtcctaactgcgaataccgtgcgcccaggaggaagacctcagctgtggaagaaacaactttgactctggcaacgaccccccccccgaagaaaggggggacgnnnnnnccccnggtgcacacgttaggcttcagnnnnnnnnnnnnnnnnnnnnnncnnnncgcnnnnnnatatagnnnnnnnnnnnnnnnnttttggaggnnnnnnnnnnnnnnnnnnttnnnnnnnnnnnncncccnctccnnnnnnnnnnnncgnnctcccccccccggcccccn

SEQ ID NO: 47582 - DNA, 860 bp, Zea mays
  misc_feature: Ceres CLONE 1455198-F
  misc_feature (18)..(18): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (434)..(434): n is a, c, t, g, unknown, or other
  misc_feature (435)..(435): n is a, c, t, g, unknown, or other
acgaattcgcccgcgctncgcccggccgggcnnnnnnnnccccnnnnnnaaaaactgggactccccgcggtggcggccgctctagactagtggatcccccgggctgcaggaattcgcacgagaccattacctagaacatcctaatcgaaaaatctgaaaaaaacgcatggtaccagcagcgcaaagagccgggtgttggcacagatcaggcggccgccatggcggatcagttcgcggatccggcgaaaacgtgatcatcgaggaggtgaaaaaggggcctgaacccagaaatggtggttctgctcgcgggagcagcttcctgctgctcttcttcgccgggaactacgcggtgtttgtgtacacaataaaaaacctcccccccaataagaagaagccggtctccaaaattatgctgaggagggaaaaaggtaaannaggttggtctccgcttccagggggaggtgaaacacccccccccttggtaacaaatagggcccggttcctgaagcccggccccccttattttaatatgatttgtcccgaagaacagcgaagataaccccctggcttgtgaatccccccggggggccccgaagggtaaatttttcggttcctagaaaaatgccccttttttagtttacctttcacatggggcgtaagaattccgggattttgacaacccctttaggctacccgacacagcgagaagaaattcttttgccgcctaaaacccaaaaaccaacctcctatatgaatgcctttgtaaaagtttgcgtggctacctagacgatgttttcaaaccccaagcgtttggctcaccgctctatataccccttaagatacaacatgtgggccacagc

SEQ ID NO: 47583 - DNA, 686 bp, Zea mays
  misc_feature: Ceres CLONE 1455201-F
  misc_feature: Translation starting site: 202
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcgaaaaacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggaacaccacgacgacgccggccccgcgcacaagcgctcgacggcggccaactcgtaccggctggtgctgctggaactggccgagggacggtggacgccgctgccgcccccgcctgggcaagccagagcctgcctctgttctgcaggtggccgccgcgtgacgnnnngcggggcaggaaagaaaaagctgcttgtggtggtcgggcgctgggaccagagacgtgggcccaacggacgcggtgctcgtctacgacttcctgtcgggcgcgtggcggcccg

SEQ ID NO: 47584 - DNA, 746 bp, Zea mays
  misc_feature: Ceres CLONE 1455207-F
  misc_feature: Encodes the peptide sequence at SEQ ID NO. 47585
agagctggagctccccgcggtggcggccgctctagaactagtggatcccccgggctgcaggaattcgcacgagaccattacctagaacatcctaatcgaaaaatataagaacgccacgtctacgatctccttgccacacccctcacaaaccacaaacacatctcgcggcggcggcggcggcagagacaggcggcggccgccgagcggcgtgggcagcgtcatccatggtgcacgtgaacttctatcgcaactatggtaagactttcaagaagccaaggcggccttatgagaaggagcgccttgatgctgagttgaaattagtgggtgaatatggcctgaggtgcaagcgtgagctgtggcgtgtgcagtatggcctcagccgcatccgaaatgctgcaagggagctgctcaccccccacgagaagaaccccctcgtatctttgaggccgaagcactcctgccccccagaaccgctatggtcttcccggtgagggccaaaacaggcttgactaagggccttgccccccccgttgaaaaattttggcagcgcccccttcagacctttggcttccgagaagggtgggggaaaacccatccccagggccggggggccccccgggcaccccccctttaaaggtgggagggaacttggaaacctcccccccttcgggggagggggtcgcccaaaaaaaaacttttgtttttcttttaacacacccctttggggggggaaaaaccccaaaggg

SEQ ID NO: 47585 - protein, 88 aa, Zea mays
  misc_feature: Ceres CLONE 1455207-F
  misc_feature (7)..(82): Pfam Name: Ribosomal_S4 Pfam Description: Ribosomal protein S4/S9 N-terminal domain
MVHVNFYRNYGKTFKKPRRPYEKERLDAELKLVGEYGLRCKRELWRVQYGLSRIRNAARELLTPHEKNPLVSLRPKHSCPPEPLWSSR

SEQ ID NO: 47586 - DNA, 712 bp, Zea mays
  misc_feature: Ceres CLONE 1455208-F
  misc_feature (315)..(315): n is a, c, t, g, unknown, or other
  misc_feature (334)..(334): n is a, c, t, g, unknown, or other
  misc_feature (369)..(369): n is a, c, t, g, unknown, or other
aagctggagctccccgcggtggcggccgctctagaactagtggatcccccgggctgcaggaattcgcacgagaccattacctagaacatcctaatcgaaaagagcccaaactgcggtagcgaaaacgcgagcgctgcggaacaacgatggcgacgatgtctcttgccgcggcgtcacccctcgcctccattccccgcggcatcgccgctcaggctccttgcgcggcattcctgtccatccgcttaggtggcgcgacggcgacgcggttcgctggactggcggtggcctcgcagccagcggagcgtcccgccgcgncgatggtcgcgatggcaanaaggagcaggagctggaggagatccgggcatgacnacggaacaaatgaaagaggagttgtaaacctcagggggaacttttcctggctccgcttaagccgccgcggcgcccggagttcaaaaaccccagttccccccctgcccaaaagatttccccttttctaccctggaaaaagggccggaaatttccacggggccctaaaaaatttcctcaaactttttaaaaaaagaaacaaaaatttttggtccccccccccctttcgggggggaaaaaaaggaaaaaccccccaaaaggggggggtgaaaactttttttcgggggggggggggggcccccccttatccccccctgggggggggtgttcccccccccctctctcc

SEQ ID NO: 47587 - DNA, 723 bp, Zea mays
  misc_feature: Ceres CLONE 1455210-F
  misc_feature: Encodes the peptide sequence at SEQ ID NO. 47588
  misc_feature (214)..(214): n is a, c, t, g, unknown, or other
  misc_feature (365)..(365): n is a, c, t, g, unknown, or other
  misc_feature (367)..(367): n is a, c, t, g, unknown, or other
tccccgcggtggcggccgctctagaactagtggatcccccgggctgcaggaattcgcacgagaccattacctagaacatcctaatcgaaaaatccgcagtccatacagtgacccccacgaggtcaagaacctgtacgaggagaggaaagaacctggaagagaggagcttgaggagatggcgagcgccgagggcgagaggtgggtgggactggcnacggacttctcgcaggggagccgagaggcgctgcagtgggcggcgaccaacctgctccgcgccggcgaccacctgctgctgctgcacgtcatcagggagcctgactacgagcagagcgaggccatcctctggggatcccacggctccccgntngatccccctctcggagttctctgacccttatatcccaagaaatatgggccaaaaccggacctgaaacccttgggacctcctgaaccttacgctccccaaagggattttgggggttggaaagtcctgggggggaatccccgggaaaaccttgtcagttttcccgacccccctaaaacttttgggtaaaaaaaaggggccttttggaactaaaagggggtcctttagaggctctcctatattttgggaaaaacccccccccgctgtcccctttttaaatccccaccccccggggtgttcttcccccccaaccgccgaaaatttttgtttaaaaaaaaaaaggggggtccctcaaaaca

SEQ ID NO: 47588 - protein, 71 aa, Zea mays
  misc_feature: Ceres CLONE 1455210-F
  misc_feature (64)..(64): Xaa is any aa, unknown, or other
MASAEGERWVGLATDFSQGSREALQWAATNLLRAGDHLLLLHVIREPDYEQSEAILWGSHGSPXDPPLGVL

SEQ ID NO: 47589 - DNA, 717 bp, Zea mays
  misc_feature: Ceres CLONE 1455211-F
  misc_feature: Encodes the peptide sequence at SEQ ID NO. 47590
aaagctggagctccccgcggtggcggccgctctagaactagtggatcccccgggctgcaggaattcgcacgagaccattacctagaacatcctaatcgaaaaataagagcttctgagtctagacactagatacagtaagccttagcaccaacagaggttagtatctcaacaaggatacttcaaatatgtccgcctcacgcagctcctctcccaactccatctcacagtggagccagaaagagaacaagatgtttgaagaggcactcgcatactacggcgagggcacatccaaccggtgggacaaggtgtccagagccatgggaggcatcaagtctgctgaggaggtgcgctgccactatgaagatcttgactatgacgtcaagatgattgaatcaggccacgtgccgtaccccccccccaacacacatggattctggacctgaggtcgaaatgttggaggggctcagggaggcagaaaacaaagctctatgaatctaagagggacctagggtctagaaggaagcaaagaatccagccatgtgttggaaaataaaatgatgaaacagtgtggctatgtataagataggtaatgagcaagtttaatgtttccccgtggttgtaggaatctaaggcacctttcacaaacggcatgatttcattaatccccccgcaactaagtttatggagggagcgaaacttcatggatttaagaaaacc

SEQ ID NO: 47590 - protein, 85 aa, Zea mays
  misc_feature: Ceres CLONE 1455211-F
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
MSASRSSSPNSISQWSQKENKMFEEALAYYGEGTSNRWDKVSRAMGGIKSAEEVRCHYEDLDYDVKMIESGHVPYPPPNTHGFWT

SEQ ID NO: 47591 - DNA, 700 bp, Zea mays
  misc_feature: Ceres CLONE 1455213-F
  misc_feature (309)..(309): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (599)..(599): n is a, c, t, g, unknown, or other
  misc_feature (600)..(600): n is a, c, t, g, unknown, or other
  misc_feature (602)..(602): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (612)..(612): n is a, c, t, g, unknown, or other
  misc_feature (629)..(629): n is a, c, t, g, unknown, or other
aaagctggagctccccgcggtggcggccgctctagaactagtggatcccccgggctgcaggtattcgcacgagaccattacctagaacatcctaatcgaaaagcgtgtctcgtgctccccccaggctcctcttcctcgctttccctccaccccgggcgcaaaccctaaccctaccgtcgctcgccccgcggcgtctgccaatggcgcgccccgtgtgagtgtgcgccagaggaggtaaaccttgaggccgctacccggggaggagagcgagagatgttaaacacggggggaaccggggtgaaggtcttntctgacccggaaccccaatccaacggggcgtgggtaaaaaatttttgggaaggccccccttttgggggttaaattaagagggggggggggggcccccccccacaaacaacaaaagatttttggttgggcgccccccccgggtccaccctccccagagggatttgtcccccaaggggggggcccgtattttttaatgtggggcccccccccggttttttgtgcgccgtcgggggaaaaaaccccccccgggtatttccgcgcgtgtttgctcccctgtccgggggnnnttnncncnnnngtagnaaaaaaatcaattttanagggggcccgttgtctgtttgggggcggtaaaaagaaagattcccccatcagtggatgtgcgcggcgtttt

SEQ ID NO: 47592 - DNA, 736 bp, Zea mays
  misc_feature: Ceres CLONE 1455218-F
  misc_feature: Encodes the peptide sequence at SEQ ID NO. 47593
agagctggagctccccgcggtggcggccgctctagaactagtggatcccccgggctgcaggaattcgcacgagaccattacctagaacatcctaatcgaaaaaggcaggcagcgagtgcaaccgcgagagcgatcagcgatgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagcgggccttcaaggagctggcctcccgcttcaccgatgccatcttcgtcaggttgacgtcaacgagctcgcggaggtcccaggacacccaccgcagaggcgatgcccacgttcgtgctggccaaggatggaaggagggtagccgttgtaatgggggttaaaaaggccaattttgaaaggaaaaacaggatgtttcgtccgggtctcttccccgcgcctaacttgagaggggaatcccccccacccttcttacggggttccccaaccccgggggttccccggggacggggtttctaaaaagggccccccttccctggtccgggaaaatccaaaaaaagattttttggaaaatgtggggggggcggggcgggggccaaaaagatttccaaaaatttgtttttttggttccccccccc

SEQ ID NO: 47593 - protein, 113 aa, Zea mays
  misc_feature: Ceres CLONE 1455218-F
  misc_feature (22)..(97): Pfam Name: Thioredoxin Pfam Description: Thioredoxin
  misc_feature (41)..(85): SWISSPROT Homolog: EC 3.5.1.52 Peptide-N(4)-(N-acetyl-beta-glucosaminyl)asparagine amidase
  misc_feature (16)..(69): SWISSPROT Homolog: EC 1.8.1.9 Thioredoxin-disulfide reductase
MGSFFSTLVTPPPAADDPNCAVVAAHSKATYDEQWAAHKSSSKLMVIDFSASWCGPCRFIERAFKELASRFTDAIFVRLTSTSSRRSQDTHRRGDAHVRAGQGWKEGSRCNGG

SEQ ID NO: 47594 - DNA, 751 bp, Zea mays
  misc_feature: Ceres CLONE 1455220-F
  misc_feature: Encodes the peptide sequence at SEQ ID NO. 47595
caaagctggagctccccgcggtggcggccgctctagaactagtggatcccccgggctgcaggaattcgcacgagaccattacctagaacatcctaatcgaaaacattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgctggtgccctgttttctggagtgcagattgccatctctgcttccaacaccggtggtgcatgggacaatgctaaaaagtacattgaggctggtgccagtgagtatgccaggaccctcggccccaagggatctgactgccacccccccccccgggaaaggtaaccacatttggtgacccccctgaaggaaacctcggggcccgtccctcaacattcttaatcaagtctcatggcgggggaagcccctttgtttttggccccttctttccccccccagggggggcctgtttgtccaagtcccttgaagggccccccccaacccttccctgcgaaaaatttcccacccaacccccaccgggaacatcctcaaaaaattctttgccaaatccccccgttcttgggggttgtgggcctaaacccccccaaggtggcattgtttgtttttttgggggccaatctggtcacgatatctccccccgtggg

SEQ ID NO: 47595 - protein, 104 aa, Zea mays
  misc_feature: Ceres CLONE 1455220-F
  misc_feature: SWISSPROT Homolog: EC 3.6.1.1 Inorganic diphosphatase
MEGTAKPDYATCVKISTDASIKEMIPPGALVMLTPLIVGTLFGVETLSGVLAGALFSGVQIAISASNTGGAWDNAKKYIEAGASEYARTLGPKGSDCHPPPRER

SEQ ID NO: 47596 - DNA, 716 bp, Zea mays
  misc_feature: Ceres CLONE 1455229-F
  misc_feature: Encodes the peptide sequence at SEQ ID NO. 47597
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaagcgtttcaacagtaatcagagtaatctctctgtgcctgcgacgacgactaggtgggttaccgccgtcgcgccgccgccgccgccgccgtcatactacaggtgcgaggccttcatcggtatcttaacaggcgacgaacaccaaccagtctgcactctacgatggcggcgcctccggccacggctcccgcggcctcccggtgtctctccggtgccaagtcgtgctgggctgctgagcggagctccagctcgtttgccgtctcggcgccttggactggcctccggcaaagtangagccgcgttcctcggcgccccccgccagcgttgccactgggcctgcaaagaccccgcacttgtggatgatggacccgaaaaggcgcgggaagctcagtgatgctcgtcctggccctgaaagatgggtcacggtggaagggccaattcttttggcgcaccaggacaacaagccgggtgaaatttgttttccacccatcccctggacggcttacagggaaattttggacggatccccgtctatgctgggccaatttgctctggatgaaccaatcccccatattggggacccctgggtgttcaatacctggacaaaccaaaaaac

SEQ ID NO: 47597 - protein, 66 aa, Zea mays
  misc_feature: Ceres CLONE 1455229-F
  misc_feature (44)..(44): Xaa is any aa, unknown, or other
MAAPPATAPAASRCLSGAKSCWAAERSSSSFAVSAPWTGLRQSXSRVPRRPPPALPLGLQRPRTCG

SEQ ID NO: 47598 - DNA, 694 bp, Zea mays
  misc_feature: Ceres CLONE 1455233-F
  misc_feature: Encodes the peptide sequence at SEQ ID NO. 47599
  misc_feature (455)..(455): n is a, c, t, g, unknown, or other
  misc_feature (586)..(586): n is a, c, t, g, unknown, or other
ctggagctccccgcggtggcggccgctctagaactagtggatcccccgggctgcaggaattcgcacgagaccattacctagaacatcctaatcgaaaaattagtgacatttccctttcttcactggttcccccggcatactctcactcactctctccctcgttccctcctcgtcgttctcccgtgtccgccgtgcactgtctgtctctggtggcggcgactgggcggcctccgccgttgccctacgccaggatcccaggctgcatcttccgaggagggcatcgccgcaggttgagtgggaggcggagatgagccgggggcggtcgccggagccgctggatttcttcatctggactgtgcaggatgtagggttatggttggaagaataaatcttgaaagctaccgcccagcttttgaagaaatggtgtcaatggagagtatctagaaagcctgtcngtgttcaccactgagcagattctccgctttataagacgatgccatatgaaatggggagattttatcaccctctgtaaagagctgagacgcatcaaagttgcctgctttgaaaggggagcaggagtccgcangccgtggtgggcgccgtcatgcctgtcggtcgtgttcacgccggtggccaggcacaaccggcagtccggggtcgtctccttgagcttgaagctagcaagttaccggct

SEQ ID NO: 47599 - protein, 64 aa, Zea mays
  misc_feature: Ceres CLONE 1455233-F
  misc_feature (29)..(29): Xaa is any aa, unknown, or other
MKWGDFITLCKELRRIKVACFERGAGVRXPWWAPSCLSVVFTPVARHNRQSGVVSLSLKLASYR

SEQ ID NO: 47600 - DNA, 683 bp, Zea mays
  misc_feature: Ceres CLONE 1455238-F
  misc_feature: Encodes the peptide sequence at SEQ ID NO. 47601
aaagctggagctccccgcggtggcggccgctctagaactagtggatcccccgggctgcaggaattcgcacgagaccattacctagaacatcctaatcgaaaaatcgctcctctccccatcctgcacgctcctccgcctgattcccagcgcgtcgcacttcaagagattcgatcgggttcgccggttcgcgcccgccgccatggcgacttcctcaggaccaaaggaggcgccagcgaataaccctgggctccagaccgaggtcgaccccgccaccaaaggctacttcttgcaacaaacgatgttacgtgtgaaggacccaaaagtgagccttgacttctactcacgtgtgatgggcatgtcgttgctgaaaaggttggattttgaagagatgaaattcagtttgtattttctaggttacgaggatgtgaccttagcccctgatgatcatatcaagcggactgaatggacttttaggcaaaaagctactcttgagctcacccacaactggggcacggaaaatgaccctgaattcaaaggttaccataatgggaactcagaccctcgtggttttggtcatataggagtaactgtggatgatgtccacaaggcatgtgaacgctttgaacgtcttggggttgagtttgtgaggaaacctgatgatggaaaatcaaaggcatcgcttc

SEQ ID NO: 47601 - protein, 161 aa, Zea mays
  misc_feature: Ceres CLONE 1455238-F
  misc_feature (29)..(161): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
MATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGTENDPEFKGYHNGNSDPRGFGHIGVTVDDVHKACERFERLGVEFVRKPDDGKSKASL

SEQ ID NO: 47602 - DNA, 700 bp, Zea mays
  misc_feature: Ceres CLONE 1455299-F
  misc_feature: Encodes the peptide sequence at SEQ ID NO. 47603
ggagctccccgcggtggcggccgctctagaactagtggatcccccgggctgcaggaattcgcacgagaccattacctagaacatcctaatcgaaaaacacaaagattcgtaggaaaatcctgcctcaaatcccctacctcacgtttgtgctcccgttccatccccaatcccctccaagaaagcatcgcccccctcgtctcggcgccatgggcagcgacgactcgccaccgcggggcctatacgcagcacacggggaggacctcaagcgagtctacgagcaccgtcgccatcgacatggtgaagtccggaatgacgaatcgtcctcggaaccgactccacgaccgcgcacgcgctcgaacgcctcggggccctcctccgcaccggtgcgcatgacgcagacaccctgcgtgaccacctccctcaagaccgaggcgcacgccgcgcacatcagcatccccatgctcgcgatggcctacgccgccgaggtcatcctctccaaccacagccccgagaatgtcgaccgggacctcaacctcgacgagggtcgcatgggttccctcctccgcgagaagaagatcaagggagccggcgccttcttcgtcctggacggcaagcagacctagctggacacccatctcggatacacgatctccctggccgtcgagatcgtccacttcggtgaagcctacaagctcagact

SEQ ID NO: 47603 - protein, 138 aa, Zea mays
  misc_feature: Ceres CLONE 1455299-F
MGSDDSPPRGLYAAHGEDLKRVYEHRRHRHGEVRNDESSSEPTPRPRTRSNASGPSSAPVRMTQTPCVTTSLKTEAHAAHISIPMLAMAYAAEVILSNHSPENVDRDLNLDEGRMGSLLREKKIKGAGAFFVLDGKQT

SEQ ID NO: 47604 - DNA, 710 bp, Zea mays
  misc_feature: Ceres CLONE 1455303-F
  misc_feature: Encodes the peptide sequence at SEQ ID NO. 47605
aagctggagctccccgcggtggcggccgctctagaactagtggatcccccgggctgcaggaattcacacgagaccattacctagaacatcctaatcgaaaaatctcttctcacttcgccccctgtcattcctaaagctcttataaatttcattttttccactccccgacttcgccgccgccgccaccggtgcctatcaagatgagtcgggaccatagattcgcgtggactcacaggattgacaaggtgaatgtcgcagggcaattgcctgacgcggaggatgccaaagcctggcggcaccccgacgggggattcacttcctttggcactgctgcaactgcatgctaactcctatgaatcctcactggattttaatgacaaatcgaatgccgcacgccaggctcagtaactgctgcgcccccgtccacatcctgtatttcgcaaacctcccacgccaaatgggggactaatcttgttctcgatgatcagaacgcactccacttctggaaagttgattgccacgaatgctccgattaatatgatcagggggctgatgctaatgccgacgggatgtactttccgaatagcaatgacatgcacattatgcctgacatggaatgtctcctcagcatgcttgacatgcccggcatgatatggatgttcggcagctgcgctatgggcgcccgcttacttgacctcgcaagagcattt

SEQ ID NO: 47605 - protein, 48 aa, Zea mays
  misc_feature: Ceres CLONE 1455303-F
MSRDHRFAWTHRIDKVNVAGQLPDAEDAKAWRHPDGGFTSFGTAATAC

SEQ ID NO: 47606 - DNA, 645 bp, Zea mays
  misc_feature: Ceres CLONE 1455336-F
  misc_feature (171)..(171): n is a, c, t, g, unknown, or other
  misc_feature (174)..(174): n is a, c, t, g, unknown, or other
  misc_feature (175)..(175): n is a, c, t, g, unknown, or other
  misc_feature (188)..(188): n is a, c, t, g, unknown, or other
  misc_feature (199)..(199): n is a, c, t, g, unknown, or other
  misc_feature (202)..(202): n is a, c, t, g, unknown, or other
  misc_feature (203)..(203): n is a, c, t, g, unknown, or other
  misc_feature (208)..(208): n is a, c, t, g, unknown, or other
  misc_feature (225)..(225): n is a, c, t, g, unknown, or other
ctggagctccccgcggtggcggccgctctagaactagtggatcccccgggctgcaggaattcgcacgagaccattacctagaacatcctaatcaaaaaattaagcttgtatattcgctcagcctctctctctcttctccttaccagccgcctcgtgccctttgtctctccngtnnctcgacgcgccgnccgcactaggncanngacgncggccccttcccccagnctcgtttcgcttccgggggggatggaaaaacgcgatggtcctcatttgcagaattccttgagcttcaagcaacccgtggtttcttggaaaggccatgccccacatcataccaaggggtgtccaaaatcccggggggtttgttgccatggggaattaaaaccaagggccccctgggaaaacttccccgaaaaatttaaaccccggaaatcccccttcccaaaaggaaattgggggtttttttatattgggggtataaaacccaaaaaaaatgattttcccgaaaaaactccttttggaggggtccctccccggggcctcttaaagaaaactccttggtggggaaacacacccctttttttaaaaaaagaggggttttttttccaccagggggtggttttccccccggggggggtcccaggc

SEQ ID NO: 47607 - DNA, 695 bp, Zea mays
  misc_feature: Ceres CLONE 1455391-F
  misc_feature: Encodes the peptide sequence at SEQ ID NO. 47608
ggagctccccgcggtggcggccgctctagaactagtggatcccccgggctgcaggaattcgcacgagaccattacctagaacatcctaatcgaaaaacttcgctctgtcctcccatgcgccggattaccactgaccacttcacagtcacagtagtacagagcagcagagtggagaagtagactctaggtgagatggcggccgtggtggcggcggtggaggcaggggtggtggcggtggcaagcgggaggggatgcagcagccggctggtgcggggcctctactggcgcctgcgcgcggttctgcggcggctgcggtcggagcgagccaggcgcggcaggaggttcagcttccactacgacgcgctcagctacgcgctcaacttcgacgacggccgcgccgcccccgccccggcccccgccgcggccgacctcgtccttgcccccggcgacaacgacgcgctacggtgaatcggcgtccgacgatccgctgccaagagccagatggggtctctcttccttgctccggacgccgcttgcttttttccactctcctgtggtctcgctttttcgataaataggggttgtgtaatggaaaaaaggagatgggtagggtggtgtcgcctccgcgttctgcgattctttgcattgacgcgcagctagctagctagggggattgcgcgggctcccggtgatca

SEQ ID NO: 47608 - protein, 91 aa, Zea mays
  misc_feature: Ceres CLONE 1455391-F
MAAVVAAVEAGVVAVASGRGCSSRLVRGLYWRLRAVLRRLRSERARRGRRFSFHYDALSYALNFDDGRAAPAPAPAAADLVLAPGDNDALR

SEQ ID NO: 47609 - DNA, 756 bp, Zea mays
  misc_feature: Ceres CLONE 1455393-F
  misc_feature: Encodes the peptide sequence at SEQ ID NO. 47610
  misc_feature (202)..(202): n is a, c, t, g, unknown, or other
  misc_feature (226)..(226): n is a, c, t, g, unknown, or other
  misc_feature (227)..(227): n is a, c, t, g, unknown, or other
  misc_feature (315)..(315): n is a, c, t, g, unknown, or other
  misc_feature (581)..(581): n is a, c, t, g, unknown, or other
  misc_feature (582)..(582): n is a, c, t, g, unknown, or other
aagctggagctccccgcggtggcggccgctctagaactagtggatcccccgggctgcaggaattcgcacgagaccattacctagaacatcctaatcgaaaaattcgaactggactgcgcaacatcagcatttcttactcaaggatctcccttgctgacattgctaagaagctaagactagactctgagaaccctgttgctgnatgcgagagcattgtagccaaggnncatagagatggcgcattgacgccaccatagatcatgcaaatggctggatgggtatcaaagaaaccgttgatgtctactcaacaatganccccaatttgcttcacttcaagaatgctttctggcccaaatgtgccattgaggggggccagggaaaaaaatccccccctatttccaaaggaaaaggaaagccccaaaaaccccaaaaaagcttctaacggaggaaaaaatgggttaacccctggttgaaagaaagaaaacaacttttaaatatcctctttttagacccccctctttatttgggttttgtaaaaccccctgaaaccccccccttatcttcccgggtgggaaaaaaanntggtttttttttccggggtttttttttttaaaccaaaaagtgtggttttctcccccctgttttgaaaaaaaaaaaaaaaaaattttttttctctcctcccggggggggggggcgccccccccccccttaaaaaaaagaaattacccccccccccccgccttatatataaaaaaa

SEQ ID NO: 47610 - protein, 84 aa, Zea mays
  misc_feature: Ceres CLONE 1455393-F
  misc_feature (67)..(67): Xaa is any aa, unknown, or other
  misc_feature (75)..(75): Xaa is any aa, unknown, or other
AGAPRGGGRSRTSGSPGLQEFARDHYLEHPNRKIRTGLRNISISYSRISLADIAKKLRLDSENPVAXCESIVAKXHRDGALTPP

SEQ ID NO: 47611 - DNA, 719 bp, Zea mays
  misc_feature: Ceres CLONE 1455395-F
  misc_feature: Encodes the peptide sequence at SEQ ID NO. 47612
ctggagctccccgcggtggcggccgctctagaactagtggatcccccgggctgcaggaattcgcacgagaccattacctagaacatcctaatcgaaaaatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggctcatcatgaggaaatgtcaggggccccgtcgcgagggtgacatcctcaccctgctcgagtccgagagggaggccaggagctgcgctgaagccctagcgttcctggtgggctcttgaatgggctttggtggcttgaaattgggcaaggtttaaactccgggaccctggttttaaaataaaaacccgggttaaaaaattgcatttttgtttttcttgggtaaaaggccaattggggttaaaaaagggttaccccgcgcttttttccttaaaaaaccccctgttttttaaaaaaaaaaaaaaaaaacttttcttccccccccccccggggggggggcgcccgcccccctccccccataggggggtataaccccccccccccgggccgttttttcccccgggggggggaaacaccggcgccccca

SEQ ID NO: 47612 - protein, 74 aa, Zea mays
  misc_feature: Ceres CLONE 1455395-F
  misc_feature (1)..(65): Pfam Name: Ribosomal_S28e Pfam Description: Ribosomal protein S28e
MDTQVKLAVVVKVMGRTGSRGQVTQVRVKFLDDQNRLIMRKCQGPRREGDILTLLESEREARSCAEALAFLVGS

SEQ ID NO: 47613 - DNA, 653 bp, Zea mays
  misc_feature: Ceres CLONE 1455401-F
  misc_feature: Encodes the peptide sequence at SEQ ID NO. 47614
  misc_feature (507)..(507): n is a, c, t, g, unknown, or other
aagctggagctccaccgcggtggcggccgctctagaactagtggatcccccgggctgcaggaattcgcacgagaccattacctagaacatcctaatcgaaaaaccacccccacaccgcgcacacaccaccatctctcctcgcctcgcctccacttcctgggctacgtaccggtctcaatcgcctcgcctcctcctcctcctcctcctcctcctcggctgcaaccctcactcgccagagccgccgccgccgccatgtcggggctctacagccagggcttctcccctgcgcgaaacctctcccctcagattagaagcaacccggatgtcgatagccagtacttggcggagctgctggcggaacaccagaagctggggccgttcatgcaggtgctgcccatatgcaacaagctgctgagcaagagaatatgcgggtgtcaagcatttgtcacaaccatggatttggcgatcatgacaagcatcggtttagaaagtcctagtccgatgtcntctccgaacccctaaaagcaaatctccctggcaatgggttccagccttggaacggactaaaaaaaaaaataagttttccctcaacaacctaacatgggacgggaaagggacaccccccagtccctaccccccaagttggggaagaa

SEQ ID NO: 47614 - protein, 89 aa, Zea mays
  misc_feature: Ceres CLONE 1455401-F
MSGLYSQGFSPARNLSPQIRSNPDVDSQYLAELLAEHQKLGPFMQVLPICNKLLSKRICGCQAFVTTMDLAIMTSIGLESPSPMSSPNP

SEQ ID NO: 47615 - DNA, 728 bp, Zea mays
  misc_feature: Ceres CLONE 1455404-F
  misc_feature: Encodes the peptide sequence at SEQ ID NO. 47616
  misc_feature (304)..(304): n is a, c, t, g, unknown, or other
  misc_feature (389)..(389): n is a, c, t, g, unknown, or other
  misc_feature (390)..(390): n is a, c, t, g, unknown, or other
  misc_feature (395)..(395): n is a, c, t, g, unknown, or other
  misc_feature (399)..(399): n is a, c, t, g, unknown, or other
  misc_feature (401)..(401): n is a, c, t, g, unknown, or other
  misc_feature (403)..(403): n is a, c, t, g, unknown, or other
ctccccgcggtggcggccgctctagaactagtggatcccccgggctgcaggaattcgcacgagaccattacctagaacatcctaatcgaaaagcgtatgccttccccctcctccacctttttcccccgttcgagtgctcgagctccgaccaaatctcgcagcggtagcaatccccgagcagccgagcccgaagcgggatcagtggaggacgagtggacaacaccctcgattctgacctgcggtcggcgcgacttacagagaaccggagatgcagcagggcgacagcacggaggcgcaggtgacntgggaggaccatcataacatcaaccgcttcggtcgcctcaaaaaccgtttttttcccccccccccaggggaaaggacgggggaannaaacnaacnananctttgttgatggctgggaacaaaaacatccctgtcgaacgaagatgtcggggggcttcccaaatcggggaggtggtttgttcccctgccccaggggaacaaatcaagaataagttgggaaaaaaaaaaaaaagaagccgcctaaaaacctgggaagggctacaggaggaaaaagaattcctcccccccccccaatgggcggagttgaaaaaaaaaccttttccgggaagtttagtggaccctcccccccccgggggaagaaaaaaaaagataccggggggtgggtggcccctgccccccttctcttttatatgggggcgcgggtg

SEQ ID NO: 47616 - protein, 47 aa, Zea mays
  misc_feature: Ceres CLONE 1455404-F
  misc_feature (41)..(41): Xaa is any aa, unknown, or other
  misc_feature (43)..(43): Xaa is any aa, unknown, or other
  misc_feature (44)..(44): Xaa is any aa, unknown, or other
  misc_feature (45)..(45): Xaa is any aa, unknown, or other
MQQGDSTEAQVTWEDHHNINRFGRLKNRFFPPPPGERTGEXNXXXLC

SEQ ID NO: 47617 - DNA, 685 bp, Zea mays
  misc_feature: Ceres CLONE 1455406-F
  misc_feature: Encodes the peptide sequence at SEQ ID NO. 47618
  misc_feature (421)..(421): n is a, c, t, g, unknown, or other
  misc_feature (430)..(430): n is a, c, t, g, unknown, or other
aagctggagctccccgcggtggcggccgctctataactagtggatcccccgggctgcaggaattcgcacgagaccattacctagaacatcctaatcgaaaactaccagattagattggggatctcatctcatccgaatccttcatagtattacacaaccagcaaggccgcccgcttgccggcaacatgaagaagatcttcggcgccaagaagaacaaggatccgccgcccacaatccaggacgcaaccgacagaatcaccaagcgcggcgacaccgtcgatgaaaagatcaagaagctcgacgccgagctcgcgcgctacaaggagcagatcaagaagacgcgcccaggccccgctcaggaggccgtcaaggcacgagccatgagggtcctcaagcagcgcaggatgtacgaagggcagcngtgacatgnctctacaaccaaacatataaactttgaccaaggtgcttttgcgggagagggactttaagatgctcagcaaactatgactggcaatgaagggttgcccaataaggagctccaaagggattgaagaaaaactggccaagcccccaaaaaatttggaaaaggtttgggcaaaaaagaaaaagaaaggggtccttttttgggggggggggagacccccctaaaaaaaataaaaaaaaaatcttttgggggaaaaaaaaa

SEQ ID NO: 47618 - protein, 78 aa, Zea mays
  misc_feature: Ceres CLONE 1455406-F
MKKIFGAKKNKDPPPTIQDATDRITKRGDTVDEKIKKLDAELARYKEQIKKTRPGPAQEAVKARAMRVLKQRRMYEGQ

SEQ ID NO: 47619 - DNA, 726 bp, Zea mays
  misc_feature: Ceres CLONE 1455419-F
  misc_feature: Encodes the peptide sequence at SEQ ID NO. 47620
  misc_feature (305)..(305): n is a, c, t, g, unknown, or other
  misc_feature (381)..(381): n is a, c, t, g, unknown, or other
  misc_feature (408)..(408): n is a, c, t, g, unknown, or other
  misc_feature (409)..(409): n is a, c, t, g, unknown, or other
  misc_feature (505)..(505): n is a, c, t, g, unknown, or other
aaagctggagctccccgcggtggcggccgctctagaactagtggatcccccgggctgcaggaattcgcacgagaccattacctagaacatcctaatcgaaaacgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtggtcgcanccatccaaggggcacgccgagggcgggttcgaggcggccgccggagctgagaacggcgggtggcagtgcggcggcnactgccagtgcgaccccctgcactgcnngcagtgagctaggtgctccaccctgcaggcccgccggagaagctagctaattatattagctaaataagtatagcggcggtccctgggtgtgtttcnagtcagtcagtcagtttagttgcttgccatggctggcatgctctgaatcttgaatgaatatgatccctgatggcgggcccccgggcccggaaaccctcccctgcccccctgggggctttttgggggaaaaaattgtttttgtttttttttttggggtgcccccgggaaagaggtacccttggcccccgggggtgttgggcccccctccccctttaaaaatt

SEQ ID NO: 47620 - protein, 97 aa, Zea mays
  misc_feature: Ceres CLONE 1455419-F
  misc_feature (1)..(81): Pfam Name: Metallothio_2 Pfam Description: Metallothionein
  misc_feature (47)..(47): Xaa is any aa, unknown, or other
  misc_feature (82)..(82): Xaa is any aa, unknown, or other
MSCCGGNCGCGSGCKCGNGCGGCSKMYPDMAEQVTTTTQALIMGGRXHPRGTPRAGSRRPPELRTAGGSAAATASATPCTAXSELGAPPCRPAGEAS

SEQ ID NO: 47621 - DNA, 530 bp, Zea mays
  misc_feature: Ceres CLONE 1455423-F
  misc_feature (229)..(229): n is a, c, t, g, unknown, or other
  misc_feature (308)..(308): n is a, c, t, g, unknown, or other
  misc_feature (309)..(309): n is a, c, t, g, unknown, or other
ctggagctccccgcggtggcggccgctctagaactagtggatcccccgggctgcaggaattcgcacgagaccattacctagaacatcctaatcgaaaaataaaagatgtgcctgtccactgtgactccagagtccagaccatagcctgcagccttccatccacgaactcccgttctccatttccagccatggcggtgtcgatcgagctcaccaaggagtacggctacgntcgtgcttggtgctggtgggcctatgtccttcctcacctttgggaaggggcttccccgggccgggcaaagggccccccnncaaaaaaaaaaagggttaccccccggtccccttggtggaaaaaaggcccctcctttttgggggggggggggggccccaaacccctagggggggggccgtttttttccaaaaaggggggggggggggggggaaaaaacaaaaaaaaaaccccggggggggggggggggtctatttccccccccggggggggttttttttttttttgaggggggagacccccc

SEQ ID NO: 47622 - DNA, 668 bp, Zea mays
  misc_feature: Ceres CLONE 1455428-F
  misc_feature: Encodes the peptide sequence at SEQ ID NO. 47623
  misc_feature (227)..(227): n is a, c, t, g, unknown, or other
  misc_feature (313)..(313): n is a, c, t, g, unknown, or other
  misc_feature (314)..(314): n is a, c, t, g, unknown, or other
  misc_feature (557)..(557): n is a, c, t, g, unknown, or other
  misc_feature (565)..(565): n is a, c, t, g, unknown, or other
  misc_feature (566)..(566): n is a, c, t, g, unknown, or other
  misc_feature (582)..(582): n is a, c, t, g, unknown, or other
  misc_feature (594)..(594): n is a, c, t, g, unknown, or other
  misc_feature (598)..(598): n is a, c, t, g, unknown, or other
  misc_feature (612)..(612): n is a, c, t, g, unknown, or other
  misc_feature (637)..(637): n is a, c, t, g, unknown, or other
ggagctccccgcggtggcggccgctctagaactagtggatcccccgggctgcaggaattcgcacgagaccattacctagaacatcctaatcgaaaaagaagaagaggatacagcaagcgggggttgcgaggaggcggcgaacgctatgggcaacgccgggagtgcgccggaccagcccaagaactcggcggatggggccggcgctgccgacgcggagtctcgccgcngggccgccgtctacggtgcgtttcttccccgatggggagcgccacaaggcacggcagccgccgcctaataaagctccgaggaaggnnaggagggcgtcccgcctgcctgcccgccacccgaggaaggagatggcccccgcgcaaccctctgggcaggtggtatggcgcctgggggccggtcatttggggtttaaaaatggggcccttggggcctttaaaaagggaaaaggggggaaaacacccccccccggggggtccccacccggggagaaaaaaaaggggggggggggggaatttttttttcccctccctctccccctcccccttgtncctgtcgnngggtcggtgcggaggnacgtaataaaanaagnacaagaaagttagnagggtaattcaagttgatttcaccntgcttccgcggccgtccttcatgcccccacg

SEQ ID NO: 47623 - protein, 49 aa, Zea mays
  misc_feature: Ceres CLONE 1455428-F
  misc_feature (28)..(28): Xaa is any aa, unknown, or other
MGNAGSAPDQPKNSADGAGAADAESRRXAAVYGAFLPRWGAPQGTAAAA

SEQ ID NO: 47624 - DNA, 863 bp, Zea mays
  misc_feature: Ceres CLONE 1455433-F
  misc_feature: Encodes the peptide sequence at SEQ ID NO. 47625
  misc_feature (1)..(1): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nttttccctggggggggggatttctcaccttccgnnnnnnnccgnnnnnntcaagctggggctccaccgcggtggcggccgctctagaactagtggatcccccgggctgcaggaattcgcacgagaccattacctagaacatcctaatcgaaaaactcagctcgcagctagcttttcacgtacgcagttgcagttcagagagaagagaaagagaccgagatctcgccgatagctagcatcatggcgtccaaggcgctcctcgtggtagcgctcctgctcgccgccaccttcctcgccgcctccgctaacgagcaagccaaggcggccaaagaggagaataaggcggaggtccaagactggcacggcggcggcggcggctacccgggcggcggcggcggctggcacggcgggggcggcggctactcgcgctgtcagagggactgctgcaaccccgcggaccaaggcggggggggggtggtggatcggggcctgcgcagatccctgagcccatgtgccgtccgggagctggtcgaggggcccaacgtcagcaagctcgatagcggagcggcggctggtagcgtagagtagaggcacccgaatgcccccatggggaaagaagccgaggagaacacggagcaccgcggggttccccgttccgtcccgcagtaggggggcccaacagaaagggtgggggttcacatccccccggttgtgggacaccaaaacaacgtgaggggagggttgggccccgccctgtggaccaccctctacccattgggaaatgacccacaatttcccgacaggggttcattgcgaggtccccgagcagaacagccacgagcgggggggggccccgccgacca

SEQ ID NO: 47625 - protein, 115 aa, Zea mays
  misc_feature: Ceres CLONE 1455433-F
  misc_feature (1)..(83): Pfam Name: GRP Pfam Description: Glycine rich protein family
MASKALLVVALLLAATFLAASANEQAKAAKEENKAEVQDWHGGGGGYPGGGGGWHGGGGGYSRCQRDCCNPADQGGGGVVDRGLRRSLSPCAVRELVEGPNVSKLDSGAAAGSVE

SEQ ID NO: 47626 - DNA, 780 bp, Zea mays
  misc_feature: Ceres CLONE 1455436-F
  misc_feature: Encodes the peptide sequence at SEQ ID NO. 47627
  misc_feature (429)..(429): n is a, c, t, g, unknown, or other
  misc_feature (432)..(432): n is a, c, t, g, unknown, or other
tggagctccccgcggtggcggccgctctagaactagtggatcccccgggctgcaggaattcgcacgagaccattacctagaacatcctaatcgaaaaaaaatcgatgggcaaaagcggaaagaaaccgagggaatcgcaccggcagggccgcggccggcgggcgtcgcacttctgcgacgaggacggctacgacttaccttcgtcagcctacgatgcgacgccgcgccaaaacgaggaatcctctgaagacaacgacgacaccagcgacgcaacagcggaggacgaaccagagagggatacggaagcaggcgagcaggaccaatggcaaggatcaatgccttccaagtttcacctataccagctctccgtgcagtcgccgaagggggacatcagctacttgcagaagttcttcctgatgtatgtcggcnggncgcgcccctctccacctgccagaagattttctgtggcccggccctcctcagcacccgagtgaatcccgtactgatgccaagaaggacacgatttggcttaaaacttggaacctggagccccttggaaggggggccttggaaacccccccaaccaaaattggggcctggaggggtttcaaaaaagtggctttttcccggaaaaagtttccaaccccaagggaaccccctcttgttcaaaaaaaaattttactaaacctggggggggggccaaatttttaaacaccacccccgggcgcccggaaaaaaacacttttacaaaagaaggggcttttttcccacaaaagaatc

SEQ ID NO: 47627 - protein, 129 aa, Zea mays
  misc_feature: Ceres CLONE 1455436-F
  misc_feature (109)..(109): Xaa is any aa, unknown, or other
  misc_feature (110)..(110): Xaa is any aa, unknown, or other
MGKSGKKPRESHRQGRGRRASHFCDEDGYDLPSSAYDATPRQNEESSEDNDDTSDATAEDEPERDTEAGEQDQWQGSMPSKFHLYQLSVQSPKGDISYLQKFFLMYVGXXRPSPPARRFSVARPSSAPE

SEQ ID NO: 47628 - DNA, 773 bp, Zea mays
  misc_feature: Ceres CLONE 1455443-F
  misc_feature: Encodes the peptide sequence at SEQ ID NO. 47629
  misc_feature (358)..(358): n is a, c, t, g, unknown, or other
gctctagaactagtggatcccccgggctgcaggaattcgcacgagaccattacctagaacatcctaatcgaaaactttgattcctgaaccccacccaggcattccgcagtggctggccgtcgctggctcgccgctacttcggccctttcgccggtgacgataacccaccagttatccgagggaaaattttccatgtgctgattggaatggcgagtacagcatgctttgtaattgtcagtaagaatgatatcccaatctacgaggcagaagttggatctgcacccaaaaaagaggatttggccttatcaccatcggtttatccttgcaggctggctttaaatgttggtttaggaccaancagggaaccaaaaaacacccaattgtcccttgaggcccccccacaagttggagggcccttgggggggggcctggttaattgacctgctggtccatacccaaattcaggtttgcctcaggacccccgccaggtgaaagaggtataaaaaatgtctttttcaaaggggcccacagaaatttcaccccagagaattccgttaaaaccccttttacctcgcccgggggttccatccaccacccctcccttctttagatcccaaaaaagggcgctccccccgggaaaatccctctttattaccccccccctgtttgggggggtgccctatttttttcaataaaaaaacaatctaaaccaccccctccccaaacggtaggggggcgccccccctaccgaaacaacgccgtccgcccggggg

SEQ ID NO: 47629 - protein, 77 aa, Zea mays
  misc_feature: Ceres CLONE 1455443-F
  misc_feature (51)..(51): Xaa is any aa, unknown, or other
MASTACFVIVSKNDIPIYEAEVGSAPKKEDLALSPSVYPCRLALNVGLGPXREPKNTQLSLEAPPQVGGPLGGGLVN

SEQ ID NO: 47630 - DNA, 702 bp, Zea mays
  misc_feature: Ceres CLONE 1455445-F
  misc_feature: Encodes the peptide sequence at SEQ ID NO. 47631
  misc_feature (594)..(594): n is a, c, t, g, unknown, or other
aagctggagctccccgcggtggcggccgctctagaactagtggatcccccgggctgcaggaattcgcacgagaccattacctagaacatcctaatcgaaaaatactatatattagacataccggtattattgttcttagacatcgcacaagactcttgtcaacaagaccaacaacaggatgaggactgccgtgcatgctgcgctttgcattgtgcttgtgataatgtcttcaacactgtcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaacaagatgcagcccttatcgccggcgacgttggcaacaaaagggatactgatggcagacgtgtacttttctggtgaaatatactgctagaattaatatgggcacccacgaatatctataatgttattcctcagtgtaatgcttccagcatgttctgaattagttaactaaaaatctattcttccccccaattnagtttaaaaaaaaaaaaaaaaagctttacgatccgtccacctcaaggggggggcccggaccccattccccctaaaggagtcaattcccccgcctcctggccgtctttt

SEQ ID NO: 47631 - protein, 103 aa, Zea mays
  misc_feature: Ceres CLONE 1455445-F
MRTAVHAALCIVLVIMSSTLSSCEDDEKVSIACDTGCNAAISRLKCFLMAYSEGKVLVSSNCETPTRCGCVFRHNKMQPLSPATLATKGILMADVYFSGEIYC

SEQ ID NO: 47632 - DNA, 765 bp, Zea mays
  misc_feature: Ceres CLONE 1455447-F
  misc_feature: Encodes the peptide sequence at SEQ ID NO. 47633
aagctggagctccccgcggtggcggccgctctagaactagtggatcccccgggctgcaggaattcgcacgagaccattacctagaacatcctaatcgaaaatctcgccccccttcccctccgttgttgtcttgtcaagttgcggttgtctccctcctccggcgctcccttccgcccctcccttcccgccgcctccgcgcagatcgccaggcgaggaaccagaccgcagggcaggatgcagtacaagaacctggggcggtcgggcctccgcgtcagccagctctcgtacggcgcgtgggtcaccttcgggaaccagctggacgtgaaggaggccaaggcgctgctgcagacgtgccgggacgctggcgtcaacttcttcgacaacgccgaggtgtacgccaacgggcgcgccaaggagatcatgggccaggccatcccgggacctgggctggggcccgttccgacttcgtcatctcccaccaagttcttctgggggggccaggggccccaacaacaagggccctctcccgaaagccctttttcaagggcctcccggggtccgtccccccccctcccctggaaaaagttaaaagtttttttttggccacccccccaaaaggtcccaccccttaaaaaaaaaagggcccccccctaaaatggggttcccacacagggtggggcccttcttggggggcccccccaagtggggcccgcgaaaaaaaaaacagaggggggggggggggacacaaaaaatttattcctttgg

SEQ ID NO: 47633 - protein, 139 aa, Zea mays
  misc_feature: Ceres CLONE 1455447-F
  misc_feature: SWISSPROT Homolog: EC 1.1.1.107 Pyridoxal 4-dehydrogenase
MQYKNLGRSGLRVSQLSYGAWVTFGNQLDVKEAKALLQTCRDAGVNFFDNAEVYANGRAKEIMGQAIPGPGLGPVPTSSSPTKFFWGGQGPQQQGPSPESPFSRASRGPSPPLPWKKLKVFFWPPPQKVPPLKKKRAPP

SEQ ID NO: 47634 - DNA, 744 bp, Zea mays
  misc_feature: Ceres CLONE 1455449-F
  misc_feature: Translation starting site: 263
  misc_feature: SWISSPROT Homolog: EC 2.3.1.41 Beta-ketoacyl-acyl-carrier-protein synthase I
aagctggagctccccgcggtggcggccgctctagaactagtggatcccccgggctgcaggaattcgcacgagaccattacctagaacatcctaatcgaaaaatacactgatacacacgggcaacgctccgcctcgcagccagcaggacaccactcatcttcttctcccccgcctcgtttccatcgccaccaccctcttctcctgcggtcctcccccgtcccactcccaccccctcgcctccgcctccactgcagctgccgccatgcagagcctcctcctgcccaccgctgccgtggccccggtggcggctccgtgcggaaggcggaatctcccgggacgcctctccgtccgcgcctccgcgacggcggtagcggcaccgcggcgggagacggatcccaagaagcgggtggtgatcacggggatggggctggtctcccgttttcgggaacgatgtaaacccttactaccaccccctggctagcggggaaagggggttcgggtttattgaacggttttaagcttttaaattccccccccccttttgccggtacaaatccggggtttcccctcccaagggaataatcccaccgaaaaaaaaccacccccccccttaagaattccccccccaaacccacccccccgggggaaaaaaaggtttttaggggtccccggggataccccccgggccccccccccctggaaaaaaaaataaaaaacccccccggcgggttgtttttgggggtg

SEQ ID NO: 47635 - DNA, 742 bp, Zea mays
  misc_feature: Ceres CLONE 1455451-F
  misc_feature: Encodes the peptide sequence at SEQ ID NO. 47636
  misc_feature (417)..(417): n is a, c, t, g, unknown, or other
  misc_feature (450)..(450): n is a, c, t, g, unknown, or other
  misc_feature (463)..(463): n is a, c, t, g, unknown, or other
aagctggagctccccgcggtggcggccgctctagaactagtggatcccccgggctgcaggaattcgcacgagaccattacctagaacatcctaatcgaaaataggcaaacaaaccagccacccctgctctctgctcactcaccttccttactactgctcactagtcactacacaccaaccaaaggaaggcccctcgcacctcttctgtggctgtcgtcgtttgcctttccgtccgttagccaagccatgggcaactgcctcaacacggcctccaagcggagtcaccggggcatgcttttgccggaggaggaagagagcctctcggagataagaaggataagccagctgcttcgggaggaggaggaggacggctacgaggtggtgggtatgcactccgtctccgagcagctggtgcangaggtggtgggccgtgctccgggggtgacggcngcccgcagaaggncctcaagtgaagatcgtgctgacccccggcaagctgaattggctcatggcccaactcaagaccggccaagcaggccctcaaggacttgcttcagaaaatgcaggctgcttagggaactggcggcggcggtggcctctttccctggggaaaaaaaaggccggttgggggccccccccccaaaactcccccaaaatccgaaaacccaaaggtaaaccggcctgaaaagttcccccgggaacggccctttaaataaaaaatttcccccccccggaggtttcc

SEQ ID NO: 47636 - protein, 142 aa, Zea mays
  misc_feature: Ceres CLONE 1455451-F
  misc_feature (57)..(57): Xaa is any aa, unknown, or other
  misc_feature (73)..(73): Xaa is any aa, unknown, or other
MGNCLNTASKRSHRGMLLPEEEESLSEIRRISQLLREEEEDGYEVVGMHSVSEQLVXEVVGRAPGVTAARRRXSSEDRADPRQAELAHGPTQDRPSRPSRTCFRKCRLLRELAAAVASFPGEKKGRLGAPPPKLPQNPKTQR

SEQ ID NO: 47637 - DNA, 866 bp, Zea mays
  misc_feature: Ceres CLONE 1455454-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (29)..(29): n is a, c, t, g, unknown, or other
  misc_feature (34)..(34): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ttttgtttgtgnnnngntgtgtgtgcttntaaantaataannnnncccaagctggagctccccgcggtggcggccgctctagaactagtggatcccccgggctgcaggaattcgcacgagaccattacctagaacatcctaatcgaaaacatcagtagctagctgttcgaagctttcagccgagcaccatcgtcacagtcagtagtagctaagcatatttctttctccgagtgatttgcgctgagcgatcagttcgtccagagcggagcggagctgagctgagctgatcgagcttgcgtcgttgctttgagagaccctgccatggcttcccacccggacaaggctagctaccaggccggcgaaaccaaggcccgccaccgaggacaagaccgggcatgcgcgtggggggcgaccaggaaagggggaaaaaagccaaggacaggccccccaaactcggttgggcccccccgtgggggaagggcccgggatccccatggaggccccctaagcagaagggcgttccaacacccgggcggctaccttggggattaaaaaacaccaactaagggccaagggacatagggccgggtataaaacaaacggaagggccccccaaggctttaaaggcccgggtaaaacaaaatggggggggcaccccaaagtataaaaggcccgggtaaaacatatgtgagggccccccccgggtcaaaaggggcccccccacaccccttggggggcggcccaaatgtaaataggccccccccggggcgcggggagtcacgccaagggaccccccccccgtcctcggaaaaaaaaaaaatctcgcggggggttcttctcatgggggctcgtttgacggtggaaaa

SEQ ID NO: 47638 - DNA, 893 bp, Zea mays
  misc_feature: Ceres CLONE 1455470-F
  misc_feature: Encodes the peptide sequence at SEQ ID NO. 47639
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
ctttttttttttcttggggggcgtccttcctctttntttttnnnnnccaaactggagctccccgcggtggcggccgctctagactagtggatcccccgggctgcaggaattcgcacgagaccattacctagaacatcctaatcgaaaagacgaccaggccctgcggccggacgaggaggccggcgtcggcgcggctgaggccgcgccggcggaagcggacgacggcatcgaggtctgctgcttcgacaaccgcggtgtcggccgcagctccgtgctccccaacaaatcctactactcgacggccatcatggccacggatgccttggccttgatggatcatttggggtggaacaaggctcacttattctgtcactccatgggtgccatgattggttgcaggctagctgcgatggtggctggggggggccattacccagacattgcccccactgttatccgacaggttggcttttttggtggtttctccaatggctagaccaccccaaatggctatcctcctggcgtatccggtttcctcgcatggggcggaacagctccttcgaggaaacctatgcccctcggggggaccttgtgcaaacctcctcttcttccgctcggtaattcccctttgtagcgaaaacctgcccgctgctccgttgtatctataaaatacgtttgatcccttcttgttcccgttattctcttggtaatggcgtcttattcgggaccgcttgggtgaggccctttactccccctggcggatgtgcgcaagggggcaaaaccctaacatttgctcgccccgcacccctaaatttatttggctttatttgcaggcgtgtttccctattcctctctccgctgtttggccggtctcattcccttgtctcccccct

SEQ ID NO: 47639 - protein, 62 aa, Zea mays
  misc_feature: Ceres CLONE 1455470-F
MATDALALMDHLGWNKAHLFCHSMGAMIGCRLAAMVAGGGHYPDIAPTVIRQVGFFGGFSNG

SEQ ID NO: 47640 - DNA, 842 bp, Zea mays
  misc_feature: Ceres CLONE 1455473-F
  misc_feature: Encodes the peptide sequence at SEQ ID NO. 47641
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnggggggcggnnnctttttcttggtccggcgcgggnnnnnnannnnnnncaaactggagctccccgcggtggcggccgctctagactagtggatcccccgggctgcaggaattcgcacgagaccattacctagaacatcctaatcgaaaaacaggctttcgccaactctccggcctcgccatggccatgaccgtgggagccgcctggcttccgtcgaccgcgtgtcgccggagaatcttatcctctccgctccctccgttcggggcccctatctccatccacatgccccggcgggcgccgcctagcaacccgtccatcgaacgccgcgcctcttcctcgccgccgcgcagctcgatttcactagagctattcatactgcattggagggtccgtaacgatgctgtgggggctgtgaattaattttggtgaccctccacttccccgacccacgtgcgggaatagggggcgccccccgggggtggggggaggggctgtttgtcccttgtcgggtgcgaatgcggggcacggggcactacttcgtctccggcccgtggtgggccctcctttttccgtggatctttccggggctatggcccctcgtggtgacggaaggcccggctcggtggctggggattgcacctccattgtgtcttccgctctcccggaaaggtgtcctgcgttgagcgacgcgctcgtgagctctatggcgactgtcatggactgtaaacagacacccggcggaaaaaagggcggctgccgcccctgcatgagggcgccgcatcggggtccggacctgcggggtacctattcgcctggctgcgtggcgggggtccagtcccct

SEQ ID NO: 47641 - protein, 79 aa, Zea mays
  misc_feature: Ceres CLONE 1455473-F
MAMTVGAAWLPSTACRRRILSSPLPPFGAPISIHMPRRAPPSNPSIERRASSSPPRSSISLELFILHWRVRNDAVGAVN

SEQ ID NO: 47642 - DNA, 753 bp, Zea mays
  misc_feature: Ceres CLONE 1455632-F
  misc_feature: Encodes the peptide sequence at SEQ ID NO. 47643
aaactggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgttaaataaagaaaatatctgacaaaaaaaaaaaa

SEQ ID NO: 47643 - protein, 72 aa, Zea mays; identical to SEQ ID NO: 46899
  misc_feature: Ceres CLONE 1455632-F

SEQ ID NO: 47644 - DNA, 742 bp, Zea mays
  misc_feature: Ceres CLONE 1455637-F
  misc_feature: Encodes the peptide sequence at SEQ ID NO. 47645
  misc_feature (239)..(239): n is a, c, t, g, unknown, or other
  misc_feature (240)..(240): n is a, c, t, g, unknown, or other
  misc_feature (248)..(248): n is a, c, t, g, unknown, or other
  misc_feature (250)..(250): n is a, c, t, g, unknown, or other
  misc_feature (251)..(251): n is a, c, t, g, unknown, or other
  misc_feature (262)..(262): n is a, c, t, g, unknown, or other
  misc_feature (263)..(263): n is a, c, t, g, unknown, or other
  misc_feature (321)..(321): n is a, c, t, g, unknown, or other
  misc_feature (502)..(502): n is a, c, t, g, unknown, or other
ggagctccccgcggtggcggccgctctagaactagtggatcccccgggctgcaggaattcgtctcacccctaatcgaaaacaacttatgatgataatgctattacaaatgcggttgagatatttaatacctctagtggcgccgttcacttcatggcatcaaataacgactctggtgtgagatactatgacatggagagattccagctattcaagcattttcagtttgaatggccagtgnnaatcatgncnnttcgttgaagnntcctgaacagaaagtggttgtattgtgggtgatatcctgatggtctacttatgatgcnactctggaagacagtcatccataaaggacatcgggactactcatttggcatcggcttggagcccctgaatgggcgaaacattttgctaacggcgaccagacagacatgcgatctgggacgtgaagaactttcaaaatccgtccatggggttaagggggaaactttgggaagctatccgggnccttccaggtttagctcggaaggccagatcatgcccctgggtaaaaccggctaaattttggcccttttccaactggaaaaaggcgcccccccaaaggcgggagccgggacttcctttggaaaaattccgggaactatttttaaccccaaaattaaacccttttttttttgggggtggggaaaaaaatattttggacacccctcccaaaatttggccccggtgaaaaaacccccttttttt

SEQ ID NO: 47645 - protein, 35 aa, Zea mays
  misc_feature: Ceres CLONE 1455637-F
  misc_feature (30)..(30): Xaa is any aa, unknown, or other
  misc_feature (33)..(33): Xaa is any aa, unknown, or other
  misc_feature (34)..(34): Xaa is any aa, unknown, or other
MASNNDSGVRYYDMERFQLFKHFQFEWPVXIMXXR

SEQ ID NO: 47646 - DNA, 710 bp, Zea mays
  misc_feature: Ceres CLONE 1455642-F
  misc_feature: Encodes the peptide sequence at SEQ ID NO. 47647
  misc_feature (266)..(266): n is a, c, t, g, unknown, or other
aaagctggagctccccgcggtggcggccgctctagaactagtggatcccccgggctgcaggaattcgcacgagaccattacctagaacatcctaatcgaaaagaaaaaaaaacgtgctgtcttcccgtctcttcccaatgcggcgtctcgctctcctcttcctcctgcctctcctcctcgccaccggcgtcaccacggcgtcagcggagcccgcgacccctcccgcctctcctcctcctcctccaccaccaccaccaccaccaccncggcagcgacggcagaagaagaacctccccgagctcatccccaacaacaccatgaccgccgccatcttcatctccaccgacagcatcttctgtcgtcgtcagcgacggcagcctcaacgtcgacctctacgacacctgctactaccactacaagaacatgatgtacttcgagtactacatcaacgacgaccaccactacggcgaccgctcccacctccacggcatcaaggtccgcctcatcctcatcgagatgaacctcccgcagctccaggacgacctcgacacccgcaggagcagcagcaacctcgacatcggggggaatcagcacaagctccccgacgacgactactagaggagcgacgcctgcgacgactccaggagcggcgacgacagctcggaggacgacgtcttcgcctactggatgcaggaggagaaggacgacga

SEQ ID NO: 47647 - protein, 64 aa, Zea mays
  misc_feature: Ceres CLONE 1455642-F
MMYFEYYINDDHHYGDRSHLHGIKVRLILIEMNLPQLQDDLDTRRSSSNLDIGGNQHKLPDDDY

SEQ ID NO: 47648 - DNA, 745 bp, Zea mays
  misc_feature: Ceres CLONE 1455643-F
  misc_feature: Encodes the peptide sequence at SEQ ID NO. 47649
agctccccgcggtggcggccgctctagaactagtggatcccccgggctgcaggaattcgcaagagaccattacctagaacatcctaatcgaaaaatcccccacccggacaatcttccttcaggcttcagctgtccgcccgcggcccacccctccgccgtctccaccattccgccgttcccaccacgccactcgccagttcggcactccctcctgtctcccccccttgccgagacggcgcggacgccccgtcgcccaccccgatggctgccactctcctccacgccgccaccgcctcgctccagagctcctcccagcccgcacgcgcgggcgccgccaccgcctttcaccccctggggtttatcccatccatactgctcgtgcgctcctcgttctcgtccaatccccctctccagggtttcttcccggttggtttagggccgggccctggtttccggggggaggggaatacccccggggcccgcccctttcttccccccctagccagggagacaaaacgaagggttcaaaaggggggcgatggcccagggttaacagaaatcaagggagataaagcccctaaaaagctttagaaaacctgggaaagtaaaagtttgtaccccctcccagggttaaagcccctggcgataacaggcccctgttacaagggaggaattaagaaggctccaccccaaaaaagggaaagagatagttttgtggtgaaagccctttaaaaaaccccacaaa

SEQ ID NO: 47649 - protein, 109 aa, Zea mays
  misc_feature: Ceres CLONE 1455643-F
MAATLLHAATASLQSSSQPARAGAATAFHPLGFIPSILLVRSSFSSNPPLQGFFPVGLGPGPGFRGEGNTPGARPFLPPLARETKRRVQKGGDGPGLTEIKGDKAPKKL

SEQ ID NO: 47650 - DNA, 773 bp, Zea mays
  misc_feature: Ceres CLONE 1455644-F
  misc_feature: Encodes the peptide sequence at SEQ ID NO. 47651
  misc_feature (407)..(407): n is a, c, t, g, unknown, or other
ggagctccccgcggtggcggccgctctagaactagtggatcccccgggctgcaggaattcgtctcacccctaatcgaaaaatcggattcaactcacctaccccaccccctcgattccttcccagctctggctacttcctacgccaccaccgcccgctccggcctcggctcctcgagcaagctgccatggctgccgccgcgctgagggagcaactcaacgctctcctctcctccatgttcgcctcgggtctggtggacgagcagttccagcagctgcagatgctgcaggaagacgggggcacgccgggcttcgtcgccgaggtcgtcaccctcttctgcgacgacgccgacaggatcatctccgagctcgccgctctgcttgaccagcccatcgtggactttgataangtggacgcctacgtgcatcagctcaaagggagcagcgccagaacttgtacggcagaacatttttacttccccatcaagcaagtcaagttgtccacttccctgccaatgtgggccctcaaaaagtgaagtttacttgcatgccatttccctccgtttaggcaggaaaaaaacaagaacgggggcatcaaggcattggctgttgggaaaatgaattcttgaactgcccaaaaaattccaaaattgcgttcccttgagaaaaaaatccggtccccaataaatccaaccaaaagggtgcccgcccggggccccccatgaaaaggttccttaaaaaggaaaaaagtttctctggttcccaaaattgaaaaa

SEQ ID NO: 47651 - protein, 115 aa, Zea mays
  misc_feature: Ceres CLONE 1455644-F
  misc_feature (74)..(74): Xaa is any aa, unknown, or other
MAAAALREQLNALLSSMFASGLVDEQFQQLQMLQEDGGTPGFVAEVVTLFCDDADRIISELAALLDQPIVDFDXVDAYVHQLKGSSARTCTAEHFYFPIKQVKLSTSLPMWALKK

SEQ ID NO: 47652 - DNA, 707 bp, Zea mays
  misc_feature: Ceres CLONE 1455646-F
  misc_feature: Encodes the peptide sequence at SEQ ID NO. 47653
  misc_feature (353)..(353): n is a, c, t, g, unknown, or other
  misc_feature (398)..(398): n is a, c, t, g, unknown, or other
  misc_feature (399)..(399): n is a, c, t, g, unknown, or other
agtgctggagctccccgcggtggcggccgctctagaactagtggatcccccgggctgcaggaattcgcacgagaccattacctagaacatcctaatcgaaaagaaacccgtctcgcaccacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaagcgcatcctcaaggagctgaaggacctgcagaaggacccccccacatcatgcagtgcaggtcctgctggtgaggacatgtttcatttggcagcaacanttatgggaccacctgacagtccctatgcggggggggtttttttannggacacttcttttccccccccattacccctttcaaaccttcaaaggtttccttccaggacgaggggcttctttccttattttccacagcatggaaggtttttgcctttgccttttccaagaggcgtgggagcccttctttttaaaatttctaagggcccggctcccccttgggccccggggggaccaaccccacccgggagaactcttttggtccgaaaattgcccccttttaccaaacgggcccggcccaaaataaaattccacgggcccccacttggggcccaaaaatatcgccagggggtttcac

SEQ ID NO: 47653 - protein, 154 aa, Zea mays
  misc_feature: Ceres CLONE 1455646-F
  misc_feature: SWISSPROT Homolog: EC 6.3.2.19 Ubiquitin--protein ligase
  misc_feature (37)..(37): Xaa is any aa, unknown, or other
  misc_feature (52)..(52): Xaa is any aa, unknown, or other
MASKRILKELKDLQKDPPTSCSAGPAGEDMFHLAATXMGPPDSPYAGGVFLXDTSFPPPLPLSNLQRFPSRTRGFFPYFPQHGRFLPLPFPRGVGALLFKISKGPAPPWAPGGPTPPGRTLLVRKLPPFTKRARPKIKFHGPPLGAQKYRQGVS

SEQ ID NO: 47654 - DNA, 728 bp, Zea mays
  misc_feature: Ceres CLONE 1455647-F
  misc_feature: Encodes the peptide sequence at SEQ ID NO. 47655
aaagctggagctccccgcggtggcggccgctctagaactagtggatcccccgggctgcaggaattcgcacgagaccattacctagaacatcctaatcgaaaagagcgaacgatccagaagcagaagccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaaatgcgctgcccttgacagacagcactcggagttttcatgatggggttcataattccccccatgatgaattaacatttgttttgatcatttcagttcacccccttttcctcggcccaatggcatattgggaccccgggcccggcgaaccttttttgggggttgccaaaaatgtgcccttttgccccggaaagggttaaaaaaacgcaaatatcctttcccttaaaaaaaaaaaaaaaaaaaattttttcacccccccccccccgggggggggggccggggccccatttcccccccaaaggg

SEQ ID NO: 47655 - protein, 72 aa, Zea mays; identical to SEQ ID NO: 46899
  misc_feature: Ceres CLONE 1455647-F

SEQ ID NO: 47656 - DNA, 719 bp, Zea mays
  misc_feature: Ceres CLONE 1455651-F
  misc_feature: Encodes the peptide sequence at SEQ ID NO. 47657
  misc_feature (443)..(443): n is a, c, t, g, unknown, or other
aaagctggagctccccgcggtggcggccgctctagaactagtggatcccccgggctgcaggaattcgcacgagaccattacctagaacatcctaatcgaaaaacttccacttcgctctgtcctcccatgcgccggattaccactgaccacttcacagtcacagtagtacagagcggcagagtggagaagtagactctaggtgagatggcggccgtggtggcggcggtggaggcaggggtggtggcggtggcaagcgggaggggatgcagcagccggctggtgcggggcctctactggcgccttcgcgcggttctgcggcggctgcggtcggagcgggccaggcgcggccggaggttcagcttccactacgacgcgctcagctacgcgctcaacttcgacgacgggcgcgccgcctcccgccccgccccggcctctgccgcggncgaccctcgtcttgcccccggcgacaacgacgcgctacagtgaatcggcgtccgacgaatcgctgccaaaagcagctgggggctcttccttgctcggacgccgcttgcttttttcactcccctggggtctccctttttgaaaaataggggttgggtatggtaaaaaagaaaatggaggggggggccccttcggttttgggattctttccctggccccaccttgtttcttatctgggggattgccgggttcccggaaaccgaaaaaccccctggggg

SEQ ID NO: 47657 - protein, 93 aa, Zea mays
  misc_feature: Ceres CLONE 1455651-F
  misc_feature (80)..(80): Xaa is any aa, unknown, or other
MAAVVAAVEAGVVAVASGRGCSSRLVRGLYWRLRAVLRRLRSERARRGRRFSFHYDALSYALNFDDGRAASRPAPASAAXDPRLAPGDNDALQ

SEQ ID NO: 47658 - DNA, 713 bp, Zea mays
  misc_feature: Ceres CLONE 1455654-F
  misc_feature: Encodes the peptide sequence at SEQ ID NO. 47659
  misc_feature (487)..(487): n is a, c, t, g, unknown, or other
  misc_feature (631)..(631): n is a, c, t, g, unknown, or other
  misc_feature (657)..(657): n is a, c, t, g, unknown, or other
aagctggagctccccgcggtggcggccgctctagaactagtggatcccccgggctgcaggaattcgcacgagaccattacctagaacatcctaatcgaaaaaaccagcgactcacacacccgcgcgccgcttctgtagggccccaaccaaccgcgcagggagaaaaccaccacagcacatgcagcgcctcgcctcctcccggaggctcctccaggccgcgctcgcccccgcccgggccaactccagcctctccgcggccgccgtcgccgcgcccgcgccagcgaatggcgccttcccgaagatgccggccttcgactacacgccgccgccgtacgacgggccgcgcgccgaggagatcttccggaagcgcgctcagttcctcagcccatccctttttcatttctacgatcgcccagtacgtgtgccgctcccccatcgccactccagtcttcagttctgtgggaaggaatatactgctacgaccaanaagaaaaacaaaaaaaactgtaaattaccttcggatttcaatatttttttcggtaaaaactgcaccgattgtcgccctggtgatcagttaaaatacgaagaatcgaactactagcattttttgtaattaaaacattttttgttnatttgttttgagaaatggggtcttcntgggtagtcatttggcacagagcagcagtgatctttgtcgttttccgagaggttga

SEQ ID NO: 47659 - protein, 140 aa, Zea mays
  misc_feature: Ceres CLONE 1455654-F
  misc_feature: SWISSPROT Homolog: EC 2.6.1.44 Alanine--glyoxylate transaminase
  misc_feature (103)..(103): Xaa is any aa, unknown, or other
MQRLASSRRLLQAALAPARANSSLSAAAVAAPAPANGAFPKMPAFDYTPPPYDGPRAEEIFRKRAQFLSPSLFHFYDRPVRVPLPHRHSSLQFCGKEYTATTXKKNKKNCKLPSDFNIFFGKNCTDCRPGDQLKYEESNY

SEQ ID NO: 47660 - DNA, 767 bp, Zea mays
  misc_feature: Ceres CLONE 1455655-F
  misc_feature: Encodes the peptide sequence at SEQ ID NO. 47661
  misc_feature (401)..(401): n is a, c, t, g, unknown, or other
  misc_feature (411)..(411): n is a, c, t, g, unknown, or other
  misc_feature (419)..(419): n is a, c, t, g, unknown, or other
  misc_feature (451)..(451): n is a, c, t, g, unknown, or other
  misc_feature (496)..(496): n is a, c, t, g, unknown, or other
ctggagctccccgcggtggcggccgctctagaactagtggatcccccgggctgcaggaattcgtctcacccctaatcgaaaatccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaatctgttttcactgncttgaccgcnagacgtgnagagtgctcctcctcctatgaagaagactacnagctggctaatcttctcctgctggaggaagaaccggatgccatgnaggaaaaagcggaagtggcttaatgataaaaaagggcttccggggccaatttcctctgaaattggttattttaaacccccccaattccgggggtgccctttgggaatcctcggaaaaccccacccccggctttggttaaaaaatttcccccggaaacggggaaacctcacaagggcccagggggggaaacctcaaaaaaaaaatgtcccccctggggggccaccccccccccacaaaaaaaaaaactttggaaaaaattcggacccccctt

SEQ ID NO: 47661 - protein, 88 aa, Zea mays
  misc_feature: Ceres CLONE 1455655-F
  misc_feature: SWISSPROT Homolog: EC 4.1.1.50 Adenosylmethionine decarboxylase
MGLDATALSYGDLVKRVLRCFGPSEFSVAVTIFGGRGHAGTWGKALGAEVYDCNNMVEQELPGGGLLVYQSFCAAEDAVATSPNLFSL

SEQ ID NO: 47662 - DNA, 768 bp, Zea mays
  misc_feature: Ceres CLONE 1455664-F
  misc_feature: Encodes the peptide sequence at SEQ ID NO. 47663
  misc_feature (682)..(682): n is a, c, t, g, unknown, or other
  misc_feature (724)..(724): n is a, c, t, g, unknown, or other
ggagctccccgcggtggcggccgctctagaactagtggatcccccgggctgcaggaattcgtctcacccctaatcgaaaaaaactgtcaaaacggggacacaggccagatggtgcttctgcgcgtttgccgtcacttcggccacctgcgcttcgcctccttcctctcaatggcggcgccccagcaatccgctcccctgtccgggtcggcgcccaagaggctcagggcgatggccacagacgccgctgcagtgccgaatcccccagcctctagtggctgccccgcgatgaaggcggagttcgccaagcacgccgagtacctcaacaccctgaatgacaagagagaaaggcttgtgaaagctagtcgggatattacaatgaacagcaaaaaggtcatctttcaggtccacacggacgaagttctctcgaaggcagaaaatgatcttgctgcagttgttaatcaatacattgcaaaactagtaaaagaattacaaggaactgacttctggaaactcagaagagcctacacctttggtgtacaagaatatgtcgaagctgcaacactctgtagattttgcaagactggcactctattaagccttgctgaaatcaatgattctttactagcactaagtggtcaatctgttgagcccttacagttaaatgtgcttgactatcttttangggttgctgaattgtccggagagcttatgaggctcgcaatangccgtatatctgatggggaaagtgatatgcaaaaactatctgtg

SEQ ID NO: 47663 - protein, 220 aa, Zea mays
  misc_feature: Ceres CLONE 1455664-F
  misc_feature (75)..(220): Pfam Name: Translin Pfam Description: Translin family
  misc_feature (192)..(192): Xaa is any aa, unknown, or other
  misc_feature (206)..(206): Xaa is any aa, unknown, or other
MVLLRVCRHFGHLRFASFLSMAAPQQSAPLSGSAPKRLRAMATDAAAVPNPPASSGCPAMKAEFAKHAEYLNTLNDKRERLVKASRDITMNSKKVIFQVHTDEVLSKAENDLAAVVNQYIAKLVKELQGTDFWKLRRAYTFGVQEYVEAATLCRFCKTGTLLSLAEINDSLLALSGQSVEPLQLNVLDYLLXVAELSGELMRLAIXRISDGESDMQKLSV

SEQ ID NO: 47664 - DNA, 769 bp, Zea mays
  misc_feature: Ceres CLONE 1455672-F
  misc_feature: Encodes the peptide sequence at SEQ ID NO. 47665
  misc_feature (387)..(387): n is a, c, t, g, unknown, or other
  misc_feature (416)..(416): n is a, c, t, g, unknown, or other
aaagctggagctccccgcggtggcggccgctctagaactagtggatcccccgggctgcaggaattcgcacgagaccattacctagaacatcctaatcgaaaaaaactagagagagcgccaatcctccccatcccgaccgccgcccccacctcctccgcggccgcctcgcggcgattccgtccgcatctgaccccgatcccaggggcatcgtcctcacctcctccgccagctgccgctcttccgtcctcttccgcagcttctgcgtggggaagaggcggtggcggccgaaccggcgtagtcgtcgccgacgccgctgccagcccgcatggaggcgtacaagctctgggtgcgcaggaacagggaccctcgtcgctccctcgagtcccntcgcaacgggctcacatggatactccccngagcggcttcgccaacttccgagatcgccccagaagccgtatatgccctactgggaattggaagttcggtccaatcacccataatggatgggccccctggaaattcttcatttggctccagggaacaatcatccccagggggtcttggtgcctcctgcccaaaagaattgaaggcctttttttagttttcctcccaacccttttttgggaaaaaaccccaaggggatttttttgtttttaaaaaaaaaaaaaaaaaggggtccggttttcctttttggggaaagggaaaacaaagctcttctcaggggggggggggaaaaaaaaaaagaggccccccctctaaaaaatattgg

SEQ ID NO: 47665 - protein, 91 aa, Zea mays
  misc_feature: Ceres CLONE 1455672-F
  misc_feature (21)..(21): Xaa is any aa, unknown, or other
  misc_feature (31)..(31): Xaa is any aa, unknown, or other
MEAYKLWVRRNRDPRRSLESXRNGLTWILPXAASPTSEIAPEAVYALLGIGSSVQSPIMDGPPGNSSFGSREQSSPGGLGASCPKELKAFF

SEQ ID NO: 47666 - DNA, 748 bp, Zea mays
  misc_feature: Ceres CLONE 1455674-F
  misc_feature: Encodes the peptide sequence at SEQ ID NO. 47667
ggagctccccgcggtggcggccgctctagaactagtggatcccccgggctgcaggaattcgtctcacccctaatcgaaaaattagccatggcggcggtggatctgtccaagctggtgaaggagaagcgcttctgggtggcctccttcctcgtcgtatgggcagcagcgctgcagggccacatgatgtggatgcagcgccaggacaccttcaagcacaagtttggtatcgaccaagcagacggacccgatgctcaggattcctcatcttcgtcttcgtcttcctcttcttagtcagttaccttgtatcgtctgaagcggtttgttcggaacaaatgagacatccatcctttaataaagcgggcgggagagaaggcagatgacaagacaagtgcagtgtgtgtaaccactaccaggcgttcctttgatgaatgtcatttttcttctctttagtcctgaataaattctgataccatatcttttgggtgtgggatgcaaaactctgctagcttatcattgccacaaactcatgtatttgagttgtgttttatagattgaagtgcactttccagcaggtttcatagactggacagtggactgccgttggttgtctctcggtgagtgtggaacccactttcatcaaaaaaaaaaaaaaaacgagacgctcgaggtacccaattcgccctatagtgagtcgtattacgcgcgctcactggccgtcgttttacaacgtcgtgactgggaaaacctt

SEQ ID NO: 47667 - protein, 67 aa, Zea mays
  misc_feature: Ceres CLONE 1455674-F
MAAVDLSKLVKEKRFWVASFLVVWAAALQGHMMWMQRQDTFKHKFGIDQADGPDAQDSSSSSSSSSS

SEQ ID NO: 47668 - DNA, 759 bp, Zea mays
  misc_feature: Ceres CLONE 1455676-F
  misc_feature: Encodes the peptide sequence at SEQ ID NO. 47669
ggagctccccgcggtggcggccgctctagaactagtggatcccccgggctgcaggaattcgtctcacccctaatcgaaaactcctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacgggctgccgctggcgcacccgcacagcatgctggtggtgaccatcaacggcaccggcatgctcatccagctcacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgcgccgctctcggtcatgaaattggtgatccagacaaagagcgtggaatacatgcccctgttccctgtcctggctcccctcgccaacagcatctgctgggacgccta

SEQ ID NO: 47669 - protein, 182 aa, Zea mays
  misc_feature: Ceres CLONE 1455676-F
  misc_feature (9)..(98): Pfam Name: MtN3_slv Pfam Description: MtN3/saliva family
  misc_feature (132)..(182): Pfam Name: MtN3_slv Pfam Description: MtN3/saliva family
MVSADTIRTAIGVIGNGTALVLFLSPVPTFVGIWKKRAVEQYSPIPYVATLLNCMMWVLYGLPLAHPHSMLVVTINGTGMLIQLTYVALFILCSAGAVRRRVVLLFAAEVAFVVALAALVLTLAHTHERRSMLVGIVSVFFGTGMYAAPLSVMKLVIQTKSVEYMPLFPVLAPLANSICWDA

SEQ ID NO: 47670 - DNA, 722 bp, Zea mays
  misc_feature: Ceres CLONE 1455682-F
aaagctggagctcaccgcggtggcggccgctctatactagtggatcccccgggctgcaggaattcgcacgagaccattacctagaacatcctaatcgaaaactttctctcgcgcacccgacgtcgcatcctctctcgtgcagttggggccagctgttgggccgaggtcgacgacggggtcgacctctccgtggagacagccaaggcggccgtgagccacgccgccacgagccaccacgagcacggcggcgagctcagcgatctggagtcggatctggtggggcggcagaagactggctgctcgtcgtcgccggcggcaacaacgccggctgcagagctgatcgtgccgccagcacagcagatctagcaattccaggtggtacaaaagggtttttcatcaacaagtggtcgtcacaaccccaactgaaacatcaagatggtgtttgcttctacattttaccattgaggatatgatgctaaactgaagtcatgtattatgctatgcattcagaagatgatgctaaactgaataagcacatcaatctgatttttctatgcactgagactatgtttgtattattgttatgcaatgcaatctatgcactaaaacgttccactctgtttgatctggctgacctattcagaattataatacgctgctgccaattagcaaaaaaaaaaaaaaaaaagctttatcgataccgtcgacctccagggggggcc

SEQ ID NO: 47671 - DNA, 703 bp, Zea mays
  misc_feature: Ceres CLONE 1455687-F
  misc_feature: Encodes the peptide sequence at SEQ ID NO. 47672
  misc_feature (520)..(520): n is a, c, t, g, unknown, or other
aaagctggagctccccgcggtggcggccgctctagaactagtggatcccccgggctgcaggaattcgcacgagaccattacctagaacatcctaatcgaaaaacacgcacctcacctctcacaattccaagcccaccagtccaccactctccgcttcgcttcttgtcgctgcggcgcgcggccatggtctccctccgcttccctaccgctgcaatcccccgcctcccgccatcccaggcccccaacggcgtcgccatcgccgccacggtcgccgctgcagccgcggccgcagctgcagtagcggccagcttgaccctcacgggcaagtccaccggccggccagtcccgcaccctgcccctctctgggcctccctctccctggccgacgcggcggcccccagctccgtcgaaccccggaccggcgcgacattccccaccgaggccgccgttgggcgccgcctactcggcataggcctccggaagaccagcgtcctcgggctcaagtccatcgacgtctacngcattcggcgtgtatgcggatgacaacgatttgaagcagcagctgaaagagaagtactcgaagttctcggtctccgaactgaaaggaaacggtgagctgatcaacgatgcccctaaaacgtgacatacccatggacggtcaagctggcgattggttaatgggaagctgaataatcccctccgt

SEQ ID NO: 47672 - protein, 119 aa, Zea mays
  misc_feature: Ceres CLONE 1455687-F
  misc_feature (113)..(113): Xaa is any aa, unknown, or other
MVSLRFPTAAIPRLPPSQAPNGVAIAATVAAAAAAAAAVAASLTLTGKSTGRPVPHPAPLWASLSLADAAAPSSVEPRTGATFPTEAAVGRRLLGIGLRKTSVLGLKSIDVYXIRRVCG

SEQ ID NO: 47673 - DNA, 773 bp, Zea mays
  misc_feature: Ceres CLONE 1455698-F
  misc_feature: Encodes the peptide sequence at SEQ ID NO. 47674
  misc_feature (445)..(445): n is a, c, t, g, unknown, or other
acccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactcccaaactaaactgtttgagtactatgcctagctgaagagctgcnatcacatcatgtggttggaacgccagggaagctcccttatcggacagcctcccttgccacgaacgcatcagggcccccccccaagccgggaactcacctgggtttggctttggcaagaaaccaaacccctgggttgccaaaacctcatacggaactaaaaaaaaacggagcttttaaaaaccaaaggttccccccccccccaaaaaatggggggggcccttgaacaaaggccggaaaaaaccctctttaaaaaaaaaaaaaaaaagaaaggccctggggagaccaattccccccaataagagggtaaaaaccccccctccccgcgccc

SEQ ID NO: 47674 - protein, 69 aa, Zea mays; identical to SEQ ID NO: 47198
  misc_feature: Ceres CLONE 1455698-F

SEQ ID NO: 47675 - DNA, 739 bp, Zea mays
  misc_feature: Ceres CLONE 1455704-F
  misc_feature: Encodes the peptide sequence at SEQ ID NO. 47676
  misc_feature (713)..(713): n is a, c, t, g, unknown, or other
  misc_feature (721)..(721): n is a, c, t, g, unknown, or other
  misc_feature (722)..(722): n is a, c, t, g, unknown, or other
  misc_feature (738)..(738): n is a, c, t, g, unknown, or other
aagctggagctccccgcggtggcggccgctctagaactagtggatcccccgggctgcaggaattcgtctcacccctaatcgaaaaatatttgcatcactgcctgcttcagcaatcaggaaaggagatcaccacttcactcaagaaggcaccctcccttgccactccttttccttgagacgacgacgatgaagaagaagcagcagcagcagctcctcctcctttctctcatgtttctcgttgctgtcacagcagccgctgttgctgccgatccacatccacagcagcaggtgcaggtgcaggtgcagcagcagcagcagcaagcacagatgaggattaacagggccaccagatcccttcttcctcagccgccgccgaaactaggtactactgaaaactgtagacaacaagatacaagatctcatttcattgacgcctgtttctcacgcaatgcagactgcccgtccacctgctccgtgcgctgcggcaacaactggaagaaccagatgtgcaacaagatgtgcaacgtctgctgcaacaagtgcagctgcgtgccgccggggaccggccaggacacccgccacctctgcctctgctacgacaccatgctcaatccacacaccggcaagcttaagtgcccctaggccgtcgccactcatgtaacaatgtactatcatcacttcaataataataataaaaacttctgggtctgggnaaaaaaannaaaaaaaaaaaaaatna

SEQ ID NO: 47676 - protein, 151 aa, Zea mays
  misc_feature: Ceres CLONE 1455704-F
  misc_feature (68)..(151): Pfam Name: GASA Pfam Description: Gibberellin regulated protein
MKKKQQQQLLLLSLMFLVAVTAAAVAADPHPQQQVQVQVQQQQQQAQMRINRATRSLLPQPPPKLGTTENCRQQDTRSHFIDACFSRNADCPSTCSVRCGNNWKNQMCNKMCNVCCNKCSCVPPGTGQDTRHLCLCYDTMLNPHTGKLKCP

SEQ ID NO: 47677 - DNA, 713 bp, Zea mays
  misc_feature: Ceres CLONE 1455705-F
  misc_feature: Encodes the peptide sequence at SEQ ID NO. 47678
  misc_feature (587)..(587): n is a, c, t, g, unknown, or other
  misc_feature (606)..(606): n is a, c, t, g, unknown, or other
agagctggagctccccgcggtggcggccgctctagaactagtggatcccccgggctgcaggaattcgcacgagaccattacctagaacatcctaatcgaaaaatccagtagcacactagacactagcagtaacgccaagaaagaatggcgtgctgcaccaccaccagccgtctcgtcctctcggcggcggccgccctgctcgccgtggcctgcggcgccgcggaagccccgagctactgcgcgccggggcaggccatcccgtaccgcccgctgtccggctgcacctggtacgttgcgagccggagctgcgacgtgatcgaggccatgctcccgaaccgggccgtcctcaaggagacgtgctgcagccagctgcgggacatcccggcggagtgccggtgccgggcgctgcgggtgatgatggagacgcccctcgtcgtgggcgcggagccgggggcccagcagaggtgccgggtcgcgcaggcccgcttcgccccccgcctcgtcgccgcggccgagtgcggcctgctcaccgccacgggaggcgcttctgcaacgcgctccacgacaagtgattaagtgacccaggntgatgatactgctcctcgnaccgggcgtggtcgaaaagaaggggggaaaattattctccggccaaacggacccataagattctattgtccccgtccgttccaaaaaaaaaaaaaaaaccttttcca

SEQ ID NO: 47678 - protein, 143 aa, Zea mays
  misc_feature: Ceres CLONE 1455705-F
MACCTTTSRLVLSAAAALLAVACGAAEAPSYCAPGQAIPYRPLSGCTWYVASRSCDVIEAMLPNRAVLKETCCSQLRDIPAECRCRALRVMMETPLVVGAEPGAQQRCRVAQARFAPRLVAAAECGLLTATGGASATRSTTSD

SEQ ID NO: 47679 - DNA, 767 bp, Zea mays
  misc_feature: Ceres CLONE 1455706-F
  misc_feature: Translation starting site: 195
  misc_feature: Pfam Name: Cytochrom_C1 Pfam Description: Cytochrome C1 family
ggagctccccgcggtggcggccgctctagaactagtggatcccccgggctgcaggaattcgtctcacccctaatcgaaaaatcgccacaaggccctctcacgctcacgcggtcacgcccccggacccttctccccgcgccgccgctcgccggagctccgcgtctccgcccgcgccacaccctgtagaatcctcaatggctgccgcaaggggcattaaccagctcctgaagagaactctctacaaccagtctgttggttcgtcgccgcttttctcatttcggggaaagcatgaagaatcgtctgctggactgagagcattggctcttcttggagttggtgcctctggtcttttgagttttggctacatagcatctgctgatgaagctgagcatggcttggcagccccaaattatccctggccacatgcttgcatcatgagctcgtatgatcacgcatcaattcggcgtgggcatcaggtttaaccgccaagtttggggccccttgccaccccatgtccttgatttccaaccggggatttggttgggctgggcccatacttgaaaagaaaaaaaaggcaagggcgccttaaaattgggggaatttaagggcccaaaaaaaagggggagaatgtgccccccccccgggaaaaaagagaatatctctcccccacccctttttaaaaaaaaaaaaacaccccgtgttttaaaagggggggccacacccccccgcactttttcttctccaaaagggagggggagtggggaaaa

SEQ ID NO: 47680 - DNA, 761 bp, Zea mays
  misc_feature: Ceres CLONE 1455710-F
  misc_feature: Encodes the peptide sequence at SEQ ID NO. 47681
aagctggagctccccgcggtggcggccgctctagaactagtggatcccccgggctgcaggaattcgtctcacccctaatcgaaaactaaaccctacccgactccgccgccgcccgccgctccgcctcagcgcatagcccgccgcgacctcatcgatcaccttcaactttcaatcatggcggacgtcgatgtcgaaccggaggttgccgccggagctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcgctcatcaagaagctgcgcaaggcgaaaaaagatgttcctgctggtgagaaaccagagccagtcaagacacatctccgtaacatgatcattgtccctgagatgattggaagcattgttggtgtctacaacggcaagaccttcaaccaggttgagatcaagcctgagatgatcggccactaccttgctgaagtctccatctcctataagccggtcaagcatggcaggcccgggtatcgtgccaccactcctcgcgggttatcctctgaaatgagcctgtacccgctctgtagcccccagaagcagttgcaaagtccgttcagcttttccacttggtttgaacaattaaaggcccaaaattttggtttgggtcctccggcccagaattcaagcgaacttgt

SEQ ID NO: 47681 - protein, 195 aa, Zea mays
  misc_feature: Ceres CLONE 1455710-F
  misc_feature (55)..(136): Pfam Name: Ribosomal_S19 Pfam Description: Ribosomal protein S19
MADVDVEPEVAAGAPKKRTFRKYSYRGVDLDALLDMSTDDLVQLFPARARRRFQRGLKRKPMALIKKLRKAKKDVPAGEKPEPVKTHLRNMIIVPEMIGSIVGVYNGKTFNQVEIKPEMIGHYLAEVSISYKPVKHGRPGYRATTPRGLSSEMSLYPLCSPQKQLQSPFSFSTWFEQLKAQNFGLGPPAQNSSEL

SEQ ID NO: 47682 - DNA, 613 bp, Zea mays
  misc_feature: Ceres CLONE 1455711-F
  misc_feature: Encodes the peptide sequence at SEQ ID NO. 47683
  misc_feature (276)..(276): n is a, c, t, g, unknown, or other
  misc_feature (299)..(299): n is a, c, t, g, unknown, or other
tggagctccaccgcggtggcggccgctctagaactagtggatcccccgggctgcaggaattcgtctcacccctaatcgaaaactacgtacacaggattggaagaactggaagagctgggaagagcggacttgccactgccttcttcaatgataataactcatcactggcaagatctcttgctgacctaatgcaagaatctaaccaagaggtacctgcatggctattgcgctatgcagctcgcccttcttatggtggtggtggtggtgggaggaccnggcgatcagggggagggagccgnctttggtggccgtgacttcgcatgattctctcatttgcagggggatcccggtgtgtgtgactactatgtgagcaacatgtggtatggtgtgccctctaggtgtggcgaaccgggaactggctccaatgctggatgatgtaaattcccccaaaaagggccgccagttaagcccttttacccagtccattaggaacattttgggaggacttttacccaccaagacaaggggaatgggcccccctttccttcggggggccggggggggcttattttgaaaagtctttaaaaaagggtggtggaactttcccccccat

SEQ ID NO: 47683 - protein, 103 aa, Zea mays
  misc_feature: Ceres CLONE 1455711-F
  misc_feature (92)..(92): Xaa is any aa, unknown, or other
ELHRGGGRSRTSGSPGLQEFVSPLIENYVHRIGRTGRAGKSGLATAFFNDNNSSLARSLADLMQESNQEVPAWLLRYAARPSYGGGGGGRTXRSGGGSRLWWP

SEQ ID NO: 47684 - DNA, 698 bp, Zea mays
  misc_feature: Ceres CLONE 1455716-F
  misc_feature: Encodes the peptide sequence at SEQ ID NO. 47685
  misc_feature (441)..(441): n is a, c, t, g, unknown, or other
  misc_feature (521)..(521): n is a, c, t, g, unknown, or other
ctccccgcggtggcggccgctctagaactagtggatcccccgggctgcaggaattcgtctcacccctaatcgaaaaatcaattcgtgtcaccgcgtcccgagagcgcaaatcattccgcgcgacgcaaaaaccctagcccagccaccgatccctctcatggcaaccaccaccacccaggcgagcctcctcctccagaagcagctaagagatctcgcgaagcacccggtggatgggttctctgctgggctggtcgacgacagcaatgtcttcgagtggcaggtcaccatcatcggaccgcctgacactctatatgatggaggttacttcaatgcaataatgagcttcccacaaaattacccaaacagcccgccatcagtcagatttacctctgaaatgtggcatccaaatgtctatcctgatggggcggtttgtatctctanttctcatccactggtgaagatcaaacggttatgagctcgcaagtgagcgatggacacctgtgcaccagtagaaagcatangtctgagcattatatcaatgctctctagtccaaaggatgagtccccagcaaaacttgaggcagctaaggaatggagggaacaaaaggaggattcaaggaaaaggtaggcccatcggggggaatcccgggaaggtcctgaagaaaagggaaccccgggaaaattacccggccctggcg

SEQ ID NO: 47685 - protein, 105 aa, Zea mays
  misc_feature: Ceres CLONE 1455716-F
  misc_feature (11)..(102): Pfam Name: UQ_con Pfam Description: Ubiquitin-conjugating enzyme
  misc_feature: SWISSPROT Homolog: EC 6.3.2.19 Ubiquitin--protein ligase
  misc_feature (95)..(95): Xaa is any aa, unknown, or other
MATTTTQASLLLQKQLRDLAKHPVDGFSAGLVDDSNVFEWQVTIIGPPDTLYDGGYFNAIMSFPQNYPNSPPSVRFTSEMWHPNVYPDGAVCISXSHPLVKIKRL

SEQ ID NO: 47686 - DNA, 739 bp, Zea mays
  misc_feature: Ceres CLONE 1455717-F
  misc_feature: Encodes the peptide sequence at SEQ ID NO. 47687
  misc_feature (374)..(374): n is a, c, t, g, unknown, or other
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaagtacccgatctccaaatcgccccccttcccaaaccctcttcttcccccttcccgtgctcgacccagatcgagggctcgatccgtcggccatggcgctggagtgggtggtgctgggctacgcggcgggcgcggaggcgatcatgctgctgctgctgacgctgccggggctggacggcctgcgccggggcatgatctccgtggtgcggagcgcgctgaagcccatgatgtcggtggtgcccttctgcctcttcctgctcatggacatctactgnaagtacgagacgcgcctcacctgcgacgacgagcacgcctgcaccccttccgagcacctccgccaccagaaagtcatcatgaagtcgcagcggaacgcgctccttcatcgcgccgcggctgctcctttacgggatctctttttccgtcaccaantttgtctttaggttccaagaaaatgcaaaaaccgtttaaaaaatttaggaagcccacccacggaggaaccccccccttccgggggggcctgtttttccccggccgcgcttgggttccccctttagtgtggggggggagggttttaaaccccgcacccaatttaaaacccgggggaaaattttctttttttttttggcccccctaaaaaaaa

SEQ ID NO: 47687 - protein, 115 aa, Zea mays
  misc_feature: Ceres CLONE 1455717-F
  misc_feature (61)..(61): Xaa is any aa, unknown, or other
  misc_feature (113)..(113): Xaa is any aa, unknown, or other
MALEWVVLGYAAGAEAIMLLLLTLPGLDGLRRGMISVVRSALKPMMSVVPFCLFLLMDIYXKYETRLTCDDEHACTPSEHLRHQKVIMKSQRNALLHRAAAAPLRDLFFRHQXCL

SEQ ID NO: 47688 - DNA, 761 bp, Zea mays
  misc_feature: Ceres CLONE 1455722-F
  misc_feature: Encodes the peptide sequence at SEQ ID NO. 47689
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattccggttccaagcgtgaactgctcgagtttgcttattatcatggaggcggctgtagttctcttttccaccgccaactcttttttttcctaaggaacgtacattgtcatttttgggagcttctgaaaacatggcgtgcgcgtgaactatgaatgtatgagtcactccgaaactaaactggttgagtactatgctaagctgaagagctgcattcacatcatgtggtggaacccaagggaagcttctttatggaagcctccattgtcaccgagcaatcaggcaccccccaaggccggaacaacctgggttgggctttgcatgaaaacaacccctggtttgcctaacccattccgaacaaaaaaaaaagtactttttaaaccaatggttccccctcccccaaaaattgaacgcctttgaaaataggagaaaaaagcccttcaaaaaaaaaaaaaaaaaaagccccggggccccattcccccaaatgaggttaaaaacccccccccgggccgttttta

SEQ ID NO: 47689 - protein, 72 aa, Zea mays; identical to SEQ ID NO: 46180
  misc_feature: Ceres CLONE 1455722-F

SEQ ID NO: 47690 - DNA, 743 bp, Zea mays
  misc_feature: Ceres CLONE 1455723-F
  misc_feature: Encodes the peptide sequence at SEQ ID NO. 47691
ggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgttaaataaagaaaattatctgacaaaaaa

SEQ ID NO: 47691 - protein, 72 aa, Zea mays; identical to SEQ ID NO: 46899
  misc_feature: Ceres CLONE 1455723-F

SEQ ID NO: 47692 - DNA, 740 bp, Zea mays
  misc_feature: Ceres CLONE 1455724-F
  misc_feature: Translation starting site: 221
  misc_feature: SWISSPROT Homolog: EC 5.5.1.4 Inositol-3-phosphate synthase
aaagctggagctccccgcggtggcggccgctctagaactagtggatcccccgggctgcaggaattcgcacgagaccattacctagaacatcctaatcgaaaaacacaacccaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccagtccgtcagtacaacttcggaacagacccgcgtccctagctcggggtgatgcttgtggggtggggaggcaacaacgggtccacgctgacggctggggtcatttgccacagggaggggatttcatgggccaaccaggaaaagggggaaaaagccaatataagggtcccttacccagggctccacccttaaattcgggcctacaaggggaaggaaatttaggccctttaaaacccccttcccgggggaaccccaaaaaatatttgttgggggggggaaataaaaaaaaaaactggccactcttaaaccggggaaggggtgttaaattttccttgaaaaaacccccccccccaagggacgcggggggcccccctccggatataa

SEQ ID NO: 47693 - DNA, 693 bp, Zea mays
  misc_feature: Ceres CLONE 1455725-F
  misc_feature: Encodes the peptide sequence at SEQ ID NO. 47694
caaagctggagctccccgcggtggcggccgctctagaactagtggatcccccgggctgcaggaattcgcacgagaccattacctagaacatcctaatcgaaaacatttggctctggtcgtcacaaagctgtttgtgcatcgcggcggcgacaagggggcgacgaggcaggcggagcgggcggcgactacagcggcagcagatctcacggaatggcggcgaaggcaatctcgagccccgtgccggtggagtggtacccgacgctggccgtcgtcatggtatccgtaggcctcatgttcaccgcctccttcttcatttatgaagcaacttcatcccggaggagccgtagcctgtcaaaggagatcgcaacagcagttgttgcttctgttttcttgggctttgggtctctgttcgtgcttcttgcaagtggtgtttatgtctgatgactggctatgggccgtgtgcttgtgttctgcatcccgagttgtagacttggttatgccagatcctcaaagctgttgtcctaacgaatatagagcatttgaacttattctagaacgatgtatgggagcaaccgagttaaagcaacgttttcttccaggtctgcattatatatcatcaatctaaatccctgttgcctatgtttctgcttattccaggtctgcttatttattatgtattaccaacatattttg

SEQ ID NO: 47694 - protein, 76 aa, Zea mays; identical to SEQ ID NO: 44247
  misc_feature: Ceres CLONE 1455725-F
  misc_feature (2)..(76): Pfam Name: UPF0197 Pfam Description: Uncharacterised protein family (UPF0197)

SEQ ID NO: 47695 - DNA, 752 bp, Zea mays
  misc_feature: Ceres CLONE 1455729-F
  misc_feature: Encodes the peptide sequence at SEQ ID NO. 47696
  misc_feature (752)..(752): n is a, c, t, g, unknown, or other
aaagctggagctcaccgcggtggcggccgctctagaactagtggatcccccgggctgcaggaattcgtctcacccctaatcgaaaaaaatccccaaaaaggcaagatcaaatcaaatcagatctctccacccccagcccatccatggcgatcgtgtacgccctggtcgcacggggcacggtggtgctggccgagttcgccgccgtctcgggcaacgccggcgccgtggcccgtcggatcctcgagaagctgccgcccgacgccgagtccaggctgtgcttcgcgcaggaccggtacatcttccacgtcctccgatccgacgccgccggcatcaccttcctctgtatggccaacgactccttcggaagaaggatcccctttctctacctggaggacatccaaatgaggttccaccaacaactacggcagagtcgcccactctgcgctggcttacgccatgaacgatgagttctccagagggctccatcagcaaatggagttccttctcccagaactcaagcgccgaaacactcaacccgctccgtggagaagtcacccagatacacaccgtcatgggccgacaacctagagaaaaattcttgaccgaggcggatcgcctcctcgctccttggtcgaaaagaactcctacccatgccaagacaagcgccttttcaccttccgccaagcaatcccaaggaggcttcccgtaaaacccccctttggaatgaaagaacaggccatattctttccttn

SEQ ID NO: 47696 - protein, 107 aa, Zea mays
  misc_feature: Ceres CLONE 1455729-F
MAIVYALVARGTVVLAEFAAVSGNAGAVARRILEKLPPDAESRLCFAQDRYIFHVLRSDAAGITFLCMANDSFGRRIPFLYLEDIQMRFHQQLRQSRPLCAGLRHER

SEQ ID NO: 47697 - DNA, 786 bp, Zea mays
  misc_feature: Ceres CLONE 1455730-F
  misc_feature (263)..(263): n is a, c, t, g, unknown, or other
  misc_feature (376)..(376): n is a, c, t, g, unknown, or other
  misc_feature (430)..(430): n is a, c, t, g, unknown, or other
  misc_feature (437)..(437): n is a, c, t, g, unknown, or other
  misc_feature (442)..(442): n is a, c, t, g, unknown, or other
  misc_feature (501)..(501): n is a, c, t, g, unknown, or other
  misc_feature (564)..(564): n is a, c, t, g, unknown, or other
aagctggagctccccgcggtggcggccgctctagactagtggatcccccgggctgcagggattcgtctcacccctaatcgaaaattcccggcccgactcccgctcccccttcctccaccacggccacgtccacgcccacgccgccgccgccgacacggagcacctgcaccgggcgcaggggccgatggacccgccgtcgtcgtcggggcgccccaccacgccgcgccggcagctgcagggcccgcgcccgcccaggctcaacntcaggatggagtcgcacgccatcaagaagccctcggcctcgggggctccgccggcgcccgggcaggggaggccgcgggaccaccaccactaccatttgtagcccccccccccncccgtcatcttctacgacgcgtctgccagttgttccccccccccccccaccaantcaatgnactcntggaacgcctcccggcccccgcccccaagcccaacaacaaaccccacggggtgacaacnaacccccccgcaacggcgggggaggctgggggaagggtttcttccccccgaagtgcttgtttngccgttcccacgcatgtgaccgggccggccgcctggggacaattaaggggttcccgggcccccagcccccacccgggcgcggggcccgaacttctccccctccggggacccccgccgggggtggccaccccccccaggggaccccgggactcttgtttcccgttggggaatttcattagtccgcagggccaccatctttggcttgtttaccttcccccgccc

SEQ ID NO: 47698 - DNA, 795 bp, Zea mays
  misc_feature: Ceres CLONE 1455731-F
  misc_feature: Encodes the peptide sequence at SEQ ID NO. 47699
aaagctggagctccccgcggtggcggccgctctagaactagtggatcccccgggctgcaggaattcgtctcacccctaatcgaaaaatcggactcatctccttcgattcagcagaggacagcgctctgcctctccactacttgacagccacggatccttccatccctcgcctagcgaacagacccggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacacattctttgaggcatctttcaagttcatgatatatgatcaagtaacccccacaacacaggtgcatctaggtaaacacagctttccagactgcaagtaccagctccgccatcgaattcatgtaacctctgaaagcactcaaacaatcccctaaaattattgcaaaaaacagcggcggatttggggatggccttccccaaggtggcccttccaagttaaccccccccttaaaacccggtttgccggagaaaaaaacactttcacacaggcccaaattttaccttggaaaaaccggaattttccgtcccaaaaaaacccccccccccccccgaatttgaaccccgggaaccagaggaaaatccctttaagacccccccccagggggaacacccccctccttttccccaaaaaaaagaaaaaacaaaaag

SEQ ID NO: 47699 - protein, 82 aa, Zea mays
  misc_feature: Ceres CLONE 1455731-F
MRYLKLNPKYEVSNEECVSLRLELSQSSVKLDTFFEASFKFMIYDQVTPTTQVHLGKHSFPDCKYQLRHRIHVTSESTQTIP

SEQ ID NO: 47700 - DNA, 791 bp, Zea mays
  misc_feature: Ceres CLONE 1455732-F
  misc_feature: Encodes the peptide sequence at SEQ ID NO. 47701
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
naaatattnnnagctaactggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattggcatttttggaagcttctgaaagcagggggggcggcgggactatgaatgtttgaattctttccccaccccccccggtttgagtactaaggcaaacctgaaggacctgccttcacctcatgggggggaacccaaggaaagccttcttttttcgaaaagcctcccttttgccccgaccaattcggggacccccccaacgcggggaacaccccggggttgggttttggaaaaaaaaacacccctcgtgttttgcaaaaacactatcgaaccaaagaaaaaaaagagctctttaaaccaccagggaccccccccccccaatataggggggcctcccttccaaaacccccaaaaagcctctctaaaaaaaaataaaaaagggagcccggggggcacccctcccgctcagagtgggtaaaccccccgcccct

SEQ ID NO: 47701 - protein, 77 aa, Zea mays
  misc_feature: Ceres CLONE 1455732-F
  misc_feature (3)..(3): Xaa is any aa, unknown, or other
  misc_feature (4)..(4): Xaa is any aa, unknown, or other
KYXXLTGAPRGGGRSRTSGSPGLQEFVSPLIENKWERQRFGLQGGFVTNPLAEPNISSAGKTMVTHEGRKKDKTLQK

SEQ ID NO: 47702 - DNA, 746 bp, Zea mays
  misc_feature: Ceres CLONE 1455734-F
  misc_feature: Encodes the peptide sequence at SEQ ID NO. 47703
  misc_feature (471)..(471): n is a, c, t, g, unknown, or other
  misc_feature (492)..(492): n is a, c, t, g, unknown, or other
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgtttgagtactatgctaagctgaggagctgcattcacatcatgtggntggagcgcgagggaggcctcnttatcggacagcctcacttgtaccgacgcaatcaggcacccccccagccgtggactaccctggtttggctttgcatgaaacgaccggctgggttggcctaagcaaatcgaacctaaaaacaggtgcttttaatcccaatgttccccctcctccaaacttggatgcccttgaaaaaggcgagaaaagcctttaaaaaaaaaaaaaaaacaaaaccccggggacccaatccccccaaagggggcgtattccccccc

SEQ ID NO: 47703 - protein, 72 aa, Zea mays; identical to SEQ ID NO: 46180
  misc_feature: Ceres CLONE 1455734-F

SEQ ID NO: 47704 - DNA, 761 bp, Zea mays
  misc_feature: Ceres CLONE 1455735-F
  misc_feature: Translation starting site: 199
  misc_feature (1)..(1): n is a, c, t, g, unknown, or other
nagagctggagctcaccgcggtggcggccgctctagactagtggatcccccgggctgcaggaattcgtctcacccctaatcgaaaagagtgaggagtctgtgtgaccagtgctcgccgtcgtcccctgcctctggccctctgctagccgctaggcgacgggcctttcgccgggcgacgggcacaccgcccctgttaccatggcagcgatgaatactggtatgggaggtttaggtggcaggccgatacatccacaagcaaatccttttggaactgccttgcagggtgctggaccaggattgatccgtactgggctagaaacatatggcggaaggattttagattcaagttctgagtttatgcagagcaatataacacaatatttgtccgaccctcagtactactttcaagtcaacagccaccacccccacgaacaaactgaaggtcatcttgttccctttcttgcacaggggtcactggacaagaataactgaaccagtaggaggaaggctatcctacaaaacctccagtccaggatatcaatgcaccggacttggacatccctttgatggcatttggcacctacattgtaactgctgggtatgcccttgagggtccttggaaggttacccctgaggcactgaccctacagttttctaaggggaaccttggtggtttcctcaagtcctcctcaacaaaaggctgcctcaacccccggggaaccgcccaacctcctttggcggacatcgtggcctatcccgac

SEQ ID NO: 47705 - DNA, 742 bp, Zea mays
  misc_feature: Ceres CLONE 1455737-F
  misc_feature: Translation starting site: 176
  misc_feature (382)..(382): n is a, c, t, g, unknown, or other
aaagctggagctccccgcggtggcggccgctctataactagtggatcccccgggctgcaggaattcgtctcacccctaatcgaaaactaaaccctacccgactccgccgccgcccgccgctccgcctcagcgcatagcccgccgcgacctcatcgatcaccttcaactttcaatcatggcggacgtcgatgtcgaaccggaggttgccgccggagctcccaagaagaggacgttccgcaagtacagctaccgcggcgtcgacctagatgcgcttctcgacatgtccacggacgacctcgtccagctcttccccgcgcgcgccaggagaagggtccagaggggtctgaagaggaagcccatggcgctcatcaagaagctgcgncaggcgaaaaaagatgttcctgctggtgagaaaaccacacccagtcaagacacatctcccgtacatgatcattgtccctgagatgattggaagcattgttggtgtctacaaggcaagacttccaacaagtttgagatcaagcctgaaatgatcggccccaacctggctgagtttccatcctccaaaaaccgggcaacatggcaggcccgtatcgggccccccactcctcggggtttatccctgaaaaggattgttccccggcttggaagcccccaaaaacaatttggaaagtccctcccctttcccacttgtttgaaaaaataaaagccccaaaaattttttttggccccttccccccaa

SEQ ID NO: 47706 - DNA, 756 bp, Zea mays
  misc_feature: Ceres CLONE 1455741-F
  misc_feature: Encodes the peptide sequence at SEQ ID NO. 47707
  misc_feature (540)..(540): n is a, c, t, g, unknown, or other
ggagctccccgcggtggcggccgctctagaactagtggatcccccgggctgcaggaattcgtctcacccctaatcgaaaagagtgaggagtctgtgtgaccagtgctcgccgtcgtcccctgcctctggccctctgctagccgctaggcgacgggcctttcgccgggcgacgggcacaccgcccctgttaccatggcagcgatgaatactggtatgggaggtttaggtggcaggccgatacatccacaagcaaatccttttggaactgccttgcagggtgctggaccaggattgatccgtactgggctagaaacatatggcggaaggattttagattcaagttctgagtttatgcagagcaatataacacaatatttgtccgaccctcagtactactttcaagtcaacagccagtatgtgaggaacaaactgaaggtcatcttgttccctttcttgcacaggggtcactggacaagaataactgaaccagtaggaggaaggctatcctacaaacctccagtccaggatatcaatgcaccngacttgtacatccctttgatggcatttggcacctacattgtagctgctgggtatgccttgggtgttcttggagggttaccccctgagcactgaacctacagttttctaaaggatacttgggtggtttctgcaagtcctcctcatcaaggtccgctggactccctgggaagcggcaaactcccctgctggacatctgggcgtatgctggatattgct

SEQ ID NO: 47707 - protein, 146 aa, Zea mays
  misc_feature: Ceres CLONE 1455741-F
  misc_feature (34)..(146): Pfam Name: YIF1 Pfam Description: YIF1
MAAMNTGMGGLGGRPIHPQANPFGTALQGAGPGLIRTGLETYGGRILDSSSEFMQSNITQYLSDPQYYFQVNSQYVRNKLKVILFPFLHRGHWTRITEPVGGRLSYKPPVQDINAPDLYIPLMAFGTYIVAAGYALGVLGGLPPEH

SEQ ID NO: 47708 - DNA, 765 bp, Zea mays
  misc_feature: Ceres CLONE 1455742-F
  misc_feature: Pfam Name: UPF0103 Pfam Description: Protein of unknown function DUF52
  misc_feature (393)..(393): n is a, c, t, g, unknown, or other
  misc_feature (396)..(396): n is a, c, t, g, unknown, or other
atagctggagctcaccgcggtggcggccgctctagaactagtggatcccccgggctgcaggaattcgtctcacccctaatcgaaaaatcaagaattcgcactagaccattacctagaacatcctaatcgaaaaactactacactccaaaatgtgctttaaccagggcttctgtctactgtaccccaatcggggatttgccagtagaccaggaagtcattgaggaactcagtgctactggaaagtttgaatttatggaccttaatgtggatgaagctgaacatagcatggaaatgcatttgccctaccttgctaaagtatttcaaggacataatgtgaaagtcgtccctatccttgttggtgcacttagctcccaaaacgaagccttgtatggncanctgctctccaaatacccccacgacccaaaaaacttcttttccgtgtcgtcagacttctgccattggggatcccggtttagctacccatactacaaaaagaagcacggtgccatccataaatctatcgagggcctggacccgtatgggcatggagatcaaagagactggggatcccgtacgtttcaaagaatacctgcaggagtacaaagaaccccatatgccggacgccacccccatcaggcgctttcctctcacagtttgaaaacatttccctcgacaaacaattaaaaatggggtgttggctcccctaacaagccaagcccagtcccagtggccagaaccatggacgggatataccacgcgcgtcgt

SEQ ID NO: 47709 - DNA, 750 bp, Zea mays
  misc_feature: Ceres CLONE 1455746-F
  misc_feature: Encodes the peptide sequence at SEQ ID NO. 47710
atagctggagctccccgcggtggcggccgctctagaactagtggatcccccgggctgcaggaattcgtctcacccctaatcgaaaaaaactgtcaaaacggggacacaggccagatggtgcttctgcgcgtttgccgtcacttcggccacctgcgcttcgcctccttcctctcaatggcggcgccccagcaatccgctcccctgtccgggtcggcgcccaagaggctcagggcgatggccacagacgccgctgcagtgccgaatcccccagcctctagtggctgccccgcgatgaaggcggagttcgccaagcacgccgagtacctcaacaccctgaatgacaagagagaaaggcttgtgaaagctagtcgggatattacaatgaacagcaaaaaggtcatctttcaggtccacagggacgaagttctctcgaaggcagaaaatgatcttgctgcagttgttaatcaatacattgcaaaactagtaaaagaattacaaggaactgacttctggaaactcagaagagcctacacctttggtgtacaagaatatgtcgaagctgcaacactctgtagattttgcaagactggcactctattaagccttgctgaaatcaatgattctttactagcactaagtggtcaatctgttgagcccttacagttaaatgtgcttgactatcttttaggggttgctgatttgtcccgagagcttatgaagctcgcaataggccgtatatctgatggggaa

SEQ ID NO: 47710 - protein, 212 aa, Zea mays
  misc_feature: Ceres CLONE 1455746-F
  misc_feature (75)..(212): Pfam Name: Translin Pfam Description: Translin family
MVLLRVCRHFGHLRFASFLSMAAPQQSAPLSGSAPKRLRAMATDAAAVPNPPASSGCPAMKAEFAKHAEYLNTLNDKRERLVKASRDITMNSKKVIFQVHRDEVLSKAENDLAAVVNQYIAKLVKELQGTDFWKLRRAYTFGVQEYVEAATLCRFCKTGTLLSLAEINDSLLALSGQSVEPLQLNVLDYLLGVADLSRELMKLAIGRISDGE

SEQ ID NO: 47711 - DNA, 805 bp, Zea mays
  misc_feature: Ceres CLONE 1455750-F
  misc_feature: Pfam Name: ATP_bind_1 Pfam Description: Conserved hypothetical ATP binding protein
  misc_feature (435)..(435): n is a, c, t, g, unknown, or other
  misc_feature (487)..(487): n is a, c, t, g, unknown, or other
aagctggagctccccgcggtggcggccgctctataactagtggatcccccgggctgcaggaattcgtctcacccctaatcgaaaacttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgccctaatcagcaccctcctcgccgtcgccatctgtcaacttattgctccagtttatacgaccattgcccagaccgtgggaaggacanttcataattgtcaatcttgatccagctgctgagcacttcgactatcctgtangatatggatatcaagaaagctggatttcattgggatgaatgttatggagggagaattgggtttgggggccaattggccgtcctcatcacctggatggaaaccccttgaaaacagctttggaatgattggtttgatgaaaccccttaaagaactacccaaaggagaatatacttggggtttaaatgcccccgcccaaattaactctttcacaaagtttccatttctcggaaattttttgcaacccctgaaacaaaaaaattttccggtgtgccctttttcccttttttttccacatttggcgcggattaaaaaaaaatt

SEQ ID NO: 47712 - DNA, 786 bp, Zea mays
  misc_feature: Ceres CLONE 1455752-F
  misc_feature: Encodes the peptide sequence at SEQ ID NO. 47713
  misc_feature (260)..(260): n is a, c, t, g, unknown, or other
  misc_feature (317)..(317): n is a, c, t, g, unknown, or other
aaagctggagctccccgcggtggcggccgctctagaactagtggatcccccgggctgcaggaattcgtctcacccctaatcgaaaagttttcgcggcgacttggaccaggctcccctcctctcaaatttgggctggtatcctcacaaacggcccgttaaggccttcctctctcctttctttcccgttcgcccttggtccgcctcgcttcttctcgtgccgcctccccctgtttccacgagctggggttttagcggcgaanagagggaaaagaaagccagcgagagagacggaaaggggaagatgagccggagcctgnggatcccggtgaagttgctcccatgagcagcgggtcacgtggtgacggtggagctcaagaccgcgaagtgtaccgggggtcattggtcgagtgcaagcacaactggaattgcagcttgaagacataactttcactgccaagggatggaaaggttcccaactgggaaccctccttcttcaagggagccaaaggggaattttgattttccccgaattgcccaaaaaccccccttttttcaaccccttggaacccgagatttgggcaaaagaacaccttttgaaattggccggaaaatttttttaaaaagggcccccggccttccttgggcgggggggggccccttgtaaaaaaaaaccccccccccctggaaggagaaaattaaaaagggggggttttctctccgcggaaaggggttttgtgaaaaaaaagagaatctctttaaaaaaaaaacctcctcaagaaaaaaaac

SEQ ID NO: 47713 - protein, 34 aa, Zea mays
  misc_feature: Ceres CLONE 1455752-F
MSSGSRGDGGAQDREVYRGSLVECKHNWNCSLKT

SEQ ID NO: 47714 - DNA, 752 bp, Zea mays
  misc_feature: Ceres CLONE 1455754-F
  misc_feature: Translation starting site: 197
  misc_feature (341)..(341): n is a, c, t, g, unknown, or other
  misc_feature (379)..(379): n is a, c, t, g, unknown, or other
  misc_feature (380)..(380): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (478)..(478): n is a, c, t, g, unknown, or other
  misc_feature (484)..(484): n is a, c, t, g, unknown, or other
  misc_feature (485)..(485): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (505)..(505): n is a, c, t, g, unknown, or other
  misc_feature (515)..(515): n is a, c, t, g, unknown, or other
  misc_feature (547)..(547): n is a, c, t, g, unknown, or other
  misc_feature (562)..(562): n is a, c, t, g, unknown, or other
  misc_feature (567)..(567): n is a, c, t, g, unknown, or other
  misc_feature (571)..(571): n is a, c, t, g, unknown, or other
  misc_feature (576)..(576): n is a, c, t, g, unknown, or other
  misc_feature (581)..(581): n is a, c, t, g, unknown, or other
  misc_feature (582)..(582): n is a, c, t, g, unknown, or other
  misc_feature (590)..(590): n is a, c, t, g, unknown, or other
  misc_feature (594)..(594): n is a, c, t, g, unknown, or other
  misc_feature (610)..(610): n is a, c, t, g, unknown, or other
  misc_feature (611)..(611): n is a, c, t, g, unknown, or other
  misc_feature (615)..(615): n is a, c, t, g, unknown, or other
  misc_feature (616)..(616): n is a, c, t, g, unknown, or other
  misc_feature (619)..(619): n is a, c, t, g, unknown, or other
  misc_feature (628)..(628): n is a, c, t, g, unknown, or other
  misc_feature (629)..(629): n is a, c, t, g, unknown, or other
  misc_feature (633)..(633): n is a, c, t, g, unknown, or other
  misc_feature (645)..(645): n is a, c, t, g, unknown, or other
  misc_feature (653)..(653): n is a, c, t, g, unknown, or other
  misc_feature (662)..(662): n is a, c, t, g, unknown, or other
  misc_feature (663)..(663): n is a, c, t, g, unknown, or other
  misc_feature (671)..(671): n is a, c, t, g, unknown, or other
  misc_feature (672)..(672): n is a, c, t, g, unknown, or other
  misc_feature (675)..(675): n is a, c, t, g, unknown, or other
  misc_feature (676)..(676): n is a, c, t, g, unknown, or other
  misc_feature (679)..(679): n is a, c, t, g, unknown, or other
  misc_feature (694)..(694): n is a, c, t, g, unknown, or other
  misc_feature (698)..(698): n is a, c, t, g, unknown, or other
  misc_feature (699)..(699): n is a, c, t, g, unknown, or other
  misc_feature (703)..(703): n is a, c, t, g, unknown, or other
  misc_feature (704)..(704): n is a, c, t, g, unknown, or other
  misc_feature (708)..(708): n is a, c, t, g, unknown, or other
  misc_feature (713)..(713): n is a, c, t, g, unknown, or other
  misc_feature (714)..(714): n is a, c, t, g, unknown, or other
  misc_feature (719)..(719): n is a, c, t, g, unknown, or other
  misc_feature (723)..(723): n is a, c, t, g, unknown, or other
  misc_feature (724)..(724): n is a, c, t, g, unknown, or other
  misc_feature (738)..(738): n is a, c, t, g, unknown, or other
  misc_feature (743)..(743): n is a, c, t, g, unknown, or other
  misc_feature (744)..(744): n is a, c, t, g, unknown, or other
atagctggagctccccgcggtggcggccgctctagaactagtggatcccccgggctgcaggaattcgtctcacccctaatcgaaaagatttagggtttccttaccttacaagctttttcttccgccgccgcctcagccctcgccccgcgctgctgtactctctcacctccttcgccgttgtctaccagatcatcccatggcgtcggagaagaagcagtcgaacccgatgcgggagatgaaggtccagaagctcgtgctcaacatctccgtcggcgagagcggtgatcgcctcacccgcgccgccaaggtactggagcagctgagtggtcagtcaccggtanttctccaaaggcaaaggtacacctggggggaggggggnncgttttgggaaacccggccccaatttggagaaaaaacccctttcctcttttttaaacccggtgtccccgggggttataaaaaannnnnnnannnnnanaaaatnntattnnnnnatatatataantactggtttntgtccacacagcaatgcaaacgaaacgggctnagcgaaccaacaccnaagtnacantacgnaaggnnacaccccncagnaagtacacccgccagnncagnncantcatacacnncaanagagtaagacanacgtacgntcattacgnncctaccgnnccnngcntgaccgacccccagnacannacgnnccgntccgnnacagncacnncgcgccacatcccnccctnncccgtacg

SEQ ID NO: 47715 - DNA, 761 bp, Zea mays
  misc_feature: Ceres CLONE 1455755-F
  misc_feature: Encodes the peptide sequence at SEQ ID NO. 47716
  misc_feature (718)..(718): n is a, c, t, g, unknown, or other
aaagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcacccagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatataccgaatctgtgcctggcaaaacatatttgaggctagctaatatgaaacctttgtctctaaagtngttaataaagaaaatatctgacaaaaaaaaaaaaaaccgagcc

SEQ ID NO: 47716 - protein, 72 aa, Zea mays
  misc_feature: Ceres CLONE 1455755-F
MGKTPVRMKAVVYALSPFQQKVMPGLWKDITTKIHHKVTQNWISATLLLTPVVGTYQYAMWYKEQEKLSHRY

SEQ ID NO: 47717 - DNA, 828 bp, Zea mays
  misc_feature: Ceres CLONE 1455756-F
  misc_feature (828)..(828): n is a, c, t, g, unknown, or other
aagctggagctccccgcggtggcggccgctcttacactagtggatcccccgggctgcaggtattcgtctcacccctaatcgaaaaacgtccaaaaaccaaccaaagcacacacacactctgccggccaccacgccctcctctgcctccgctgacgccgagggcgcccgcagcaaacgcaaaagaggctcgtcggccgcatgcgcatccgacggcagcgaccagcagggcccgtcgtcccactggctgacgccgcgcgcgcagcaggcatactcctccaagctcctccaggcgctgcgcctcgtgcgcggcggcactggcacacccacctgctccgcctccgccccggcggtgcgcgacgcggtcctattgagcgttaaacttggtggcgcgggaccagtctcgcttgaacccccccccccccccccaccaacccacgagagccgggggctccctccgcgccgcgcagacctcccactcacaaagaccacgcaacgactggtggtggcttcatcaccatcaagtaccaacccgcccggtgtgtaggctctgtatggcatggtcgatagcggcctaggccgggatggggtgctaaaggcgcttctataccttgttcgcttatttcgcctgccggtctcaagctcgctctaactaccttcctccgccctcgcactatcgttgatccctacccttgggatctatcttctgtgataagactctttgtctacttattttgtcgcactcgcatcccacgcagtagagcatgaatgtaccgccctcgtaatttgcgcttctcgcactctactttcttttcccactgcggccgccan

SEQ ID NO: 47718 - DNA, 812 bp, Zea mays
  misc_feature: Ceres CLONE 1455761-F
  misc_feature: Encodes the peptide sequence at SEQ ID NO. 47719
  misc_feature (366)..(366): n is a, c, t, g, unknown, or other
  misc_feature (394)..(394): n is a, c, t, g, unknown, or other
  misc_feature (447)..(447): n is a, c, t, g, unknown, or other
aaaactggagctccccgcggtggcggccgctctagaactagtggatcccccgggctgcaggaattcgtctcacccctaatcgaaaacctttccgccgcctccccaccgcaaaccccgaccagccctagggttcgccgccatgcctcagggagattacatagaacttcaccagaagcgccatggacggcgcatggactacgaggagcgcaagcgcaagaaggaggcgcgcgccgtcaagaagaactccaaggatgcccgcaagctacttggtgccaagggcaagaggttcgccaagaagcggtatgccgagaaggcgcagatgaagaagaccctgaaatgcacgatgagtcttcttccccgcagaangttgatgataatgttgaggagggtgccnatcccctcgtatctgctgaaccgggatccgacacaacgcggcaagggtctccngcaccccatttagcccaaaagggaaggaaaaggctggccaaaggggatgttccctttgcctaagggccaaactgtgtgcttaaaaaaaaaatgtttaaatttccttccccctgggaaggggaaaacccaaggtggggaaaaaaagggtacttaaagcccccctttttggcccttggttttcaagggaaccccccaatttggagggggtccccgggcctttgggttggttttccccggggggtggggacccccccggagagaaagagggccccccccttgaattttttttggaaaaaaaaccaagggggcgagagacctcttttggggggtaaagcgagggaaaattttgggggagaccctccccc

SEQ ID NO: 47719 - protein, 106 aa, Zea mays
  misc_feature: Ceres CLONE 1455761-F
  misc_feature (1)..(106): Pfam Name: Ribosomal_S8e Pfam Description: Ribosomal protein S8e
  misc_feature (76)..(76): Xaa is any aa, unknown, or other
  misc_feature (103)..(103): Xaa is any aa, unknown, or other
MPQGDYIELHQKRHGRRMDYEERKRKKEARAVKKNSKDARKLLGAKGKRFAKKRYAEKAQMKKTLKCTMSLLPRRXLMIMLRRVPIPSYLLNRDPTQRGKGLXHPI

SEQ ID NO: 47720 - DNA, 727 bp, Zea mays
  misc_feature: Ceres CLONE 1455762-F
  misc_feature: Encodes the peptide sequence at SEQ ID NO. 47721
  misc_feature (421)..(421): n is a, c, t, g, unknown, or other
  misc_feature (437)..(437): n is a, c, t, g, unknown, or other
atagctggagctccccgcggtggcggccgctctatgaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgccctttcagcagaaggtgatgcccgggctgtggaaggacatcaccaccaagatccaccacaccgncaccgagaactggatntccggcaggcttcttcttacccccgtcgtcgggacctaccaataccccatgtggacaaagagcagggaaaagcttcccacagaaactaaatggaaagccccccaagtgctgccgttgccccaattgaatttcccagaaggggtggaaaaccggcaagggcatttccttgcccgtttaagtcaaccccttttccccttccaaatgaataacgggatcggcgccgggaaaacaatttggggggtaccaaaaagacacctttggcccccaaagggttaaaaaaaaaaaatatt

SEQ ID NO: 47721 - protein, 134 aa, Zea mays
  misc_feature: Ceres CLONE 1455762-F
  misc_feature (38)..(38): Xaa is any aa, unknown, or other
  misc_feature (43)..(43): Xaa is any aa, unknown, or other
MGKTPVRMKAVVYALSPFQQKVMPGLWKDITTKIHHTXTENWXSGRLLLTPVVGTYQYPMWTKSREKLPTETKWKAPQVLPLPQLNFPEGVENRQGHFLARLSQPLFPFQMNNGIGAGKTIWGVPKRHLWPPKG

SEQ ID NO: 47722 - DNA, 727 bp, Zea mays
  misc_feature: Ceres CLONE 1455765-F
  misc_feature: Encodes the peptide sequence at SEQ ID NO. 47723
  misc_feature (682)..(682): n is a, c, t, g, unknown, or other
  misc_feature (685)..(685): n is a, c, t, g, unknown, or other
ctggagctccccgcggtggcggccgctctagaactagtggatcccccgggctgcaggaattcgtctcacccctaatcgaaaaatcacagtctcgcagccgccgcgatctgctagcccccgaaccctagctcaatgggaaccgccgcttctccttctccctcactttccctagacacagccgcctcccgtcctgatcctccttccccggaggccaccgctacaccagccaaagaagatcaccagcactccgcctccgacgccgcgaccgccgcagctggcggcggcgcagacgatgcggcggcggctccttctgttggaggcggcgcggaagaggctgctgagacggtggtcatcgatgcctccgcggtggccagcggagcaggggagggggaggaggaggaggagcacccccactgcgggttctgtctcttcatgaagggcggcggctgcaaggacgagttcgtcgcgtgggagaagtgcgtggaggagacggatgccgcggatgccagcattgacgtcgtggagcggtgccaagacgtcacggccgcgctgcggaagtgcatggacgcgcacgccgcctactacgagcctatcctccgggccgagcgcgccatggctgcggacctcgaggccttcaggcccaaggaagccgcctcgactccgcggcgtcggaggaagccanaanggagcggcagcggcggccgagcaccccccgtcggtcagagaa

SEQ ID NO: 47723 - protein, 198 aa, Zea mays
  misc_feature: Ceres CLONE 1455765-F
  misc_feature (93)..(169): Pfam Name: GCK Pfam Description: GCK domain
  misc_feature (184)..(184): Xaa is any aa, unknown, or other
  misc_feature (185)..(185): Xaa is any aa, unknown, or other
MGTAASPSPSLSLDTAASRPDPPSPEATATPAKEDHQHSASDAATAAAGGGADDAAAAPSVGGGAEEAAETVVIDASAVASGAGEGEEEEEHPHCGFCLFMKGGGCKDEFVAWEKCVEETDAADASIDVVERCQDVTAALRKCMDAHAAYYEPILRAERAMAADLEAFRPKEAASTPRRRRKPXXSGSGGRAPPVGQR

SEQ ID NO: 47724 - DNA, 761 bp, Zea mays
  misc_feature: Ceres CLONE 1455768-F
  misc_feature: Encodes the peptide sequence at SEQ ID NO. 47725
aaagctggagctccccgcggtggcggccgctctagaactagtggatcccccgggctgcaggaattcgtctcacccctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtgcggctggccgtggccacgccggtgttcctgatcttcagccccgtgctcgtccccgccgcgctgctcatcggggacgccgtcatggggttcctcacgtcgggcgcgctggggctcgggggcctgtcctcgctcacgtgcctcgccaacacggcgcgggcaggcgttccagcgcaccccggactacgtgggagaaggcccaccccaggaatggcggaggcccccggcgcaaccccggccccaagaacggcgcaaggcaggccaaggccatccagggcaagggcccaggaaggcccgcccccggggggaagtgcaaggtgcccggcccctggccggcggccggaagggccttc

SEQ ID NO: 47725 - protein, 190 aa, Zea mays
  misc_feature: Ceres CLONE 1455768-F
  misc_feature (44)..(151): Pfam Name: Oleosin Pfam Description: Oleosin
  misc_feature: SWISSPROT Homolog: EC 6.1.1.16 Cysteine--tRNA ligase
MADRDRSGIYGGAHATYGQQQQQGGGGRPMGEQVKGMLHDKGPTASQALTVVTLFPLGGLLLVLSGLALTASVVRLAVATPVFLIFSPVLVPAALLIGDAVMGFLTSGALGLGGLSSLTCLANTARAGVPAHPGLRGRRPTPGMAEAPGATPAPRTAQGRPRPSRARAQEGPPPGGSARCPAPGRRPEGP

SEQ ID NO: 47726 - DNA, 772 bp, Zea mays
  misc_feature: Ceres CLONE 1455769-F
  misc_feature (378)..(378): n is a, c, t, g, unknown, or other
  misc_feature (411)..(411): n is a, c, t, g, unknown, or other
  misc_feature (412)..(412): n is a, c, t, g, unknown, or other
  misc_feature (425)..(425): n is a, c, t, g, unknown, or other
  misc_feature (428)..(428): n is a, c, t, g, unknown, or other
atagctggagctccccgcggtggcggccgctcttgaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttgtgggtgaanggcgtgcgcgtgaactatgaatgtatgagcccnnccgattcccaacngantgaatactatgctaagctgaggagctgcatccacatcatcctgctggagcgcgagggaggcttcttttatcggaaagccctccttggtcaccgacgcaatcagggcacccccccaagccggggactacccctgggtttggctttgccatgagaacaaccgcttggtttggccttaacccatatccacacctatagaaaccaataagcttttataatcacaatggaacaaccctccctccaaaacaaaggatggcctcttgtccatagctctgtataaaaccgctccttaaaaaaaaaaaaaataaccgaaatcccttcaagggtctcccattcgtgtccgtttt

SEQ ID NO: 47727 - DNA, 762 bp, Zea mays
  misc_feature: Ceres CLONE 1455770-F
tggagctccccgcggtggcggccgctctagactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcattttttggaagcttctgaaagcatggcgtgcgcgtgaactaatgatgtatgattctctccccaccccacctgtttgagactatgctaaacctaaggaactgccttcccattcttgttgtgaaccccaagggaggcctcctttatggaaaagccttccttgtccccaaacaaattaggggacccccccaaacccgggaacacccctggggtttggccttttgcataaaaaccacccctgtttttttccaaaacccattccccacccaaagaaaacaagtcttttttaaccccagggttcccctccccccaaaaaattgggtcccctttttaaaagggccggaaaaacccctcctaaaaaaaaaaaaaaaaaaaaggccgcggggccccacatcccccataaggggggcttatcc

SEQ ID NO: 47728 - DNA, 709 bp, Zea mays
  misc_feature: Ceres CLONE 1455772-F
  misc_feature (462)..(462): n is a, c, t, g, unknown, or other
  misc_feature (709)..(709): n is a, c, t, g, unknown, or other
ctccccgcggtggcggccgctctagaactagtggatcccccgggctgcaggaattcgtctcacccctaatcgaaaagaattaacacatacagaggagagtcacaacacaaatccgaagaagccggagagtgaaaaaaaatggcagcgacgactctttccatcgcaaccacaatccgctcctcctctcacctcactcccgcttctccccatgtcttcccttcccgaccaaacacaaccgcatttccctttcgcctcggttcatcttctccgacactaacccaccgtgcaacccacctccgtcccatatccgccgtcgaggccccggagaaaatcgagaagatcggatccgaaatctcgtccctcactctcgaagaagcacgcatcctcgtcgactacctccagcacaaattcggcgtctcgccgctctccttagctcccgctgcagcggctgtggctgctccnggaaacggtggcggtgcggccgctgcgttgaagaccacaacgaattcgatgttggcatcaaccaaaccccaacaagggccgtatcggggatcaaaggggtaggggctttaactacttggctttaaggaacccaaaggatttaccaagggtcccaaaaaggttaaaaaggggggaccaaagggaaccttaaaaaccaaaaccccttaaaaaatggcccaaggttccatcctaaagggttttttttttn

SEQ ID NO: 47729 - DNA, 749 bp, Zea mays
  misc_feature: Ceres CLONE 1455781-F
  misc_feature: Encodes the peptide sequence at SEQ ID NO. 47730
ctggagctccccgcggtggcggccgctctagaactagtggatcccccgggctgcaggaattcgcacgagaccattacctagaacatcctaatcgaaaaatccaaatcagttccgtcacgtctcttcctctcccgtctccgcagacgcctcccttttcttctcactccactccgccgcccggattcagagcgagaggaggcggagagggcggacatggcggcgatgttggtgggcgcgctgcggaggggaagtggatgccgcggcggcttgcgccttatcgctcattcgcttcgcagattcgtgagcacgctcgtcgtagcggagcacgaaggcgggttcgtcaagccgtcgtcgctgagcgcattggccgccgcggaggccattgccaaggacaacaaagtttctgtcctgctgggtggttccgggccggcgcttcacaaggccgccgaccatgccgcgtgcagccatccactggtgtctgaggtgctcgtggccgattcggaagccttggcgcatcctctggctgaaccctgggccgagctactccgttccgttcagcagaaaggaggctactctcatgtcatagcttcatccacatcattcgggaagaatttgcttccacgtgctgcggctctccttgatgtgtcccctggtactgatgtcaccgctgtaaaggagccacacgtctttgtgaggtctgggtatctgctgtttagctgggaaccgtagcatttttattaagtacctag

SEQ ID NO: 47730 - protein, 171 aa, Zea mays
  misc_feature: Ceres CLONE 1455781-F
  misc_feature (31)..(172): Pfam Name: ETF Pfam Description: Electron transfer flavoprotein domain
MAAMLVGALRRGSGCRGGLRLIAHSLRRFVSTLVVAEHEGGFVKPSSLSALAAAEAIAKDNKVSVLLGGSGPALHKAADHAACSHPLVSEVLVADSEALAHPLAEPWAELLRSVQQKGGYSHVIASSTSFGKNLLPRAAALLDVSPGTDVTAVKEPHVFVRSGYLLFSWEP

SEQ ID NO: 47731 - DNA, 729 bp, Zea mays
  misc_feature: Ceres CLONE 1455784-F
  misc_feature: Encodes the peptide sequence at SEQ ID NO. 47732
  misc_feature (589)..(589): n is a, c, t, g, unknown, or other
aaagctggagctccccgcggtggcggccgctctagaactagtggatcccccgggctgcaggaattcgcacgagaccattacctagaacatcctaatcgaaaacactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgaagggcgggttccaaggcggccgccggagctgaaaacggcgggtgcaagtgcggcggcaacttgccagtgcgacccctgcaacctgcggcaagtgagctaggtgctccacccctgcaggccggccggaagaagctagctaattattataagctaaataaagtatagcggcgtccgctgtgtgtgtttcgagtcagtcagtcagttagttgcgtgccatggctggcatgctcctgagtctgaaatgatgatgatgcctgatgngcggcgtcctgtcctgtagtcctcccctgccccctcgggcgcttctggcggcgaacagtgtgttgtgttgtggttgtgtgggtgcagcacggtagcaggctagccatgtgccctgcctgtgttgtgtcaccatccatcta

SEQ ID NO: 47732 - protein, 85 aa, Zea mays
  misc_feature: Ceres CLONE 1455784-F
  misc_feature (1)..(81): Pfam Name: Metallothio_2 Pfam Description: Metallothionein
MSCCGGNCGCGSGCKCGNGCGGCSKMYPDMAEQVTTTTQALIMGVAPSKGHAEGRVPRRPPELKTAGASAAATCQCDPCNLRQVS

SEQ ID NO: 47733 - DNA, 726 bp, Zea mays
  misc_feature: Ceres CLONE 1455785-F
  misc_feature: Encodes the peptide sequence at SEQ ID NO. 47734
ggagctccccgcggtggcggccgctctagaactagtggatcccccgggctgcaggaattcgcacgagaccattacctagaacatcctaatcgaaaaataggaataggagcaactaaccaccggcctctcgctccctcgctgcgccataaggctgcgactgcgagagccagccgcacccgcaccagtccataggccggcctcctctcttaccttcccacaccccttctcgaccgtacgtagcctagttgtgcttggtagccagccagaaggtcgtcggccgatgatgggaggaagaacagtggccccgccgctcgtcctcgcgctggtgaccatcatcgccatcgcggcggccgagggggacgaggtgaagtgtggcgggtgctctccgtgcggcggcgccgactgcccggtgctgtacccgtcgccgcccccaccgacgtactactactacagccctcccccacccgcgacctaccccggggagtcctcgtcatactaccagccggcgccgccgggcgcgtacatccagatccggagcgcggcgccgggcaaggggccggctgtacccgcaggacccagggttcattccggccggggcggccgggccgggccccgcccctctggggtcgtccttgccttcgcgccggggttgccctggcccagggccctaatgggaaccccaatgggcttgacttgaaaaagccagggaaactggttttttttcgg

SEQ ID NO: 47734 - protein, 138 aa, Zea mays
  misc_feature: Ceres CLONE 1455785-F
MMGGRTVAPPLVLALVTIIAIAAAEGDEVKCGGCSPCGGADCPVLYPSPPPPTYYYYSPPPPATYPGESSSYYQPAPPGAYIQIRSAAPGKGPAVPAGPRVHSGRGGRAGPRPSGVVLAFAPGLPWPRALMGTPMGLT

SEQ ID NO: 47735 - DNA, 702 bp, Zea mays
  misc_feature: Ceres CLONE 1455792-F
ggagctccccgcggtggcggccgctctagaactagtggatcccccgggctgcaggaattcgcacgagaccattacctagaacatcctaatcgaaaaaaaaaaactcttgttttgtactcaatcgtcgtcgtgtacgccaaagataggaagagcagagcgcaaggatgccggctagcctggtgacgtcgtcgctcctcccgccgtgccgcgcggccgcgacgtcggcgcgcgcgttgcgttcgttcgcccgccggccgccgccttcgtccgccggtctcgtccgcgtgcgctgccacgctgccactccgccgccgccggaggtcccgggccagacgacgccgcccgaggtgcctggcacggaccgccagccgctcgaggtgccggggacgaaccgcccgccggacgaggtgccgagcatcgacacgccgccagagttcaacgcgccgccgggcgtcgacgtgccgatgccggggcagccagcgcccggaccggagctcccgggtccggcgatgccgtcgccgccggcgccggaggtccctgtcgtgccgcccaaccccgacgtaccgccgccacagctcccggaggtggacccgcccagtccgccgcccgaggtcgtcccgccggagccgccaggcaccgcgacggcgccgcctccctttgtgtagctccgtggctccgccgccgtcgatggcgcgggccggt

SEQ ID NO: 47736 - DNA, 735 bp, Zea mays
  misc_feature: Ceres CLONE 1455794-F
  misc_feature: Encodes the peptide sequence at SEQ ID NO. 47737
  misc_feature (456)..(456): n is a, c, t, g, unknown, or other
  misc_feature (457)..(457): n is a, c, t, g, unknown, or other
  misc_feature (463)..(463): n is a, c, t, g, unknown, or other
  misc_feature (510)..(510): n is a, c, t, g, unknown, or other
  misc_feature (514)..(514): n is a, c, t, g, unknown, or other
  misc_feature (557)..(557): n is a, c, t, g, unknown, or other
ggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcannctacgncagctctttcaccctgagcagctcatcagtgggaaaggaggatgcancccnacactttgcccggggtcactacaccattggcaaggagattgtngacctatgccctgatcgcatcaggaaagctggccgaaactggcctgggctcccagggcttcttcttcttaaccctgttgggggaagaacgggtctggcctttggtccctctcccaaaggccctggtttgttacaacggaaaaaaccaagctggggtcaccgggaccccttcccccaat

SEQ ID NO: 47737 - protein, 119 aa, Zea mays
  misc_feature: Ceres CLONE 1455794-F
  misc_feature (82)..(82): Xaa is any aa, unknown, or other
  misc_feature (100)..(100): Xaa is any aa, unknown, or other
  misc_feature (116)..(116): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGXLRQLFHPEQLISGKGGCXPTLCPGSLHHWQGDCXPMP

SEQ ID NO: 47738 - DNA, 803 bp, Zea mays
  misc_feature: Ceres CLONE 1455806-F
  misc_feature: Encodes the peptide sequence at SEQ ID NO. 47739
  misc_feature (662)..(662): n is a, c, t, g, unknown, or other
  misc_feature (735)..(735): n is a, c, t, g, unknown, or other
ttaactagtggatcccccgggctgcaggatttcccacgagaccattacctagaacatcctaatcgaaaaagtactctctccagtgtccacagaaacagaattccgctccctccccgtgtcctcctcccgcgcccgcgcatcgtgaggtggagttcccaccccgaggccgcaatggcgacggtggaggtggtggtggccaacggcttgggtggcgccgacaccaagaccgtgtttaaggaaacatacagcaagctcaaggaggagatgctagacgaccccgccttcgagttcaccgacgagtcgctacagtggatcgaccgcatgttgaactaccatgttgcccgaaggaaagtgcaatcggggggttcttctgcctttggttaccccccccctaattaaagggggttgatgtttcttgagcaaggaggaaaaaattttcttcgctgcgcccctttcgctcgcgggctttgaaaggggcttccaaggttatattttttttgagcctttgagagaatattttgggagaaaatttctcaaaaacccgcgggtgtggcccaaccttgtctggggtttacaatggccccaaggggtgggcccctctttggtgtggaaatgtgggggaattttcccttccaaattctttttttcaaaaaatttctctnacccccctttttggggggaaacccctttttgtgggggagggtgttgcgctcttcatagggggtgggatctaanacccctctccgccacatttttctatttttccccccgccgggggggggaggtgtctctctactcctccg

SEQ ID NO: 47739 - protein, 75 aa, Zea mays
  misc_feature: Ceres CLONE 1455806-F
  misc_feature: SWISSPROT Homolog: EC 2.5.1.67 Chrysanthemyl diphosphate synthase
MATVEVVVANGLGGADTKTVFKETYSKLKEEMLDDPAFEFTDESLQWIDRMLNYHVARRKVQSGGSSAFGYPPPN

SEQ ID NO: 47740 - DNA, 747 bp, Zea mays
  misc_feature: Ceres CLONE 1455807-F
  misc_feature: Encodes the peptide sequence at SEQ ID NO. 47741
  misc_feature (338)..(338): n is a, c, t, g, unknown, or other
  misc_feature (395)..(395): n is a, c, t, g, unknown, or other
  misc_feature (471)..(471): n is a, c, t, g, unknown, or other
aagctggagctccccgcggtggcggccgctctagaactagtggatcccccgggctgcaggaattcgcacgagaccattacctagaacatcctaatcgaaaaaagcctcagtccaatccgcggcccaaaaactccccccgacaaccgaacaggagcggcggcggcggcggcactaccctctccagcaatcggcatgggcacgcgggaggtgtacgaggagaagctccgcagcggtgcgcacctccaccgcgatcccaccatcaacccaggcctcggctcgccccggtgcccgcgatgcctctccctcctcaaccccaccgcgggaaagagggactgggncatcacctccgtcctgcacgacgccactgccgtggctgggtccggtgccggcgcttngctcagtgctgtgcacgggttaaacacaggaatcccttttgtccaaaaccatgtccaggggccaaagtgcctgcanttgctccttggggggccccccctgctgaattccccaggggccagggggaatttggggaaatgcccttccaagggttgttcatggaaggggactttttaatccgggaaaaaagggtctccaaaagggttttcaaaattccccgggaaaaaaaaaagcctttttttcaaaaaccccccaaaaaataaggggggggggggggacccccccttcttgggggggggccgtccctgttaaaaaagaggttttggggcttttttcgggggaagaaaaaaataa

SEQ ID NO: 47741 - protein, 125 aa, Zea mays
  misc_feature: Ceres CLONE 1455807-F
  misc_feature (49)..(49): Xaa is any aa, unknown, or other
  misc_feature (68)..(68): Xaa is any aa, unknown, or other
  misc_feature (93)..(93): Xaa is any aa, unknown, or other
MGTREVYEEKLRSGAHLHRDPTINPGLGSPRCPRCLSLLNPTAGKRDWXITSVLHDATAVAGSGAGAXLSAVHGLNTGIPFVQNHVQGPKCLXLLLGGPPLLNSPGARGNLGKCPSKGCSWKGTF

SEQ ID NO: 47742 - DNA, 741 bp, Zea mays
  misc_feature: Ceres CLONE 1455809-F
  misc_feature: Translation starting site: 182
  misc_feature (244)..(244): n is a, c, t, g, unknown, or other
  misc_feature (310)..(310): n is a, c, t, g, unknown, or other
  misc_feature (355)..(355): n is a, c, t, g, unknown, or other
  misc_feature (378)..(378): n is a, c, t, g, unknown, or other
ggagctccccgcggtggcggccgctctagaactagtggatcccccgggctgcaggaattcgcacgagaccattacctagaacatcctaatcgaaaagggtttcttcggaggctttatttatcgtttatccacggaacttccggtgccggcggcgaccacttgtggcgatccatccctcaccatgtcgtcggagaaggaggcggcgctcgccgccgtgctcgatgacagcccaaccatatttgancagatcatcaaaaggaaataccttctactgtggttttatgagacgagaaggtactggctttcaggnacattaaccccctcagctccacacacattctcatcatccccaaangtcaggatgggactactggcctngcaaaggctgaaaaaaagcccataaaaatactttgcttatccctccatgtttgccaagtttgtttccaaaccgggagggactttaaaaaggttttccccccctcctcaaggaccggccaggggagatccattcgtttcccaatccccttttccttccccggaagggggaaaataaacgggcccccccgctaaaaaaatttttggtattaaaaggggtaaaacccaaggaccgcctccccctttttcttaaaaaaaccccgcgtgattttccaaaaaaagggtggggcccggggcccgcccctttgttatttttttgggaaaaaccccaagaaacgtgttgtttttgtttttttatttaaaaaa

SEQ ID NO: 47743 - DNA, 720 bp, Zea mays
  misc_feature: Ceres CLONE 1455810-F
  misc_feature: Encodes the peptide sequence at SEQ ID NO. 47744
gatcccccgggctgcaggaattcgcacgagaccattacctagaacatcctaatcgaaaagcgttcaccccctctttctctcgtggcgacgacggcgaccgtcgccttcccctacgcgctaggtgccagggtccgtcgggtccttcgctggcgacgagcaactaccaggcaacctagtggtgtgttcgggaacgttttcgcgggcgggcggcggccccaagtggcgaagatgatccgactaccgacgtatgcagcaggaggcgtccgttgccatcttcttctcctttgagtatatgatactagcaacatccacattatcaacattcgtgaaccacatattctatgttagtgacatgctaatggaaggtttaccccccccaaaggcagtgtatacattttacttggttcgtgagctatacgtgactccccgcaacttcagaattcgcattgcaaattatgtgcgctacagaaagatcacttccaacatgaatgaacgctttccagatgctacatcagaaggagctccatgggagtgatgctacatgtattattttgccgtgaggaaatggctacagcaaaaaaactgctccaaggggctctgtttccctgtgcattgtcttaagacaaacaggggaaacacgcctaaagaagaaggtcctcctacagctttttccatgggagcttcacctctcacatggagggattctcctctactgggaag

SEQ ID NO: 47744 - protein, 95 aa, Zea mays
  misc_feature: Ceres CLONE 1455810-F
MQQEASVAIFFSFEYMILATSTLSTFVNHIFYVSDMLMEGLPPPKAVYTFYLVRELYVTPRNFRIRIANYVRYRKITSNMNERFPDATSEGAPWE

SEQ ID NO: 47745 - DNA, 691 bp, Zea mays
  misc_feature: Ceres CLONE 1455814-F
  misc_feature: Encodes the peptide sequence at SEQ ID NO. 47746
aagctggagctccccgcggtggcggccgctctagaactagtggatcccccgggctgcaggaattcgcacgagaccattacctagaacatcctaatcgaaaaagaccatagcctgcagccttccctcatctaactcccgttctccgtttccagccatggcggtgtcgatcgagctcacccccgagtacggataacttcatgctggagctggtgccctatgacatcatcccccttgggatggacatcctccccagcgaggcccgaccaaggtccagggtgttctaccccaccatgatcaccatcaagacggagaacacggacgccatcctcttcttctgggggtgaagggggccccccaactctctagagtggatgcccgtgttctgcggattactgctgctggcctcactgacatccccgaccatctccgccggtctggctcgaatctccatcggcacgaggttcttctactttcacgtatacgccacattgcgatcccgacagacgctctcagcattgcggagatctgctacatggcgcttgcttggactgatcatttgctgagcatcattccgcctcctcctgcacttcagggagaagctcgagaccctggcttgatatgtgagccccaagcggggttacacgcacaggttactcagggtctgagcatcatcacatcgtgatactacgcg

SEQ ID NO: 47746 - protein, 63 aa, Zea mays
  misc_feature: Ceres CLONE 1455814-F
MPVFCGLLLLASLTSPTISAGLARISIGTRFFYFHVYATLRSRQTLSALRRSATWRLLGLIIC

SEQ ID NO: 47747 - DNA, 706 bp, Zea mays
  misc_feature: Ceres CLONE 1455818-F
  misc_feature: Encodes the peptide sequence at SEQ ID NO. 47748
aaagctggagctccccgcggtggcggccgctctagaactagtggatcccccgggctgcaggaattcgcacgagaccattacctagaacatcctaatcgaaaagaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatggtggtggcggcgatgcggcggccgtgcgctgtgccagcgctgctggtggcggcggcgacggcgacgctagcgcttctgctgctgctgtcaccgtcgagcgcgcagccgatgccgtcgtccccggcggcggcgccgggccccgcgggcgggaccgggatcgactcggcgtgcctgaactcgctgctcaacatgtcggactgcctcccgtacgtgagccaggggagcacggcgcggcgccccgacgcgccctgctgcccggagctggcgggcctcgtcggctccaaccccgtctgcctctgcgagctcctctccggcgccgccgactcctacggcatcgccgtcgactacggccgcgcgctcgcgctccccggggtctgccgcgtcgccaccccgcccgtctccacctgcacagcgctcgggt

SEQ ID NO: 47748 - protein, 141 aa, Zea mays
  misc_feature: Ceres CLONE 1455818-F
  misc_feature (58)..(137): Pfam Name: Tryp_alpha_amyl Pfam Description: Protease inhibitor/seed storage/LTP family
MVVAAMRRPCAVPALLVAAATATLALLLLLSPSSAQPMPSSPAAAPGPAGGTGIDSACLNSLLNMSDCLPYVSQGSTARRPDAPCCPELAGLVGSNPVCLCELLSGAADSYGIAVDYGRALALPGVCRVATPPVSTCTALG

SEQ ID NO: 47749 - DNA, 698 bp, Zea mays
  misc_feature: Ceres CLONE 1455822-F
  misc_feature: Encodes the peptide sequence at SEQ ID NO. 47750
aagctggagctccccgcggtggcggccgctctagaactagtggatcccccgggctgcaggaattcgcacgagaccattacctagaacatcctaatcgaaaaatttccgtacgccgtacttccccagacacactcaaccaggggttttgctagggttctcatcctgccgccacagcgatggccgctgctgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctagggaacaaccggttcgcggaggtccaggagctcgcgccactcgccggggtccgggtcgagtcgctcgacctgttccagtgccccgtcaccaaggtcaaggggtacagggatgaggtcttcgcgctgattcccagcctcaagtacctcgatggcgctgacgctgagggcaacgagcgtttggagacggatgac

SEQ ID NO: 47750 - protein, 174 aa, Zea mays
  misc_feature: Ceres CLONE 1455822-F
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLGNNRFAEVQELAPLAGVRVESLDLFQCPVTKVKGYRDEVFALIPSLKYLDGADAEGNERLETDD

SEQ ID NO: 47751 - DNA, 878 bp, Zea mays
  misc_feature: Ceres CLONE 1455831-F
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
tatatataaaacccccacaaaaacaaanncnaaccaaaaaaaacaaatactagaactccaccgcgggggcggccgctctaaaactagtggatcccccgggctgcaggaattcgcacgagaccattacctacaacatcctaatcgaaaaaaaaaatctcgcctgccatctcgcggtccagccccgtcgttcacctcaatctccacgcgtcaccgccgccttccggcgagtctattcccctccgccacgccgtcgaagctttccagaccccgcagcggatcggataaggcggccgcccgccacccgccctcgcttcggccccactcatctcggccccaggaccgctacggggtggatctagggttgcatgcggaggggttctggaaacctccgccgcgatggacgagggggatgatgatgtttgcaccttcaaggggggattaataagattatagaaaaacccccgattccgaaaaaaaaaaagaagaaattgctcgggttcacgtaggggcacagcaacgaaaccatccttgaatataggatatcaatagaaccaagctctcccgactgcgacagctatcttggacccttaaagggtatggattggcggtttgttaagtggtacttaaaggagtgtcatctggctagtaatgcgagtatataatgaatttctggtatcaaacgacaatttatacggatgttacacatctcccttcaagcgaactatgctaaggtacttaattaagtgccgcaggagcgcaggtatacagagtgttgtacacccagcgaattagacggttcgactcgaactcagatcaagagagagaaatagttttatagctccgctatagtggatatcagatgcctggatgtttgtttg

SEQ ID NO: 47752 - DNA, 722 bp, Zea mays
  misc_feature: Ceres CLONE 1455833-F
  misc_feature: Encodes the peptide sequence at SEQ ID NO. 47753
  misc_feature (412)..(412): n is a, c, t, g, unknown, or other
  misc_feature (503)..(503): n is a, c, t, g, unknown, or other
ggagctccccgcggtggcggccgctctagaactagtggatcccccgggctgcaggaattcgcacgagaccattacctagaacatcctaatcgaaaaagcaagcgccgcatccctcgcctcttcccgacttcccccctcgattcgatccgagctcacttctagggttcttggccccgctccaccgtcgcccatggcagacgatgccaaccgagcggccttcatggagctgcagtcccggatgatagataccaccgcgaagatcaagcagttacaaacccaaatgcgttctaaagaaggggaaaagaagcgtgcctaccttactttggaggaacttcgccagttgccagatgataccaacacctacaagactgtcggaaaagtgtttattctggagccgaagtcagttctgttncatgagcagggagcaaagcttaatgacagtgagagtgcgatagctttcatgcagacatccaaagactacctggagaaacagcagggcgaantggagacaatattagggagctgctttcacagaccccagacttgcccgtcaatcctcccaatgaccgttcaatgaaagttgtttttcccccctttaatttttaaaaaaatggaatggcccatttggaccacccggctggggccttgccttaccggaaaaattgggcggccttaattttccaaaggttttgctggggaaaaaagaggcccccccctttccc

SEQ ID NO: 47753 - protein, 128 aa, Zea mays
  misc_feature: Ceres CLONE 1455833-F
  misc_feature (11)..(116): Pfam Name: Prefoldin_2 Pfam Description: Prefoldin subunit
  misc_feature (74)..(74): Xaa is any aa, unknown, or other
  misc_feature (105)..(105): Xaa is any aa, unknown, or other
MADDANRAAFMELQSRMIDTTAKIKQLQTQMRSKEGEKKRAYLTLEELRQLPDDTNTYKTVGKVFILEPKSVLXHEQGAKLNDSESAIAFMQTSKDYLEKQQGEXETILGSCFHRPQTCPSILPMTVQ

SEQ ID NO: 47754 - DNA, 695 bp, Zea mays
  misc_feature: Ceres CLONE 1455834-F
  misc_feature: Encodes the peptide sequence at SEQ ID NO. 47755
  misc_feature (275)..(275): n is a, c, t, g, unknown, or other
  misc_feature (283)..(283): n is a, c, t, g, unknown, or other
  misc_feature (297)..(297): n is a, c, t, g, unknown, or other
  misc_feature (368)..(368): n is a, c, t, g, unknown, or other
aaagctggagctccccgcggtggcggccgctctagaactagtggatcccccgggctgcaggaattcgcacgagaccattacctagaacatcctaatcgaaaagcatttccatcctgtcgtgggatcccagccaccgccgctagaagaagagctcggcgattcccaggtcccgcgagaagatgccgaagcagatctatgagattaaggacttcctcctcaccgcgaggaggaaggatgcccgctcagtgaaagatcagagggagcaggatgttgtncagttcanggtgcgctgctccnagtacttgtacacgctctgcgtcttcgatgctgagaaggcaaacaggtgaagcaatctcttccccaggttngaccgtcgaggagtctgaatggatacttggcacccgccgggtgaactaccccagcttcttattcgaagcaaaggctgctaccttgtccttttggaaccaaacctattaaacctgccagggttggagggtggaactctgcatttttgtgggaaaaacccaattaccccgtgcaggggggccccttccaaaaatttccgtgtgaaggcgcctttttttaaaattttgccgggtccaaaaaaaaaaaaaaaaattttttccttcccccccccctggggggggggcgggggcaaatttcccctaaggggggggtataaccccccgccttgg

SEQ ID NO: 47755 - protein, 55 aa, Zea mays
  misc_feature: Ceres CLONE 1455834-F
  misc_feature (2)..(56): Pfam Name: Ribosomal_L38e Pfam Description: Ribosomal L38e protein family
  misc_feature (35)..(35): Xaa is any aa, unknown, or other
  misc_feature (40)..(40): Xaa is any aa, unknown, or other
MPKQIYEIKDFLLTARRKDARSVKDQREQDVVQFXVRCSXYLYTLCVFDAEKANR

SEQ ID NO: 47756 - DNA, 822 bp, Zea mays
  misc_feature: Ceres CLONE 1455835-F
  misc_feature: Encodes the peptide sequence at SEQ ID NO. 47757
  misc_feature (363)..(363): n is a, c, t, g, unknown, or other
  misc_feature (364)..(364): n is a, c, t, g, unknown, or other
  misc_feature (367)..(367): n is a, c, t, g, unknown, or other
tccccgcggtggcggccgctctattactagtggatcccccgggctgcaggaattcgcacgagaccattacctagaacatcctaatcgaaaagtcaccacaccaccgtctcgcggagaaactcctccaaaacccccaaaccctttcaatcggcggcaatggcggcgccggcggccgacgatgcctcggcatccccaggctacgtcctccgctccacacttgaggggcaccgccgcgccgtatcaaccgttaagttctccccggatggccgccttctcgcctccgcctccgccgacaagcttcttcgcgtgtggtcttcctccgatctcacccccgttgcggagctcgagggccatggagagggnnacncaaacctctctttctcccccgatgggcggcttttttgcccccccccaccgatgagtcgcaccggtccgcatcgtgggacctctcccttcagcgtgaggggccccgcctcctccaagaagcttcacgcgaccacaacaagataagtcctttctggggtcttcttttcaacccctcatggcatactttctatgtgttcttgtgtacctataaacaaacacccgtgcctcggtgtcggtaacactccaggcccaggtaaaggtgccattcgggtttgttgtcccgccccaattttgaaacctcgtactctgtccttgtgactttcggtcccgtggggggctcaaataaaactcgtgtcctgggattcatttacacgcgatcccccgaccagtacgtggccaaacaaaacaaggggatcacatggaaataaaaacgcctctatcagcccatctagatgt

SEQ ID NO: 47757 - protein, 117 aa, Zea mays
  misc_feature: Ceres CLONE 1455835-F
  misc_feature (15)..(53): Pfam Name: WD40 Pfam Description: WD domain, G-beta repeat
  misc_feature (70)..(70): Xaa is any aa, unknown, or other
  misc_feature (71)..(71): Xaa is any aa, unknown, or other
MAAPAADDASASPGYVLRSTLEGHRRAVSTVKFSPDGRLLASASADKLLRVWSSSDLTPVAELEGHGEGXXNLSFSPDGRLFCPPPPMSRTGPHRGTSPFSVRGPASSKKLHATTTR

SEQ ID NO: 47758 - DNA, 771 bp, Zea mays
  misc_feature: Ceres CLONE 1455836-F
  misc_feature: Encodes the peptide sequence at SEQ ID NO. 47759
  misc_feature (398)..(398): n is a, c, t, g, unknown, or other
  misc_feature (407)..(407): n is a, c, t, g, unknown, or other
  misc_feature (412)..(412): n is a, c, t, g, unknown, or other
tggagctccccgcggtggcggccgctctagaactagtggatcccccgggctgcaggaattcgcacgagaccattacctagaacatcctaatcgaaaactccactcgctctcccacacagaaaaccctagccgccgccaccgaagcggcctcccaggtaagcaggatcgtccagcccgccgccgccatgaagcgcaatccccgcgtcacgagctcccgccggaagtgccgcaaggcgcactttacggccccgtcctccgtccgccgtgttctcatgtccgccgggctgtcgacggagctccgccacaagtacaacgtgcgctccatcccgatccgcaaggacgacgaggtgcaggtcgtgcgcggcacctacaagggccgtgaggggaaggtggtgcangtgtaccgncgccnccgggtcatccacgtcgagcggattcaccgcgaggaggtaaacggctcaacgtggacctgggcatcacccctccaagtggatcgtccccagctgaacccccacaagacccgaaggcgctctctcaccccaagggccgggcccccccccaaaaagggtaagggaaattttatgggaaaaaaatccccccccccccccttggggggcccccaccgggcctttttcaggagaaaaaaaaaactctttccgggtatttaattggtgcccaccccctttccccacccccttatttttgcccccaatgtgttgggaaaagggtcttttttttaaaaaaaccgcccccgccaaaaaaaaatttaag

SEQ ID NO: 47759 - protein, 160 aa, Zea mays
  misc_feature: Ceres CLONE 1455836-F
  misc_feature (51)..(82): Pfam Name: KOW Pfam Description: KOW motif
  misc_feature (71)..(71): Xaa is any aa, unknown, or other
  misc_feature (76)..(76): Xaa is any aa, unknown, or other
MKRNPRVTSSRRKCRKAHFTAPSSVRRVLMSAGLSTELRHKYNVRSIPIRKDDEVQVVRGTYKGREGKVVXVYRRXRVIHVERIHREEVNGSTWTWASPLQVDRPQLNPHKTRRRSLTPRAGPPPKKGKGNFMGKKSPPPPLGGPHRAFFRRKKKLFPGI

SEQ ID NO: 47760 - DNA, 730 bp, Zea mays
  misc_feature: Ceres CLONE 1455840-F
  misc_feature (422)..(422): n is a, c, t, g, unknown, or other
gcggtggcggccgctctagaactagtggatcccccgggctgcaggaattcgcacgagaccattacctagaacatcctaatcgaaaaatctcaaagatctcagccgccgtcgtctccgtcgctccgccgcacctccccccatcaccgcctctctaaaaccctaatccctagccgccatggcggctgttgcggcggccacctcgcacctcctacgccaccaccgcaacccccaccttctcctcctccgcgcagcgatctcatcctcccgtgctttgccccagcagccggagctgtcccccgacccgaccgccggcacccccgacctcgccggcgcggccccactccctccaaaccccagcacggggagccccttctacaccccagactggcgcaaccccagccggcgcaacccgccctctttgnttctgcccaacgtcgtcgccggcagcccccttcgggcggcgcaacttatggccggccttctacaatgcacccaacgtcacggggcttcaggagaccttccccaaaaaaatggggggaaacaccgggggaaaaaaatgaacccatcggttcacacccgggggggccccccccagaccccgcccggggaaaaccaaaccccccgaaagggaacccttttaaaaccaaacccgccgccaaaacctaaaaaaagggccctgtcccaaaaaaatttctttcttcctaaacaagtgggcggagggggccccccc

SEQ ID NO: 47761 - DNA, 724 bp, Zea mays
  misc_feature: Ceres CLONE 1455855-F
  misc_feature (317)..(317): n is a, c, t, g, unknown, or other
  misc_feature (356)..(356): n is a, c, t, g, unknown, or other
  misc_feature (357)..(357): n is a, c, t, g, unknown, or other
  misc_feature (366)..(366): n is a, c, t, g, unknown, or other
  misc_feature (369)..(369): n is a, c, t, g, unknown, or other
aaagctggagctccccgcggtggcggccgctctagaactagtggatcccccgggctgcaggaattcgcacgagaccattacctagaacatcctaatcgaaaacccgttttctcgcctcgcggtctcgcccctcgcacccgcccctcagctcccatgggctctcgccgtcgctgacactggggcccaacgctctcccccgcgtccgcgcccgcctcctccccctcaccctcctcctcctcttgttgcctccactgactctagccgaccgcccccgcccaccgacatcggaagccctagctgctgcaggaactgccctngcggccccgcgctcctccgctcgaagcgtctccgggttnnctggatgcnacngctgctccgatggctgcctttccgcccgcgcaaaagaccccgaccccgtgaagatccgtgaagtttgggcgaggcacctgaagaggagttcccagggatccgggccttctcgacggtacccgtacgggccatggaaacggaattccccggtttcgggggaacccaaagccaaaacgggttcccttggaaaccgaaatcccccccttgggggaaaaccaaaggggcaaaactctcccggggggcccccccccccccaggggggagggggcccccccccggggaacgggggggggggcccccccttggaatttttttctgggggggttcccccccccccaccctctttttggaggcc

SEQ ID NO: 47762 - DNA, 747 bp, Zea mays
  misc_feature: Ceres CLONE 1455859-F
  misc_feature: Translation starting site: 161
  misc_feature: Pfam Name: LysM Pfam Description: LysM domain
  misc_feature (426)..(426): n is a, c, t, g, unknown, or other
aaagctggagctccccgcggtggcggccgctctagaactagtggatcccccgggctgcaggaattcgcacgagaccattacctagaacatcctaatcgaaaaaaccccacagcagtaacaggggcacactagctaagctaaacctcgccacggcacagcaatggcgccgctccccgcttccctcatgccctgcctctggctcttcctctgcctcctcgccgcgccgtgccccgcggcgcgggcggcgcggttcgcgtgcaacgccacggcgccgcgagcgtccacgtgccaggcgctcgtctcctacgcgccgcccaacgggacggccacgcccacgctcgccgccgtgcgcgcgctcttccagctccgctcccaccgcgcgctgctggccgccaacggcctcccgctctccacgccgcctacggngtctgctccctgtgcgctgcgggtccgcctgccctgcctctgctcggggggcgccggggccacgttcccagcgcccacgtaccgggtcggcgccgggggacacgctcgacgccgtcgcgcggggcgtcttcgcggggcctcgtcacttaccaagacatcgcctgcggcaaaaacgtctccgaacccaaaaaggttcgccgtcggccaacagctttggatccccgggcccttgaattgcaacctcgggggggggcaaccggtcgggaacttaacctaaatcgggcccgccgggggcctcgggtccaaactccggaaaaattt

SEQ ID NO: 47763 - DNA, 691 bp, Zea mays
  misc_feature: Ceres CLONE 1455860-F
  misc_feature: Encodes the peptide sequence at SEQ ID NO. 47764
aaagctggagctccccgcggtggcggccgctctagaactagtggatcccccgggctgcaggaattcgcacgagaccattacctagaacatcctaatcgaaaaaaacacaagctgagatacggcggaaggcaacaagaacggccgccttcgcctccgttcatctctatcccgtgctgcccgtcccccagccacacagggacacatgacaaaacaggaagcactgcctgctcattttcttcctgtgcgcgtacagagatactactagcgagcacgccatggagcaaaccgaggcggcggtgagcggcgcgcttggagcgggagtggaaggtggcgacaagacggcgaggaaggcgctgaaggtggtggcggccgtggacgcgagcgaggagagcctgcacgcgctgtcgtgggcgctggacaacgtcgtgcggtgccacccggacgcgacgctcgtcgtcgttcacgcccagcacgccgccgaccacttcgcctaccccgtcgccgcgcacggcatcgtgtacgccccgtcctcggcggtggagtccgtgcgggcggcgcaggaggagagctcccgcagggtcgtggcgcgcgcgctggacatctgcaaggagaggcaggtggacgccacggggggccgtcgtggagggcgacgccaaggaggccatccgccaggcccgtggagcgtatgcag

SEQ ID NO: 47764 - protein, 138 aa, Zea mays
  misc_feature: Ceres CLONE 1455860-F
MEQTEAAVSGALGAGVEGGDKTARKALKVVAAVDASEESLHALSWALDNVVRCHPDATLVVVHAQHAADHFAYPVAAHGIVYAPSSAVESVRAAQEESSRRVVARALDICKERQVDATGGRRGGRRQGGHPPGPWSVC

SEQ ID NO: 47765 - DNA, 684 bp, Zea mays
  misc_feature: Ceres CLONE 1455862-F
  misc_feature: Encodes the peptide sequence at SEQ ID NO. 47766
aaagctggagctccccgcggtggcggccgctctagaactagtggatcccccgggctgcaggaattcgcacgagaccattacctagaacatcctaatcgaaagccccaccaggaggcacgagccggccccacctctcagccccaacttcacctccgattcgaaatgtcttcctcatcatccgatctcgtcctctacaacctcgtccccgctccccaaaccctaaaccctcccccaccacacgtcaccgccgcccccgatctctccatctccaccgccgtcgcggcggcgccagaacccgtcatccgcggccgggttcgccgcacggtgggctcctcttccgccgaccgccacgccaaggtcgccggccgcggccgccgggtccgcatcccggccatggtggcggcgcgcgtcttccagctcacgcgtgaactcggacaccgcaccgacggagagaccatcgagtggttgctgcgccaggccgagccttccataatcgccgccaccggcaccggtgtcacgaccgaggaggcgccgtcgtctctcgtccccatctcctccatcgcgtcctcagtgtcccttacgccggtcccgtactacaccgcgctcctcatgcaaccaccgcccaccgccaatgagtcccctgtcgcctctgcatccgtatctggcactgttgcggaggagaaa

SEQ ID NO: 47766 - protein, 174 aa, Zea mays
  misc_feature: Ceres CLONE 1455862-F
  misc_feature (41)..(168): Pfam Name: TCP Pfam Description: TCP family transcription factor
MSSSSSDLVLYNLVPAPQTLNPPPPHVTAAPDLSISTAVAAAPEPVIRGRVRRTVGSSSADRHAKVAGRGRRVRIPAMVAARVFQLTRELGHRTDGETIEWLLRQAEPSIIAATGTGVTTEEAPSSLVPISSIASSVSLTPVPYYTALLMQPPPTANESPVASASVSGTVAEEK

SEQ ID NO: 47767 - DNA, 762 bp, Zea mays
  misc_feature: Ceres CLONE 1455886-F
  misc_feature (657)..(657): n is a, c, t, g, unknown, or other
ggagctccccgcggtggcggccgctctataactagtggatcccccgggctgcaggaattcgcacgagaccattacctagaacatcctaatcgaaaagcgcccacaaccaccgccgcgcccacccccactcccgatgtgtccgccccaacgccgatagtcctcgcccctcccctccccgttgcgcccatccatgccccctccgcgcccgcgcctcccctcaaccaccgcaccgagatcgccgccgatctgagctcccctccccgttgcgcccacccatggtcgccgcttcgacttgctgttgctgctgctcctgcacgacgaccactgtcagctacttgcttttgtttcgtagcttcgtagtttttgaagttgtgatacagcaacaagcaattcctattatttcctaccttgaacgaagggaacgacgtggtctgcgcgggcatggtgggcgcgtggaaggagaagtcgttgaaggcgccgccgaccgcagctcggctgtcgtcttgctgagactgagatgcgatcaggtcggcggcctgcttccagtcgaacctctgcgccgggatggcgccggtggtgggcgacgcgaaaaagttcgaggaagagtggagcgggacgggcgagtccagcagctcggcggggctgagcccgggcggnatggagaagtaggaagagggcgacaatcggcggcgcgagaatggcaggctgggcggctgcccggacttggacttggccacgcctacgccgcccgccctggtggcg

SEQ ID NO: 47768 - DNA, 793 bp, Zea mays
  misc_feature: Ceres CLONE 1455891-F
  misc_feature: Encodes the peptide sequence at SEQ ID NO. 47769
ggagctccccgcggtggcggccgctctagaactagtggatcccccgggctgcaggaattcgcacgagaccattacctagaacatcctaatcgaaaaaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgcccaggaggagagggactggagcgcatcgaggaccgaaatcgatgcggggcagtcgaggagctcatcgagggagccgaagaccaactcaagctcatcgctaaaatgattgaatgggatccatggggtggtcccgatgactaccaatgggaggtgattgaaaacaaccccccatttcctaacatgttcctcagcaccggcctgttgctcttccgaagattttctcaggggcctaaaggttgccaatctgaacctgtttttaaaggggatgccccctcccagggaaagggaaaggaggttttttcccggaaaaacctttttcctttttgccccggggggagaggggggtttttttttgtttttttccaaaaaggctgttttttcaaaaaaaaattttttgggggggcacccccagggggttttttttttttgtttttccccaaaaatttttttggcgagaaaaaaacct

SEQ ID NO: 47769 - protein, 231 aa, Zea mays
  misc_feature: Ceres CLONE 1455891-F
  misc_feature (35)..(91): Pfam Name: ETC_C1_NDUFA5 Pfam Description: ETC complex I subunit conserved region
MFLRRILTGGGGLAALRAARAVKETTGIVGLEVVPNAREVLVGLYERTLKEIKAVPEDEGYRKAVESFTGHRLQICPGGEGLERIEDRNRCGAVEELIEGAEDQLKLIAKMIEWDPWGGPDDYQWEVIENNPPFPNMFLSTGLLLFRRFSQGPKGCQSEPVFKGDAPSQGKGKEVFSRKNLFPFCPGGRGGFFFVFFQKGCFFKKKFFGGAPPGGFFFLFFPKNFFGEKKT

SEQ ID NO: 47770 - DNA, 741 bp, Zea mays
  misc_feature: Ceres CLONE 1455897-F
  misc_feature: Translation starting site: 137
ccccgcggtggcggccgctctagaactagtggatcccccgggctgcaggaattcgcacgagaccattacctagaacatcctaatcgaaaaagattcggagcttcggggggaaaaggcaggcacagtatcgtcgaccatgctgccaggtcgccacccggcgcgccgggccgacgccaccgggacggggccgctcctgccggacgccactcgcgcggtggtggcggagttcgtcgccacagccatgttcgtgttcgccgccgaaggctccgtctacggcctctggaagctgtacaaggacacggcaacgccgggcggcctgctcgcggtggccatcgcgcacacgctggcgctggtggccgcggtggcggtagcgagcaacgcgtcgggtgggcacgtcaaccctgcggtcacgttcggcctgctcgtgggccgccgcatctccttcgggcgtgccgcggtatactggctcgcgcagatgctcggcgccgtggtcgcgtcgttgctgctaacgctcgtctccggcggcacgcgtccccgtgggcttcgggctcgtccgcggcgtccacgagcggaacgcgctcctgctagaagccgtcatgacgttcggcctcatgtacgccgtgtaccccaccgcgtgtgaatcccggaaccggggcggccccgtcccaattgcgccccttcgcattggtttttgtctgggggcgaaattcccccccggggggccctttaaaggggccccaa

SEQ ID NO: 47771 - DNA, 758 bp, Zea mays
  misc_feature: Ceres CLONE 1455907-F
  misc_feature: Encodes the peptide sequence at SEQ ID NO. 47772
  misc_feature (371)..(371): n is a, c, t, g, unknown, or other
aagctggagctccccgcggtggcggccgctctataatagtggatcccccgggctgcaggaattcgcacgagaccattacctagaacatcctaatcgaaaatcggcgacgcccttcgccctccaggactccaggccttcactccacgcaacctgttcgcaccggccacagccgccaccggccttcgccgcgagcccgcgacgacgcccagacttggtgccttactaccacggacacggaggcaccaccgcatcaggcagggaccggacgacgacgcccagacctaatacagcctgccggactccccaggcccccagcccccagtggtcacacggtcacaccgtgaggtgttggactgttgaactgaggtggncaccctgtgcaagtgtgagaactgttgaactgagcaccaccaggacaccatgaagcttgacgtgaatgcccttcgctacctcgccaaggacgacttccgtgtcctcaccgccgtccagatgggcatgcgcaaccatgagactgttccagcacaacttattgacaggattgccagattagaacatggaggcacatacagagtgctgaggaatcttttgaggaacaagctggtgcatcatggttgcactaaatacgagggatatcggctcaactatctgggatatgacttccctgccatcaaaactttggttaaacgaagaattttttgcttcagttggccgccagaatggtgatggaaaagagtccaatttttttgaggtaggcccaa

SEQ ID NO: 47772 - protein, 100 aa, Zea mays
  misc_feature: Ceres CLONE 1455907-F
  misc_feature (8)..(89): Pfam Name: Rio2_N Pfam Description: Rio2, N-terminal
  misc_feature: SWISSPROT Homolog: EC 2.7.11.1 Non-specific serine/threonine protein kinase
MKLDVNALRYLAKDDFRVLTAVQMGMRNHETVPAQLIDRIARLEHGGTYRVLRNLLRNKLVHHGCTKYEGYRLNYLGYDFPAIKTLVKRRIFCFSWPPEW

SEQ ID NO: 47773 - DNA, 683 bp, Zea mays
  misc_feature: Ceres CLONE 1455908-F
  misc_feature: Encodes the peptide sequence at SEQ ID NO. 47774
  misc_feature (357)..(357): n is a, c, t, g, unknown, or other
  misc_feature (379)..(379): n is a, c, t, g, unknown, or other
  misc_feature (380)..(380): n is a, c, t, g, unknown, or other
  misc_feature (387)..(387): n is a, c, t, g, unknown, or other
  misc_feature (388)..(388): n is a, c, t, g, unknown, or other
  misc_feature (394)..(394): n is a, c, t, g, unknown, or other
  misc_feature (397)..(397): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (422)..(422): n is a, c, t, g, unknown, or other
ctggagctccccgcggtggcggccgctctagaactagtggatcccccgggctgcaggaattcgcacgagaccattacctagaacatcctaatcgaaaaattcccatcccattccccactctactcattcagcagatcccgtcactcgctctccacaagcagagcaccgcagcagaacgaggaaggatgctggccatcttccagaagcaggtggcgcacgcgccgcaggagctcaacagcccccgcgccggcgcgtcgcccagcaagccccggaaccccgacgagatcctgcgcgacttccacgccgcgcacccggccgccgccttctccgcctccttcggcggcggcgccgcgctcngctgcgtcggcccctcctcctnncgcacgnncacggnacngncnnactacagcggatgttctgcngcctggacacatctactgcgtcttcctgggcgcctcgacaactcagcgggctcatccgcagtacggcctgtgcgccgctccaccaacgagcgatgctgtcatcgaggctaccgacgctggcgaccggggcctacccgccgaacaggtgtaaggacctgccgggccttccctttgtgtttttaaaggcgttcgggccttttccccccctggcccccaaacggggaaccccgggcccttaatggggcctccgccaaagctccc

SEQ ID NO: 47774 - protein, 139 aa, Zea mays
  misc_feature: Ceres CLONE 1455908-F
  misc_feature (58)..(58): Xaa is any aa, unknown, or other
  misc_feature (65)..(65): Xaa is any aa, unknown, or other
  misc_feature (68)..(68): Xaa is any aa, unknown, or other
  misc_feature (70)..(70): Xaa is any aa, unknown, or other
  misc_feature (71)..(71): Xaa is any aa, unknown, or other
  misc_feature (72)..(72): Xaa is any aa, unknown, or other
  misc_feature (73)..(73): Xaa is any aa, unknown, or other
MLAIFQKQVAHAPQELNSPRAGASPSKPRNPDEILRDFHAAHPAAAFSASFGGGAALXCVGPSSXRTXTXXXXYSGCSAAWTHLLRLPGRLDNSAGSSAVRPVRRSTNERCCHRGYRRWRPGPTRRTGVRTCRAFPLCF

SEQ ID NO: 47775 - DNA, 703 bp, Zea mays
  misc_feature: Ceres CLONE 1455911-F
  misc_feature: Encodes the peptide sequence at SEQ ID NO. 47776
ggagctccccgcggtggcggccgctctagaactagtggatcccccgggctgcaggaattcgcacgagaccattacctagaacatcctaatcgaaaagccagtttcgttctcatctccgtttctctggattgtcccccgctccccgctcccctctccggtcttccccatgtcggacgcgtataggaaagccaagcccggccgcctcgtcttcaagggcggcgaagccgcctccatccacaagccaaagaagcacaagaagaataagaagcccgcgtcggacgccctcgccgacggcgacatcgaggccgcggccgcgaccgcggagggtgctgaaggcggcggaggtgccggcagcggcactggcgacgactacaccatcgacgcggcgaagaagatgaagtaccaccaactcttccctgtggagtcgaagaagttcgggtatgaccccgacaacgccgcccgcgctgccgcccggaaccgcaccgtcgaggaagcgctcgacgaccgcgtccgcaagaaggccgaccgctactgcaaatgaggttcactcattggtcattgctgttgtttgcagctgtattgctcagtgtattgaagatggcctctttggagaattatgatccttcacggcatgttgtttagtagtcaaagtgctagtcaagcatttttctttatgcatatttgtactagtaattagcaaact

SEQ ID NO: 47776 - protein, 124 aa, Zea mays
  misc_feature: Ceres CLONE 1455911-F
MSDAYRKAKPGRLVFKGGEAASIHKPKKHKKNKKPASDALADGDIEAAAATAEGAEGGGGAGSGTGDDYTIDAAKKMKYHQLFPVESKKFGYDPDNAARAAARNRTVEEALDDRVRKKADRYCK

SEQ ID NO: 47777 - DNA, 758 bp, Zea mays
  misc_feature: Ceres CLONE 1455922-F
  misc_feature: Encodes the peptide sequence at SEQ ID NO. 47778
  misc_feature (363)..(363): n is a, c, t, g, unknown, or other
  misc_feature (364)..(364): n is a, c, t, g, unknown, or other
tggagctccccgcggtggcggccgctctagaactagtggatcccccgggctgcaggaattcgcacgagaccattacctagaacatactaatcgaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgggtgtgtgtgccctggctgnncaactgtcctctgccacccaccaggaggaagggcaggctcactgagggctgctctttcggaggaaaggaaactaaagcggatgtggccttcagttttgctctagcccaaacaagcgccaggaactgccttaacaaaaattcccaaaatgtgttccaacacttgggtggggggggggaaacccccacttaaagcgggttgggttgggaggggggaaaaaaggggctttgaattttatttaaggggggaaattttggggaaaaaaaaaaaaaaaaattttttttccccccccccgggggggggccgccacccactccccccaagggggagaaataacccccccgcgggggctgtttttaaccgcgggggagaaaaacttgggttcccatatttttt

SEQ ID NO: 47778 - protein, 95 aa, Zea mays
  misc_feature: Ceres CLONE 1455922-F
  misc_feature (30)..(85): Pfam Name: Ribosomal_S27e Pfam Description: Ribosomal protein S27
  misc_feature (61)..(61): Xaa is any aa, unknown, or other
  misc_feature (62)..(62): Xaa is any aa, unknown, or other
MVLQNDIDLLNPPAELEKLKHKKKRLVQSPNSFFMDVKCQGCFSITTVFSHSQTGCVCPGXXTVLCHPPGGRAGSLRAALSEERKLKRMWPSVLL

SEQ ID NO: 47779 - DNA, 763 bp, Zea mays
  misc_feature: Ceres CLONE 1455923-F
  misc_feature: Translation starting site: 140
  misc_feature (417)..(417): n is a, c, t, g, unknown, or other
ggagctccccgcggtggcggccgctctagaactagtggatcccccgggctgcaggaattcgcacgagaccattacctagaacatcctaatccaaaactctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagctacgtgcggcgaccggaccaggcagaccgtgtcatcggcaccctccttggatccctcctccccgatggcaccgtccacgtccgcaactcctacgtggtccccacagcgagtcgggcgaaccagtcgccatcgacatcgactaccacccatacatgtacgccctcccacaaaanggtgaccccaaggaagtcatcgtcggatggttctcgactgaattgtgtggttctgggggaatacccctatcctggaatctattcagggaaggacaaagcccctccactttaaggcaaccccggtttcctagggggaaagtttcctaaaggctaattttcttccaacggcccccggggaaaggaaacccgggcgaattttgagaaacccccgggattttagagaataggggaaaaaagggggtgtttaaacccccaaaaccccggggggaaaaacccccccgcgttgggggggaggggcccctccggggagaattttttacccccccccccgggggggggccccccc

SEQ ID NO: 47780 - DNA, 622 bp, Zea mays
  misc_feature: Ceres CLONE 1455925-F
ggagctccccgcggtggcggccgctctagaactagtggatcccccgggctgcaggaattcgcacgagaccattacctagaacatcctaatcgaaaagatttcttctcttaactctcgcgtctcgcgtccttttcccttcctcccctccgttgcgtccgtcgtctgcgttgcgtccctccgtccgtccgtccgttggcccgtccgtcgtcaccagcctcctccctcgcgcccaccgccgggatccggccctcctcgtctgcgcccgcctcggtctagatttctgagaaaatggcgagaagtgcgggaactaggaggcgtgtggctcgccagctcaagtccacacatcccaattccttcataccgatggaagtcaaagcccatgaaaaaagccgaatgaaaaaatccaaactgaaaaggcaagtggtttgccaaaccttgcaaaaaatggactgggaaaaatcccatttgcctgggggccatggaaacccccaaaagggggggccccccctttgtcacccccaagaaaggggtgtgcccccccttaaagggggggaacaaaatctccccccctctaaattggtttgggaaacctccaaaaaaaacttttaccccaggggggggg

SEQ ID NO: 47781 - DNA, 760 bp, Zea mays
  misc_feature: Ceres CLONE 1455928-F
  misc_feature: Encodes the peptide sequence at SEQ ID NO. 47782
  misc_feature (760)..(760): n is a, c, t, g, unknown, or other
tggagctccccgcggtggcggccgctctataactagtggatcccccgggctgcaggaattcgcacgagaccattacctagaacatcccaatcgaaaaatcagaaccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggccccccgccgcccaagtccgggcgcggcggcaagtacaccccccacggccccggcagcgtcgtcgaggaccagctcgacccggcgccgccccgcatcgaccccaacgaccccaactacaaggagggaggggcggcggaccaggacgacgaggcggccagggaagtggtcctcgcggaggtggaggtcgctaaggtcgccgaagagcacggacgcgtcgccaggggccacttcccgccgggcctgcttccggaccaaaagcagtaaaaagactgtcttttcttggaaccgctaaactctattaaactggtgtgtcactgtggtccaattttgtttccggcaaagaagggcccgcccaccccccccttaaataaacctgcttttgggaan

SEQ ID NO: 47782 - protein, 148 aa, Zea mays
  misc_feature: Ceres CLONE 1455928-F
MAAYMRVTHRDEEGKKVTEKMPVPETRRPDTAKHFERKLEEQGLHRFERHPANAPRGVGIGPPPPKSGRGGKYTPHGPGSVVEDQLDPAPPRIDPNDPNYKEGGAADQDDEAAREVVLAEVEVAKVAEEHGRVARGHFPPGLLPDQKQ

SEQ ID NO: 47783 - DNA, 736 bp, Zea mays
  misc_feature: Ceres CLONE 1455930-F
  misc_feature: Encodes the peptide sequence at SEQ ID NO. 47784
  misc_feature (421)..(421): n is a, c, t, g, unknown, or other
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaaactaaaatccaccaaaaaatgtctctagtccattatgccatcctcgtggcacttcttgtcatctccgccaatgcagtctctcctccagagaagttgaaacccaaacaaaccgttcctgcttctcctacaatctctgctgccgccaaagctttcaccgacgcgcacaacaaggccagagccatggtaggtgtcccaccgctagtatggagccagacgctggaggcggcggcgaaccggctggctcgttaccagaggaaccagaagaaatgtgagtttgcgagtctaaaccctgggaaatactgtgcggggccctttcccnncaaaggtttggccgtgacgccgactcttgcggtggagacatgggtgaaggagaaacctttctacgactacaagtcggacaaatgtgccccgacccacacgtggggtgtctataaacaagtcgtggggagagactcaaaggagctaggctgtgctcaagccatgtgtaactaagagccaacggttttaaaccttttgtttctataaccccccccggaaataaaattggcccaaaccccttcctataaagaaaaaaagggcttaccttactaggagtaactttatttaacggggcccaaaaataaatcttctttat

SEQ ID NO: 47784 - protein, 157 aa, Zea mays
  misc_feature: Ceres CLONE 1455930-F
  misc_feature (46)..(158): Pfam Name: SCP Pfam Description: SCP-like extracellular protein
  misc_feature (101)..(101): Xaa is any aa, unknown, or other
MSLVHYAILVALLVISANAVSPPEKLKPKQTVPASPTISAAAKAFTDAHNKARAMVGVPPLVWSQTLEAAANRLARYQRNQKKCEFASLNPGKYCAGPFPXKGLAVTPTLAVETWVKEKPFYDYKSDKCAPTHTWGVYKQVVGRDSKELGCAQAMCN

SEQ ID NO: 47785 - DNA, 960 bp, Zea mays
  misc_feature: Ceres CLONE 1455932-F
  misc_feature: Encodes the peptide sequence at SEQ ID NO. 47786
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (435)..(435): n is a, c, t, g, unknown, or other
  misc_feature (437)..(437): n is a, c, t, g, unknown, or other
  misc_feature (441)..(441): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (960)..(960): n is a, c, t, g, unknown, or other
caacgggccccccaacnnnnnnnnnnnttggttnnnnnnntaccgatgagctccacgcggtggcggccgctctagaatagtggatcccccgggctgcaggaattcccacgagaccattacctagaacatcctaatcgaaaactcttgctcataccgcaacgctctatctctttcggcgagctcctcgaaccctatgagcgtgcttgagcgggggcggcgaggtgatggcgatggaccctgacgcgggaccggagggcttcgtggagcattactaccgaacgttcgaccccccccggggggggccggctgggcctgaacccgatacctccgcgatcacgatcgacggctcgaaagtccccgggtcccttcccccattcgcgccaacactcggacttgttgtttttttggtgggggaacccgggggcagaggggggnanaatnttaaatttttaannntttccgcccaccccccccccaaaaaaaaaaaatttggtggatgccatcagccgtgcgggccccccatcaaaacccagccaacaagtgggcgcctggtgctcgtccccttggtgaactcggcggccgcgcccgcgccttcacggcgctggacggccccggagcgctgcgatgtgttggtgctcgcacagaccgatagagtctctctggacctgcgcgcgccgcttctcgccggtgcccctacctgatgagtagttcgcgggtccctcatcactctgctgcgggcgggttgcacatcggctcggggcgccttcatccgctgtccgacgtggcgcagatggcgccacggcgctattcgcggcctcgcgctgggcttgtgaacgcgcagccgagagggaccgcgccgttcttatgatctccagtgctacaccggtgggcgtcgcgtctcagcctgctcaccgcaggatctcggccactgcgccgtcctagcgcctggtctgcggattn

SEQ ID NO: 47786 - protein, 158 aa, Zea mays
  misc_feature: Ceres CLONE 1455932-F
  misc_feature (71)..(71): Xaa is any aa, unknown, or other
  misc_feature (73)..(73): Xaa is any aa, unknown, or other
  misc_feature (77)..(77): Xaa is any aa, unknown, or other
  misc_feature (78)..(78): Xaa is any aa, unknown, or other
MAMDPDAGPEGFVEHYYRTFDPPRGGPAGPEPDTSAITIDGSKVPGSLPPFAPTLGLVVFLVGEPGGRGGXNXKFLXXSAHPPPKKKKFGGCHQPCGPPIKTQPTSGRLVLVPLVNSAAAPAPSRRWTAPERCDVLVLAQTDRVSLDLRAPLLAGAPT

SEQ ID NO: 47787 - DNA, 853 bp, Zea mays
  misc_feature: Ceres CLONE 1455937-F
  misc_feature: Encodes the peptide sequence at SEQ ID NO. 47788
aagctggagctcaccgcggtggcggccgctctatcctagtggatcccccgggctgcaggaattcgcacgagaccattacctagaacatcctaatcgaaaagtaaaatcacaaagccagcccatcacctcagtcctcacactgacatttcactctcggctgctggagtgtcggccgctgccatctgcctgccgctcactcccacgcgccgcaatgtgccactccccactcggcgccgccaccaccaccgcgggggcgctagcgctcctcttcctcctgccgctagcctcggccgccgccgccggcggcggcaccgcggcgaaggcgacgcccaacatcacggcgctcatgtccaagggggggtgcaaaggcccccccctccttgctgaaaaagtcccccgaaagtttggtgggccccccaccccaacagttaaccgcccgcatgaaccgcctttctgccccaacgaaaaaagccctgggcgcggttttttgccccgcttaccgaaaccctgaaccccagaaggaaagaggccccccttgctgctgtttcccaacggggtggccccttgtaataaaccccttggggggggcctaaaataccgaaaaagggcgcccaaaaaaaaaccgtggcccccgagaggtggccccccaaaacataaaaaacggggggtggtaaaaaacgcggaaaaaatatttaaatatttagaaaacccgcggggcaaaaaaccgccacccccgggtggccccccccttttaaaaaaaagaaccccccccctctaaacacgtggaactatttggtttcacccacgggagttttttcacaccccgggagacactcccacccagcgtggccgg

SEQ ID NO: 47788 - protein, 99 aa, Zea mays
  misc_feature: Ceres CLONE 1455937-F
MCHSPLGAATTTAGALALLFLLPLASAAAAGGGTAAKATPNITALMSKGGCKGPPLLAEKVPRKFGGPPTPTVNRPHEPPFCPNEKSPGRGFLPRLPKP

SEQ ID NO: 47789 - DNA, 712 bp, Zea mays
  misc_feature: Ceres CLONE 1455938-F
  misc_feature: Encodes the peptide sequence at SEQ ID NO. 47790
ggagctccccgcggtggcggccgctctttactagtggatcccccgggctgcaggatttcgcacgagaccattacctagaacatcctaatcgaaaaaaaaatctataagccatccctacgccgccgccgccgccgctatgggtatcgacctcgtcgattgcggtcgttacttgaggaccatgcgcaccgcgccaaagtcggacgatgtctacctcaagcttctggtgaagctctaccgcttcctgttgacgaccaccaagctcagttctttgctgggaacctccatgcgccacttcgttactgataccaatcggccgcccctctcgcttcgtcctctcgtccagttcatggacggcaaggataactagatcgctgtgatctgtggtactataagcgaggacaaacccccccacgaggtgcctgcaatcaatgaggcagcgctcgctctccctgaaacgcttgggcaccacattgtgaatgccggtggagaatgcctcgcctttgaccacctggcccttcgtgctcctcttggtcagaggacagttctcctgaggggtgcctagaacgcccgtgaggcaaggaggcacttcggaaaggctcctggtgtgccgcacattcttaccaatccttatgtccgttcgaagggaaggacatttgaggaagcaagatgaattatgaacagctgacgtttcaaggtctaagttgttgcttgt

SEQ ID NO: 47790 - protein, 76 aa, Zea mays
  misc_feature: Ceres CLONE 1455938-F
MGIDLVDCGRYLRTMRTAPKSDDVYLKLLVKLYRFLLTTTKLSSLLGTSMRHFVTDTNRPPLSLRPLVQFMDGKDN

SEQ ID NO: 47791 - DNA, 724 bp, Zea mays
  misc_feature: Ceres CLONE 1455939-F
  misc_feature: Encodes the peptide sequence at SEQ ID NO. 47792
  misc_feature (430)..(430): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (604)..(604): n is a, c, t, g, unknown, or other
  misc_feature (664)..(664): n is a, c, t, g, unknown, or other
  misc_feature (665)..(665): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
ggagctccccgcggtggcggccgctctagaactagtggatcccccgggctgcaggaattcgcacgagaccattacctagaacatcctaatcgaaaaagatcaccagccataccacacgaccgcagaggagtagcaagagcccgggggagaaatgagcgcggcggcgggcggactgcggcggctgctggcggcggcggcgacggcgggagccgcggaggtgcgggcgtccatcttcggccacgcgctgaaccctacggggaggcgcgcggcgacgaagctcctgcggaagaagatggtgggcgaccaggtggcgcagtggtacccctacgacatcaagcgcgacgacccgctcgtcatggcgcgcgaggagaaggagcgtctggctaaactggaaatgctgaagcgtcgtggcaagggcccgccgaagaanggtcagggaaggcgtgccgtcaagagggagcagtagtcgagctgtgctacccctatcatgctcatctctgtttctggagcttgccnnntgtctacattgctgtaacgtactaccagtgatttgtcgggtgagtgggcgaccaccgatgcaaaaaaaaacccaccttttctatcnagtttagcttacgaatgtttttttcatcaaatggcaatgaaaccgcccttcatgtgtggnnaannnnagggaaaaaaaaaaaaaaggttttccatcccccacccccagggggggccgggc

SEQ ID NO: 47792 - protein, 104 aa, Zea mays
  misc_feature: Ceres CLONE 1455939-F
  misc_feature (14)..(93): Pfam Name: Mit_rib_S27 Pfam Description: Mitochondrial ribosomal subunit S27
  misc_feature (93)..(93): Xaa is any aa, unknown, or other
MSAAAGGLRRLLAAAATAGAAEVRASIFGHALNPTGRRAATKLLRKKMVGDQVAQWYPYDIKRDDPLVMAREEKERLAKLEMLKRRGKGPPKXGQGRRAVKREQ

SEQ ID NO: 47793 - DNA, 750 bp, Zea mays
  misc_feature: Ceres CLONE 1455940-F
  misc_feature: Encodes the peptide sequence at SEQ ID NO. 47794
  misc_feature (410)..(410): n is a, c, t, g, unknown, or other
aagctggagctccccgcggtggcggccgctctatactagtggatcccccgggctgcaggaattcgcacgagaccattacctagaacatcctaatcgaaaacaaagcaaagcaaagcttcaaagcatctctgctaggattttagcgagcggcaacgacgagcgacccaaaaaagcaatcattagtcaccatatctggtcctctcgctccacccccctcctctgcgacttgaggcaggacaggaggcacagacgtgcaatggggttcgtgctggtggtctctctgcccttcatcttcttctccatcctcctcggcttcggctgctacttcctcggcaagcacaggggccgggaggagatgcggaccggcatcggcgtgcaaatctacggcacgccgctgccgccgcccggcnccctcggagcctcctcgccgccgcctgagccgttccacagcaagaaacaatggtccgaggctgtgtgactgagattcagacgtctctccatccatccattcaactactactacatatattgtcttgggggtgaggttggaattaaaattcataagtcctttcctccttaaaattcccccctggccgctcttgaaaagtggaaatttgagaagcccaaatctgtgcctgggtgcttaaaaaaaggggcggggtggaaagtttcggaaaccaatttggaattcacacttaacatctcttctgtgactcccgccaaaaaattttcttgaaaaaaaaaaaaaag

SEQ ID NO: 47794 - protein, 73 aa, Zea mays
  misc_feature: Ceres CLONE 1455940-F
  misc_feature (52)..(52): Xaa is any aa, unknown, or other
MGFVLVVSLPFIFFSILLGFGCYFLGKHRGREEMRTGIGVQIYGTPLPPPGXLGASSPPPEPFHSKKQWSEAV

SEQ ID NO: 47795 - DNA, 734 bp, Zea mays
  misc_feature: Ceres CLONE 1455941-F
  misc_feature: Encodes the peptide sequence at SEQ ID NO. 47796
  misc_feature (711)..(711): n is a, c, t, g, unknown, or other
  misc_feature (734)..(734): n is a, c, t, g, unknown, or other
aagctggagctccccgcggtggcggccgctctagaactagtggatcccccgggctgcaggaattcgcacgagaccattacctagaacatcctaatcgaaaatttttttcgaatttagaatccccgtgctgagagctgagtgccgccttggttgctccgtactggactcgattcctcatcgcagcagaagcatcccgtcccctccgcttctccttgctctgctctgctaacacacagacaaaaaaaatagcagcatgtcggaggtgaaggactccaatgtgcctgctgcacttgatggaaatcctcaacctatggaccaaactgaagacaattctatgccctcagcacagcaacaggaagaagcaatcaagaagaagtttggaggactaatgcccaaaaagcccccactcatcccacaggatcatgagcgggcctactttgattctgctgactgggctctagggaagcaaggtgttgccaaaccaaaaggaccgctggaggcacttaggcccaagcttcagccaacacgccaacaacagcaacaacgtgcaaggcgccctatttacacttcgtcagaaaacgaggacggagacggggctggtgctgaggatatgaacatcaattgaagtggactagtggagtggaatgcctgctcagattggttgatgagcaagtcgtcactatatgtcaagtgttgtagtttgctttgcanttattggaggaaattaatgatcn

SEQ ID NO: 47796 - protein, 123 aa, Zea mays
  misc_feature: Ceres CLONE 1455941-F
  misc_feature (39)..(122): Pfam Name: Lg106 Pfam Description: Lg106-like protein
MSEVKDSNVPAALDGNPQPMDQTEDNSMPSAQQQEEAIKKKFGGLMPKKPPLIPQDHERAYFDSADWALGKQGVAKPKGPLEALRPKLQPTRQQQQQRARRPIYTSSENEDGDGAGAEDMNIN

SEQ ID NO: 47797 - DNA, 733 bp, Zea mays
  misc_feature: Ceres CLONE 1455942-F
  misc_feature: Encodes the peptide sequence at SEQ ID NO. 47798
  misc_feature (399)..(399): n is a, c, t, g, unknown, or other
  misc_feature (733)..(733): n is a, c, t, g, unknown, or other
agagctggagctccccgcggtggcggccgctctagaactagtggatcccccgggctgcaggaattcgcacgagaccattacctagaacatcctaatcgaaaaaattccccatcgcgataggcccgttcgcacgaatcactgctctgctttcaccccccgcatcgaacctcacccccgatctgatcgaatcgaaggctgcggcggcgatgggcggtgaccatggcggtgggcacgccggcggcgacttccgccagaaggtatggagcatgacgggcggcccgtactgccgccccgtccactgggcgcgtaacaccgccatcgccatgttcggcgtcttcctcatctgcatccccatcgctatgaagcccggagagctcgaggaggggccgcctcacccantcccggccaccccccctgagctggggtgcaaaaactttggtaagaaaggaatacggaaggaccctccaattggatggaggggggggcaccttgctttttgccttcttttgggggaaacctgggcccaacccaaaggggggggtaaggggcagagacaccccctgggaggctcccggaaaaccttttggaccctctcccccccccgggaaaaggagaaaaccctggaagaccccaaaaaatgccccgggacacaaaaattcttggaagaaattttccccgggggtttgcaaagtatgttacgaacgcggggcccccccgcaaaaacagttgaagn

SEQ ID NO: 47798 - protein, 175 aa, Zea mays
  misc_feature: Ceres CLONE 1455942-F
  misc_feature (65)..(65): Xaa is any aa, unknown, or other
MGGDHGGGHAGGDFRQKVWSMTGGPYCRPVHWARNTAIAMFGVFLICIPIAMKPGELEEGPPHPXPATPPELGCKNFGKKGIRKDPPIGWRGGHLAFCLLLGETWAQPKGGGKGQRHPLGGSRKTFWTLSPPREKEKTLEDPKKCPGTQKFLEEIFPGGLQSMLRTRGPPAKTVE

SEQ ID NO: 47799 - DNA, 747 bp, Zea mays
  misc_feature: Ceres CLONE 1455944-F
  misc_feature: Encodes the peptide sequence at SEQ ID NO. 47800
  misc_feature (370)..(370): n is a, c, t, g, unknown, or other
ggagctccccgcggtggcggccgctctataactagtggatcccccgggctgcaggaattcgcacgagaccattacctagaacatcctaatcgaaaagatcggagcatcccgtcccgaggaggaagacaaccggcgacgcggggggaacatggggaagacgccggtgcggatgaaggcggtcgtgtacgcgctgtcgcccttccagcataaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatnccctgcccttgacagacagcactcggagttttcatgatccctttcataatcctcccatgatgatttaacatttgtttgatcgatttcaggttcgcggcttttcatcgttccgtatgcatatatgggagcggtgtctgggagacttatttggaggggttgcgaaaaatggacccgttggtctctgaagtggggaggtagagcgagattaactgccggggttctgaagaagaaaaaaaaaaaaaggtttagcggaggcctgtcgagcgtcgggggggggggccgggttcgccaagttcgccccttgtaggtggggtctgagttaacgggggggtgggatgggcgagcggtttttgcggccggcccggggacggggggaa

SEQ ID NO: 47800 - protein, 72 aa, Zea mays
  misc_feature: Ceres CLONE 1455944-F
MGKTPVRMKAVVYALSPFQHKVMPGLWKDITTKIHHKVTENWISATLLLTPVVGTYQYAMWYKEQEKLSHRY

SEQ ID NO: 47801 - DNA, 701 bp, Zea mays
  misc_feature: Ceres CLONE 1455951-F
  misc_feature: Encodes the peptide sequence at SEQ ID NO. 47802
tccccgcggtggcggccgctctagaactagtggatcccccgggctgcaggaattcgcacgagaccattacctagaacatcctaatcgaaaaatttgcattcggatctggtttagacgggatgagcaacccgggggcaccggacaccgtcactgagtcggcggagctggtcctgccgttgttgccgccgcaggacctcgcggccgcggcatcggcctgccgcgccctccgcgcggctgtgactgctgtcaccgcgcgccgcgccggcgacgccgcacgtggcctagagccgctccccatcccgttccgcaactacgtcgattccaagccctatgcctacttcctgtatacccccttctccctcacccggctggctcccggcgcctccgcccccagcgcccagccgtggggtgccgcctggacccggccgccccgccccacctggccccgccccaacctcgacggcttaccatcagccgtgtacgggtgcgcgtgcgcggcggcggaatgcggtggtacccagtgcgcgtgcgccgatgtggaggccgatgcagcgggctcgggcttggaggccgggatggggagcctcacggagtgcggtgatgtctgcgcgtgtgcgccgtcatgtgggaaccgggcgactcagcgcggcgttgctgtgcggctgtgcgtcgtgcgccacctgcacaggggtgggggctgc

SEQ ID NO: 47802 - protein, 194 aa, Zea mays
  misc_feature: Ceres CLONE 1455951-F
  misc_feature (50)..(172): Pfam Name: Pre-SET Pfam Description: Pre-SET motif
  misc_feature: SWISSPROT Homolog: EC 2.1.1.43 Histone-lysine N-methyltransferase
MSNPGAPDTVTESAELVLPLLPPQDLAAAASACRALRAAVTAVTARRAGDAARGLEPLPIPFRNYVDSKPYAYFLYTPFSLTRLAPGASAPSAQPWGAAWTRPPRPTWPRPNLDGLPSAVYGCACAAAECGGTQCACADVEADAAGSGLEAGMGSLTECGDVCACAPSCGNRATQRGVAVRLCVVRHLHRGGGC

SEQ ID NO: 47803 - DNA, 732 bp, Zea mays
  misc_feature: Ceres CLONE 1455959-F
  misc_feature: Translation starting site: 186
ggagctccccgcggtggcggccgctctagaactagtggatcccccgggctgcaggaattcgcacgagaccattacctagaacatcctaatcgaaaaaccacgcagtcactcccgggccgccgccgccgccgcctccgcgaaaaaccctagcaggcttcgccgctatcactccaaggggcgcgaccatggtggccacaaagaagacgaagaaatccacggacaacatcaataacaagctgcagcttgttatgaagagtggcaagtacactctcggctacaagaccgtcctcaggactctcaggaactctaagtcgaagctagtgatcatcgctaacaactgcccgccccttcgtaagtctgaaattgagtactatgctatgctggccaaggtcactgtccaccacctccatggtaaacatggtcgactttgaaactgcctgtggtaaatactttccggtctgctggctccgcattatggacccgggggagtctgaatcccccaagactaccccgggggaacataaaaaaaccccctgcagaagggggatcttacggcatttggtcctcgggccgggaaaaaaaatttcccggggagtaaaagggttattccgaaacatggcttgaaaagaattttggccccggggtgttaaccctaaaaaagaggtttacttaaacccgggggtcaaaaaaaaaaaaaaaaatttttttccccggccccccccgggggggggg

SEQ ID NO: 47804 - DNA, 803 bp, Zea mays
  misc_feature: Ceres CLONE 1455966-F
  misc_feature: Encodes the peptide sequence at SEQ ID NO. 47805
tggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactggtggcctttacgcttcagacgatgccagtgatgatgccacagatgatgacgcctaacatgatgccacactcgatgatgccgagcatgatgtcaccaatggtcttgccaaacatgatgtccaaatgataatgccaaatgtccctgcgaagccgtctcccaattatgctgcaaaagcatttacctttctggtccaacccaagggccttgaagaattcccccagtgtttttacagaaccccttttgggggcggcgccttccaaaaaaaaaattttgggttgcccccaaaaaaaaggtgtaaacccccccccggggggcccctttttaaaaaaaaaaaaatggtttcctcttttttttttttttataaaaaaaaaaaaaaaaaaattttttttctctccccccctgcggggggggggcgggcccccaactcccccccaaagagagggaaataaaaccc

SEQ ID NO: 47805 - protein, 105 aa, Zea mays
  misc_feature: Ceres CLONE 1455966-F
MAAKMLALFALLALCASATSATHIPGHLPPVMPLGTMNPCMQYCMMQQGLASLMACPSLMLQQLVAFTLQTMPVMMPQMMTPNMMPHSMMPSMMSPMVLPNMMSK

SEQ ID NO: 47806 - DNA, 838 bp, Zea mays
  misc_feature: Ceres CLONE 1455967-F
  misc_feature: Encodes the peptide sequence at SEQ ID NO. 47807
  misc_feature (397)..(397): n is a, c, t, g, unknown, or other
  misc_feature (402)..(402): n is a, c, t, g, unknown, or other
aagctggagctccccgcggtggcggccgctctagaactagtggatcccccgggctgcaggaattcgcacgagaccattacctagaacatcctaatcgaaaactaccccagccgccgccgccgccaccgccacctgccccagcgcgccgccgccgcagccaccatgggtcgcgtccgcaccaagaccgtgaagaagacctccaggcaggtgatcgagaagtactactcccgcatgaccctcgacttcaacaccaacaagaaggtgctcgaggaggtctcgattctgccctcgaagcgcctccgcaacagggtggctggcttcagtaccccccggatgccccgcattgagggggggcccagtccggggaatttcccctcaggtgggaggagaaaaaacnttaancgcgggccccccctcgtggcccgaaaaaaccccccttctcgaggccaaaaaaaatcccgggccccacagggaaaccctggggaagaaatctcccctccccctccgcatgggcaccaaacacccccccgcgcttttaaactccccgggttgagagactcttctacaccctcccccccatatatgcccccccccatatatggggtggggcctcccccccggaacacccatatataaactttccgggtggggggtcctctttgtgccgccccggctgctctgaaaagatagtttcttatcccgtgccccaaatattttttaataccattgcgcgcgcggcactgtgtggggagatataattgacccggcgcccccgccccacaaacaagaacaaacacgcaaggtgttactaatggtggaataataagccatttattat

SEQ ID NO: 47807 - protein, 157 aa, Zea mays
  misc_feature: Ceres CLONE 1455967-F
  misc_feature (1)..(113): Pfam Name: Ribosomal_S17e Pfam Description: Ribosomal S17
  misc_feature (79)..(79): Xaa is any aa, unknown, or other
  misc_feature (80)..(80): Xaa is any aa, unknown, or other
MGRVRTKTVKKTSRQVIEKYYSRMTLDFNTNKKVLEEVSILPSKRLRNRVAGFSTPRMPRIEGGPSPGNFPSGGRRKNXXRGPPLVARKNPPSRGQKKSRAPQGNPGEEISPPPPHGHQTPPRAFKLPGLRDSSTPSPPYMPPPIYGVGPPPRNTHI

SEQ ID NO: 47808 - DNA, 754 bp, Zea mays
  misc_feature: Ceres CLONE 1455968-F
  misc_feature: Encodes the peptide sequence at SEQ ID NO. 47809
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (587)..(587): n is a, c, t, g, unknown, or other
  misc_feature (630)..(630): n is a, c, t, g, unknown, or other
  misc_feature (641)..(641): n is a, c, t, g, unknown, or other
tggagctccccgcggtggcggccgctctagaactagtggatcccccgggctgcaggaattcgcacgagaccattacctagaacatcctaatcgaaaaactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcctgagcagctcatcagtggcaaggaagatgcagccaacaacttcgctcgtggtcactacaccattggcaaggagaatgtnnngactgtgctttgacgcatcangaagcttgcagataattgcactggtctccagggcttcctcgtnctcaacgctgnttgtgaaggaaacggctctgggcttggttctctcctcctgaggcgctgtctgttgactatggcaagaagtccagctcgggttcaccgtgtaccatccccccagtgtcacatcc

SEQ ID NO: 47809 - protein, 119 aa, Zea mays
  misc_feature: Ceres CLONE 1455968-F
  misc_feature (116)..(116): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKENVXTVL

SEQ ID NO: 47810 - DNA, 780 bp, Zea mays
  misc_feature: Ceres CLONE 1455973-F
  misc_feature: Encodes the peptide sequence at SEQ ID NO. 47811
  misc_feature (341)..(341): n is a, c, t, g, unknown, or other
  misc_feature (386)..(386): n is a, c, t, g, unknown, or other
  misc_feature (404)..(404): n is a, c, t, g, unknown, or other
ggagctccccgcggtggcggccgctctagaactagtggatcccccgggctgcaggaattcgcacgagaccattacctagaacatcctaatccaaaactctcctcatccaccaccaccagtgcctccaccgaatcttcaacaggcaaagccaatcaataatcaccagccacatccacatcaatccattccctttcctctcccgctccacttccatgggcaaggttcggtccttcttctcccgctcccgcagcggcaagcgcggcagcgcccggagggcaggctcgtcctcgccgcactcctccgcggcgagcgcgccgccgtccccgtccccactcccactnccgaggaagtcgccgtcgtcgtcgtcgtcaaccagggacgagacngagcgcgtgttccgcaangtcgacccgaacggcgacgggcagatctcgcggtccgagctggccgcgctgttcgaggggcgtggccaccgccgtgacgaacaccaagtgtccgcatgaggaaggaggcggacccgacgggaaaggttgcttaccctggccaatttccccgggctctaggaatccggtccccaaaacccccccccgggaaaaaaaacctgccccccccttttgggttttaaagccaagaggaagggccctttacccccccaaaattgcgggggttttgtggggcccctggaaatacccccccctcccacaagggccccaataaaaagggggggacacaaaaaagagagaccccccctcccttctaaaaaaaaacccaagggggggg

SEQ ID NO: 47811 - protein, 96 aa, Zea mays
  misc_feature: Ceres CLONE 1455973-F
  misc_feature (57)..(85): Pfam Name: efhand Pfam Description: EF hand
  misc_feature (64)..(64): Xaa is any aa, unknown, or other
MGKVRSFFSRSRSGKRGSARRAGSSSPHSSAASAPPSPSPLPLPRKSPSSSSSTRDETERVFRXVDPNGDGQISRSELAALFEGRGHRRDEHQVSA

SEQ ID NO: 47812 - DNA, 810 bp, Zea mays
  misc_feature: Ceres CLONE 1455974-F
  misc_feature: Translation starting site: 147
  misc_feature (68)..(68): n is a, c, t, g, unknown, or other
  misc_feature (264)..(264): n is a, c, t, g, unknown, or other
  misc_feature (372)..(372): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (390)..(390): n is a, c, t, g, unknown, or other
  misc_feature (418)..(418): n is a, c, t, g, unknown, or other
  misc_feature (419)..(419): n is a, c, t, g, unknown, or other
  misc_feature (421)..(421): n is a, c, t, g, unknown, or other
  misc_feature (422)..(422): n is a, c, t, g, unknown, or other
  misc_feature (425)..(425): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (452)..(452): n is a, c, t, g, unknown, or other
  misc_feature (488)..(488): n is a, c, t, g, unknown, or other
  misc_feature (495)..(495): n is a, c, t, g, unknown, or other
  misc_feature (501)..(501): n is a, c, t, g, unknown, or other
  misc_feature (523)..(523): n is a, c, t, g, unknown, or other
  misc_feature (568)..(568): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (613)..(613): n is a, c, t, g, unknown, or other
  misc_feature (614)..(614): n is a, c, t, g, unknown, or other
  misc_feature (616)..(616): n is a, c, t, g, unknown, or other
  misc_feature (619)..(619): n is a, c, t, g, unknown, or other
  misc_feature (620)..(620): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (763)..(763): n is a, c, t, g, unknown, or other
  misc_feature (777)..(777): n is a, c, t, g, unknown, or other
ccgctggcggccgctctataataatggatcccccgggctgcaggaattcgcacgagaccattacctanaacatcctaatcgcaaagtaccatccgccgccgcaaccatccgcttgttctcttcagttcagttctcgagtttccaggatgaaggcaatagctgcctatctgcttgctgttctgggtggaaacacttccccgactgctgatgatgctaagagcactctggaatcacttggtgctgaagctgatgaaaaaaaactanacttcctgctcacagaactcacagacaacgacataacagaaccgattgcaacttggaaaggaatagggtatccttttgttgtttggatgaccccctccgttccccccnannnannnnaaagaaggnggaaggtgggtttgttcccccccacccnncnnaanaannnaaaaaaaaggaaaaaaaagganaaaaaaaaaggaaaaaaccagaaaaaaaaaaggggntaaaganggggcncaaataaaaaaaaaaaacccancttacaaaattctctcgccaaaggaccgcacaaaaattcgccggntcccccaaacaaatttttgttttttttgnnnnnnnnnnnnngggnntnccnnaagggagaaagtaaaaaggggagaagaaaagaaaagagagaaaaaaaaagggggcgaggggggccaaaaaaaaaagggagaaaaaaggaaaaagggggaannnagaaagaaaatgaggaaaaagaaacaaagaaggggcgaanaaaggagaaaaaanaaagaaaaggggaaaatttggaggggtttgttt

SEQ ID NO: 47813 - DNA, 720 bp, Zea mays
  misc_feature: Ceres CLONE 1455981-F
aagctggagctccccgcggtggcggccgctctagaactagtggatcccccgggctgcaggaattcgcacgagaccattacctagaacatcctaatcgaaaacaagtgctcatttcgtctgacctccccaaccgccacaaaacaaaggagccgcattgctgctgacggaccgctcttacttcccttctctctctgttccttcatttctagaccacctgacccacagctactcggctgccagggagaaccacccgctagctgctctactccctctcttgtttcacgttccatcagcacgttctggtggacagcgcatcccagacacctcgcacaactgaaaggcacgagctagcagcatttcggtctgctcaatgaacagggaaacgggcacctcaaacatcaccggcagcgagctcatcccttcgggcggatgatctgctgtcggccggaaactgaccgcagtcacaagcacgacaggatggatgtctgtctctagactgacattaactttgaaaacttgcatgtaggactcaataactccaatcccatactgagcatgaatgaatgcatgagatggatctaatgtgatattcaggatccacttatgagttgataaaacgtatatacgagaccttgcgtgattactgctacttactataatgacgttctgtacctttgactgaaaaaaacagtccaatgaatatattcgaagtgctcagta

SEQ ID NO: 47814 - DNA, 785 bp, Zea mays
  misc_feature: Ceres CLONE 1455982-F
  misc_feature: Encodes the peptide sequence at SEQ ID NO. 47815
  misc_feature (376)..(376): n is a, c, t, g, unknown, or other
aaagctggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtggccttaagccaagctggcgcaggccaaagggtattgactcccgtgtcaggaggaagttcaagggatgcaccttgatgccaaacattggttatggttctgacnagtcgacccagcactacctccccacaaggtcaagaagttggtggtcaaccacgttttctgagctggagttgctcatgatgcaccacaggaccctactgccctaaaatggctccaacgtggccccttaaaaacccaaggaaattcctgggagcgggctcgccactccgactttggggaccaaaaaaatttggtagggtccccaacccaaaaaaaaaaaaactcgggttcttgtgttaacacaaaaggggtttccccttcccttttggagggaaaacctttggtggggccgggggaaacaaaaaaaaaaaccccctcccttttttggcaagggcgcaaaagagggggggaaacccccatttccgcgggcacaaaaaaaaaaaggggggaggggctcctcccaacaaaaaaa

SEQ ID NO: 47815 - protein, 43 aa, Zea mays
  misc_feature: Ceres CLONE 1455982-F
  misc_feature (10)..(10): Xaa is any aa, unknown, or other
MPNIGYGSDXSTQHYLPTRSRSWWSTTFSELELLMMHHRTLLP

SEQ ID NO: 47816 - DNA, 753 bp, Zea mays
  misc_feature: Ceres CLONE 1455983-F
  misc_feature: Encodes the peptide sequence at SEQ ID NO. 47817
aaagctggagctccccgcggtggcggccgctctagaactagtggatcccccgggctgcaggaattcgcacgagaccattacctagaacatcctaatcgaaaaacatccccccggagggcggtgtgagggcatggctgcaaccgtgaggagggctgcttcctccgtcctctctcgcttcctcctcacaaagccttcgccttcgcctgcttctgccgccggcaataagtccgctctcctcggagcaggggctgctgctcttcacaggttcagcaccgcaccggcatccgcggccgcggccgcagaggagccgatccagcccgcggtggaggtgaagcacacccagctcctcatcaatggcaacttcgtcgacgctgcttctgggaagacgttcccgacgctggacccgcgcaccggcgaggtcatcgcgcgcgtcgccgagggcgacagcgaggacatcgaccgcgccgtggccgccgcccgcagggccttcgacgagggcccgtggccgaggatgaccgcctacgagcggtgccgcgtgctgctgcgcttcgcggacctgatcgagcggcacgcggaggaggtcgcggcgctggagacgtgggacaacggcaagacgctggcgcaggcggcgggggccgaagtgcccatggtggcgcggtgcgtccggtactacgccgggtgggcggacagatccacggcctggtggcgccggccgacggcgcgcacccacgtgcagtgctgcacgagccggtc

SEQ ID NO: 47817 - protein, 207 aa, Zea mays
  misc_feature: Ceres CLONE 1455983-F
  misc_feature: SWISSPROT Homolog: EC 1.2.1.3 Aldehyde dehydrogenase (NAD(+))
MAATVRRAASSVLSRFLLTKPSPSPASAAGNKSALLGAGAAALHRFSTAPASAAAAAEEPIQPAVEVKHTQLLINGNFVDAASGKTFPTLDPRTGEVIARVAEGDSEDIDRAVAAARRAFDEGPWPRMTAYERCRVLLRFADLIERHAEEVAALETWDNGKTLAQAAGAEVPMVARCVRYYAGWADRSTAWWRRPTARTHVQCCTSR

SEQ ID NO: 47818 - DNA, 763 bp, Zea mays
  misc_feature: Ceres CLONE 1455990-F
  misc_feature: Encodes the peptide sequence at SEQ ID NO. 47819
  misc_feature (654)..(654): n is a, c, t, g, unknown, or other
tggagctccccgcggtggcggccgctctagaactagtggatcccccgggctgcaggaattcgcacgagaccattacctagaacatcctaatcgaaaaagacacagacacggacagagcaaccaacaagtcgtccaacgtccaggcttttctgttttgtttctctctcacgcaagtcgcaaagcaaagcgtcccccaccatggcttccacgacgacgacggcatccaacaacctggcgggcgtgtggctcggcgagctctcgtcggcgctgcatgggacgtggcaggcggtggccgtggccgtggccgccacccacgggctcggcgaggacgacgacccgcggctgccgtgccagcagcagcagaggccgtggcgaggcgacgacaggagcagcagcaacaacaaggcgttgcgaggagccgcggcggccgggacggacaggcgggagggggacgtcgcgaggtgcggcggcgccatgtccgacaccacgctctaactcctcctcaaacggttctcgccccatttaaaagggggccttttttttccaccccccccccctctggtgtttttgcccccccaacaaataaaagggggggggttttttgttttaaaaaaaaaaaaaaacaccccccccccgcttttttaaaaaaagggnttataaaaccaaaccacccaaactgtttgttttggttttgaaaaaaaaaaaaaaaaaaaaaaaaaaaaattttttggtgtttgggggggggggggcggggggggctctt

SEQ ID NO: 47819 - protein, 98 aa, Zea mays
  misc_feature: Ceres CLONE 1455990-F
MASTTTTASNNLAGVWLGELSSALHGTWQAVAVAVAATHGLGEDDDPRLPCQQQQRPWRGDDRSSSNNKALRGAAAAGTDRREGDVARCGGAMSDTTL

SEQ ID NO: 47820 - DNA, 764 bp, Zea mays
  misc_feature: Ceres CLONE 1455994-F
  misc_feature: Encodes the peptide sequence at SEQ ID NO. 47821
aagctggagctccccgcggtggcggccgctctagatctagtggatcccccgggctgcaggaattcgcacgagaccattacctagaacatcctaatcgaaaaatcctgtcgcggtcttcccctaaccgtttcttcccgttgccgcggtcccgcgccgctggtgtttccgtacaggcctctacttcgtggcggtggagaggcaggctcagaatcgtgcgcgggcggtggcggagggcctcaaggcgctcgacggcgccggggatgacgtgtgacagcggtggacgctgccgtgcagagggcctcctttggttcacatgttcacagaacctcatagcgttgcaataatgtactaaacatctgtgctcagtctttgtagaattaaatgtggatcaatgtgagtgttctcctatttcacataacccatctgagcctttgttgctgcacagaaatgttgatccgtgccactacgtgagtgttttcttatttcacacaatttgtccatttaaggatccacatgatgtattccgtagagtggagtaaccagaattcaataactgtgtattcactgtgttttttattgtccaatacaatgcatatcacaaaatatcaatatgaaactgaagaaaatttactgtgacaaaaaaaaaaaaaaaaaagcttatcgataccgtcgacctcgagggggggcccggtacccaattcgccctatagtgagtcgtattacgcgcgctcactggccgtcgttttacacgtcgtgactgggaa

SEQ ID NO: 47821 - protein, 113 aa, Zea mays
  misc_feature: Ceres CLONE 1455994-F
AGAPRGGGRSRSSGSPGLQEFARDHYLEHPNRKILSRSSPNRFFPLPRSRAAGVSVQASTSWRWRGRLRIVRGRWRRASRRSTAPGMTCDSGGRCRAEGLLWFTCSQNLIALQ

SEQ ID NO: 47822 - DNA, 767 bp, Zea mays
  misc_feature: Ceres CLONE 1456004-F
  misc_feature: Encodes the peptide sequence at SEQ ID NO. 47823
  misc_feature (742)..(742): n is a, c, t, g, unknown, or other
aaagctggagctccccgcggtggcggccgctctagaactagtggatcccccgggctgcaggaattcgcacgagaccattacctagaacatcctaatcgaaaaaccacgggcgcgggcgcggagaccgaccacctccacctcctccggttgccttcggcctcgactcccctccgtcctccccgtctccagcctcccggaccggaagctccacgtggcgcggcagctcgtacccggcgtctatggcggcggcagaagtgtactcgccgaccgcggcggcggcggcgcagcagcagcgggagaaggcggcgtcgcaggcgtggcggacggtggtagggtggatcggcttccttgttcaggttctgctccagatccttcgaggcacgccgtcctgcgcccagctcttatccttcgtcggcgtccgctacccgctcctctccgggcccacggcctcgaacccgtcgccggaggtggccttcatgccgcttcgctccgagatcccagctgacgcggcacctgccctgacacccgcgtctgagcctgagcccctgggccgcctcacggtagtgcttgacttggatgagactttagtttctgcatatgaatcatctagtcttcctactattgtacgtacacaagctgttgaagcaggattacattgctttgatatggaatgcatatcatctgataaggatgctgaaggaaaacagaaggtgaatcatgtgactgttttcgagcgtcctgntttgcatgagtcttgcagaaaacta

SEQ ID NO: 47823 - protein, 176 aa, Zea mays
  misc_feature: Ceres CLONE 1456004-F
  misc_feature (168)..(168): Xaa is any aa, unknown, or other
MAAAEVYSPTAAAAAQQQREKAASQAWRTVVGWIGFLVQVLLQILRGTPSCAQLLSFVGVRYPLLSGPTASNPSPEVAFMPLRSEIPADAAPALTPASEPEPLGRLTVVLDLDETLVSAYESSSLPTIVRTQAVEAGLHCFDMECISSDKDAEGKQKVNHVTVFERPXLHESCRKL

SEQ ID NO: 47824 - DNA, 710 bp, Zea mays
  misc_feature: Ceres CLONE 1456007-F
  misc_feature: Encodes the peptide sequence at SEQ ID NO. 47825
caaagctggagctccccgcggtggcggccgctctagaactagtggatcccccgggctgcaggaattcgcacgagaccattacctagaacatcctaatcgaaaaaccaagcgaccaagcctgcaagtcaccaagggagcccgatctgagtcaagcgagtcttcccgtttcatcgcctggaaaaaggcgagaaaccccaaagcgaaggaacagcagcgcgagtgctagcagcagcagcgattccttcgccataccgttcgctgcgctcgctcactcggatcgaaaccccctagggttcgcatcgtcctcccgccaactcctatccctcccctctccctccgccgcgcgcgcgcgtggagctaccaaaccctaggacggcaaatccggtgcgatcgcccacggtggaggcctctcggccgccgagaggagccgctcggggctcggatcagggttccggtacttcgccggtgccgcctctgggtggtgggaccggtggatggtcatgggagccagcggctccaagcttgagaaggccctcggagaccagttcccggaaggccagcgctacttcggcctcgagaacttcggcaacacctgctactggcacagtgtccttcaaaaaatctgcccaacagcaatatccggcataggggacaaccctgcttgaacccaaacctttccgggaaaaaaatttccccttgccgcgctagaa

SEQ ID NO: 47825 - protein, 56 aa, Zea mays
  misc_feature: Ceres CLONE 1456007-F
  misc_feature: SWISSPROT Homolog: EC 3.1.2.15 Ubiquitin thiolesterase
MVMGASGSKLEKALGDQFPEGQRYFGLENFGNTCYWHSVLQKICPTAISGIGDNPA

SEQ ID NO: 47826 - DNA, 712 bp, Zea mays
  misc_feature: Ceres CLONE 1456012-F
  misc_feature: Encodes the peptide sequence at SEQ ID NO. 47827
ctggagctccccgcggtggcggccgctctagaactagtggatcccccgggctgcaggaattcgcacgagaccattacctagaacatcctaatcgaaaacttttttttcctcgagtttcctattttcctctcctcccccacagcagctcggcgaaaaccctagtaagcaaaccaccggagcagcggcgcttgcgcgagcggagccatggcggacgacgattacaacgaaattgacatggggtatgaggatgagcccccagaaccggagattgaggaaggagctgaagaagagcctgagaacaatgaagatgcccctgatgacgtcataggtggtgagggtgaagataaggaacaggaaaagaccaagcgtgaacgcaaaacaacaaaatacatgacgaagtacgaacgtacgcgcatcctgggtacacgagccttgcagataagcatgaatgctccagttatggttgaacttgagggagaaactgaccctcttgagattgcaatgaaggagctgagagcgcgcaagatacccttcacgatcagacggtacttacctgatggaagctatgaagactggggagtagacgagctcattgtggaggactcctggaaacgccaggttggtggagactgaaaaggatctacttggcatggaaagggtatgtgggtgcagtgggtgtttcctgtagttacaagtctttcgttgccactaa

SEQ ID NO: 47827 - protein, 142 aa, Zea mays
  misc_feature: Ceres CLONE 1456012-F
  misc_feature (61)..(114): Pfam Name: RNA_pol_Rpb6 Pfam Description: RNA polymerase Rpb6
  misc_feature: SWISSPROT Homolog: EC 2.7.7.6 DNA-directed RNA polymerase
MADDDYNEIDMGYEDEPPEPEIEEGAEEEPENNEDAPDDVIGGEGEDKEQEKTKRERKTTKYMTKYERTRILGTRALQISMNAPVMVELEGETDPLEIAMKELRARKIPFTIRRYLPDGSYEDWGVDELIVEDSWKRQVGGD

SEQ ID NO: 47828 - DNA, 752 bp, Zea mays
  misc_feature: Ceres CLONE 1456014-F
  misc_feature: Encodes the peptide sequence at SEQ ID NO. 47829
  misc_feature (445)..(445): n is a, c, t, g, unknown, or other
  misc_feature (455)..(455): n is a, c, t, g, unknown, or other
  misc_feature (456)..(456): n is a, c, t, g, unknown, or other
  misc_feature (497)..(497): n is a, c, t, g, unknown, or other
aaagctggagctccccgcggtggcggccgctctagaactagtggatcccccgggctgcaggaattcgcacgagaccattacctagaacatcctaatcgaaaactccgaccacgactgtgcgccttcctaagtaaccctagctcggcgccctccctccgcgacatccaagcccggcaatctcatcgtcgcgcttgcaccgttacgcagtgcgacctctgcgtcttcgaatccaggtctctgcaggaaggtagagaggaggaggaggtttgtggcaggatttgaccagcccaatggttccatccgagatggggagcgtcgccaccgccgtcagcacgcctgctgcggacaagctgctccatgggcctatctctggcaagaagtgcaagaaaccaggcccgaggaagattcataaggctgagagggagaagcttaaacgagaccaccntaatgatctnncttgtgagctgggtaatatgctagaagcagatagacagaancatgggaaagcatgcatactgactgacactactcggatactaagagacctgcttgtccaagtaaatcccttccgaaggaacatagcgacctaccaaacggatctccttttgtacaatgggaagggatgaaatccagagaaaaccgggtggcccccaaaaaaatttccaaactctaaaaggtttgaaatgggggtttagggccccccaaggtggggccatggacccccaaaaaaaaacccccttttccaaaaaaag

SEQ ID NO: 47829 - protein, 111 aa, Zea mays
  misc_feature: Ceres CLONE 1456014-F
  misc_feature (52)..(52): Xaa is any aa, unknown, or other
  misc_feature (56)..(56): Xaa is any aa, unknown, or other
  misc_feature (69)..(69): Xaa is any aa, unknown, or other
MVPSEMGSVATAVSTPAADKLLHGPISGKKCKKPGPRKIHKAEREKLKRDHXNDLXCELGNMLEADRQXHGKACILTDTTRILRDLLVQVNPFRRNIATYQTDLLLYNGKG

SEQ ID NO: 47830 - DNA, 806 bp, Zea mays
  misc_feature: Ceres CLONE 1456015-F
  misc_feature: Encodes the peptide sequence at SEQ ID NO. 47831
  misc_feature (337)..(337): n is a, c, t, g, unknown, or other
  misc_feature (382)..(382): n is a, c, t, g, unknown, or other
  misc_feature (393)..(393): n is a, c, t, g, unknown, or other
  misc_feature (436)..(436): n is a, c, t, g, unknown, or other
  misc_feature (438)..(438): n is a, c, t, g, unknown, or other
ctggagctccccgcggtggcggccgctctagaactagtggatcccccgggctgcaggaattcgcacgagaccattacctagaacatcctaatcgaaaactcatgagccagccgccacccccacgtccccacccatccgccagccccaggcttctagcctctgtcccagccggcagcccaccacccgcgaggccgcgaccggcgaccgcccgcccctgacgcggtgactgcgtcctcctccgctctccgtgcgccaccctgaagcggtgaggcggcgacctccaggcacctccctcccccggttcggcggctccctcgaggccttcctccccacgggntcagcagctcccgaatcacacggccaaaggccgattcgcgctccntcagccttccntcgggtccaacagcaagggaaaaaacttcaaccaggaattggncnatgtcctggaacaaaagggttaaagcaatggggttgttcccaagggattgccgctcaattgtggaaaaagcaaaaattttgcattttgcaccaaaggaaaaaaaagggggaaaggttaatcttgaaaaaatcccggctctcccccaaaccttaaaagaccaaagggttcggggaaaaactttcaagaggggggtttttcccaaaaccccccccccctcgaatccccggggcgggggggttttttcccaaaacccgccctttttaatggcgcggggaaaaaaaacccaacacctttttttaaaaaacaaaagtttttttttttggcccccccccccccaaaaaaaaaaggacccccccctcaaaaaaca

SEQ ID NO: 47831 - protein, 122 aa, Zea mays
  misc_feature: Ceres CLONE 1456015-F
MSWNKRVKAMGLFPRDCRSIVEKAKILHFAPKEKKGGKVNLEKIPALPQTLKDQRVRGKTFKRGVFPKTPPPSNPRGGGVFSQNPPFLMARGKKTQHLFLKNKSFFFWPPPPQKKKDPPLKK

SEQ ID NO: 47832 - DNA, 699 bp, Zea mays
  misc_feature: Ceres CLONE 1456016-F
  misc_feature: Encodes the peptide sequence at SEQ ID NO. 47833
  misc_feature (276)..(276): n is a, c, t, g, unknown, or other
  misc_feature (291)..(291): n is a, c, t, g, unknown, or other
  misc_feature (296)..(296): n is a, c, t, g, unknown, or other
  misc_feature (315)..(315): n is a, c, t, g, unknown, or other
  misc_feature (339)..(339): n is a, c, t, g, unknown, or other
  misc_feature (340)..(340): n is a, c, t, g, unknown, or other
  misc_feature (382)..(382): n is a, c, t, g, unknown, or other
ctggagctccccgcggtggcggccgctctagaactagtggatcccccgggctgcaggaattcgcacgagaccattacctagaacatcctaatcgaaaaatctccgcagtgcaaagcgtcaacgcaaaccgaccaagatccagaagcaagaaagtgtctatagcctagccggtgcgcgcgcgagaggaatagccgattatcatcaagctctgagctagcagcgaagatgagcgcgtcgtcgtccatgaccaagaagacgtcgtcgttcgtggtggcngcaagcatgagcgcngtggnaagcgctcaaggacccagncggggctgtgcccggtggactacnngctccgctccctttaaaacggcgggggcgccccaaataggtnggtcccgggccggcccttcccgttgcctttgccccctccaaaacccggggggcattggcacccccccgcccccggtagggcccccggccccggggtttgggggaggaaaattccaaggggtcccctcctttggggggggggcccataatatgtggggggcgctcctttaataaaaccccttaaaaaggggggggaaaaacccccccttttgtgggacccaccaaaaaagaggtccccccaatttttggggtggcccccccccgcgggggttttccccccaaaaattatttttttttggggggagaaaaaaaaagaaa

SEQ ID NO: 47833 - protein, 108 aa, Zea mays
  misc_feature: Ceres CLONE 1456016-F
  misc_feature (24)..(24): Xaa is any aa, unknown, or other
  misc_feature (30)..(30): Xaa is any aa, unknown, or other
  misc_feature (39)..(39): Xaa is any aa, unknown, or other
  misc_feature (53)..(53): Xaa is any aa, unknown, or other
MSASSSMTKKTSSFVVAASMSAVXSAQGPXRGCARWTTXSAPFKTAGAPQIGXSRAGPSRCLCPLQNPGGIGTPPPPVGPPAPGFGGGKFQGVPSFGGGAHNMWGALL

SEQ ID NO: 47834 - DNA, 774 bp, Zea mays
  misc_feature: Ceres CLONE 1456017-F
  misc_feature: Encodes the peptide sequence at SEQ ID NO. 47835
  misc_feature (411)..(411): n is a, c, t, g, unknown, or other
  misc_feature (457)..(457): n is a, c, t, g, unknown, or other
  misc_feature (518)..(518): n is a, c, t, g, unknown, or other
  misc_feature (610)..(610): n is a, c, t, g, unknown, or other
ctggagctccccgcggtggcggccgctctagaactagtggatcccccgggctgcaggaattcgcacgagaccattacctagaacatcctaatcgaaaaaggatttccctcttccatatgccgatctcccggacacggtggcctcccgctgccggagcgccatcgccgccgcagcaagcggcgcagggtacggtttccgccgtggcgccgaagcgtcgacccgtcgtgggttcccgttctcggcccgcgaaggaggcggaggccacggctcgacttccgtctgcggactactactcagagctaaagaccctggagcatgtagagaaaaccaaaaaatatcagggtaagcttgcagcacagttgaaggccaaatatttttcccaacagacttttgaaaaaggatacgtgttcnaagaaatttgtatagggtcccaagacatcccggctaagcaggtggncgttttacaagggtggtttgcagatcccagaaaaattttgccaaagaaaagacctctactngtgaggacaatgtctccatcttctgactgtggaacccatgtgaaatggttcagtacctcttttacctctggcccccccgacgaaaaaactcngaggctcgggccctaaactttatccgtttccctcaaaacggggactgggtggtttccccaggcccagttaaccctggacagttttaacccaagggaggttccctttttccccgaaaagggggggccccaaacccagaccgggggaaatccccattcctttttta

SEQ ID NO: 47835 - protein, 169 aa, Zea mays
  misc_feature: Ceres CLONE 1456017-F
  misc_feature (99)..(99): Xaa is any aa, unknown, or other
  misc_feature (114)..(114): Xaa is any aa, unknown, or other
  misc_feature (165)..(165): Xaa is any aa, unknown, or other
MPISRTRWPPAAGAPSPPQQAAQGTVSAVAPKRRPVVGSRSRPAKEAEATARLPSADYYSELKTLEHVEKTKKYQGKLAAQLKAKYFSQQTFEKGYVFXEICIGSQDIPAKQVXVLQGWFADPRKILPKKRPLLVRTMSPSSDCGTHVKWFSTSFTSGPPDEKTXRLGP

SEQ ID NO: 47836 - DNA, 804 bp, Zea mays
  misc_feature: Ceres CLONE 1456020-F
  misc_feature (415)..(415): n is a, c, t, g, unknown, or other
  misc_feature (423)..(423): n is a, c, t, g, unknown, or other
  misc_feature (487)..(487): n is a, c, t, g, unknown, or other
  misc_feature (501)..(501): n is a, c, t, g, unknown, or other
aagctggagctccccgcggtggcggccgctctataactagtggatcccccgggctgcaggaattcgcacgagaccattacctagaacatcctaatcgaaaaattcaatccctggggaactcctggcacgaggaagaaacaagacagggacctgactgcaccttatgttgatgatggactcattgaggttgtcggctttcgtgatgcctggcatggtctcgttttgctggcccctaatggacacggaactcgtctagcgcaggctcacagaatccggtttgagttccacaaaggagcagccgaccacacgttcatgagggtcgacggtgagccatggaagcagccactccccagcaacgacgagaccgtcgtggtcgagatctcccacctccgtcaggtcaccatgctcgccaacngccactgncagtcgaagagcgtcgagaaacccgcgaccccgtcaagccacgggcatgagaacgacgacggcnacagcctggagacnaagatgattggaaggagggaaggaaaaatttgggggcttccaaccccctcaagtttccttaacaaggcaacatccccccctttaactgatttctttacccaggttccggggacttgtccaaatggttcaaatttcaaaaaccccccccccgcggggggaggggaaaaaaccccctttggttttggggggaaattttggagagggaaaaacccccttttggaaaaaaaaaaaaaaaaattttttttccccccccccccccgggggggggcccgcgccacccctccccccaatgaggggaaaaac

SEQ ID NO: 47837 - DNA, 719 bp, Zea mays
  misc_feature: Ceres CLONE 1456021-F
  misc_feature: Encodes the peptide sequence at SEQ ID NO. 47838
ggagctccccgcggtggcggccgctctagaactagtggatcccccgggctgcaggaattcgcacgagaccattacctagaacatcctaatcgaaaagactctttcatttccttctaccgcagcctcagaattcccccctcccccgtagcgaaaccctagccgccacgccaaaaccaaatcccgccgagcccgaaattttccggcgggttccttgccgcgaatcgattgatttcgagcgattcgactcctttgtgatctctcggcggggtagagcgcggtcgaccgtcggccatgtcgaggtgcttcccctacccgccaccggggtacgtgcggaacccagtggccgtggccgagccggagtcgaccgctaaggtttgttgaaccttcggatttacacacgcaccccccaaatcgtttgttcaatctgtaggttttgcgcggatctgtggtttgcgcgtgcgtgatgtgggtattgcccgtgccttgaaagctaaccgaagctgaggaagtgtatggatcttgtgtagctgcacgaggtcctccaaatcgattgtaaaatttaagttgtatggcccggaaggccaagattgggttagtcccggttttccaaaactggtagcatggttatcggggacatttgaaggaatggtagaacatcaaactccatttcaaaaatgggcctagatttgcatatttaggccgccctaaaattacggggg

SEQ ID NO: 47838 - protein, 29 aa, Zea mays
  misc_feature: Ceres CLONE 1456021-F
MSRCFPYPPPGYVRNPVAVAEPESTAKVC

SEQ ID NO: 47839 - DNA, 755 bp, Zea mays
  misc_feature: Ceres CLONE 1456023-F
  misc_feature: Encodes the peptide sequence at SEQ ID NO. 47840
  misc_feature (155)..(155): n is a, c, t, g, unknown, or other
  misc_feature (169)..(169): n is a, c, t, g, unknown, or other
  misc_feature (384)..(384): n is a, c, t, g, unknown, or other
  misc_feature (408)..(408): n is a, c, t, g, unknown, or other
ggagctccccgcggtggcggccgctctagaactagtggatcccccgggctgcaggaattcgcacgagaccattacctagaacatcctaatcgaaaaacacacactctctctccactggctgacgccgcgaccgccccaacccaacctcccttttncggagatctcgccngcctccgccgtcgacttccgtcgcccccctatcccgcgtccgggcttacccgatggcacggctgcactggcttgaggctgtcctgccgctggggatcatcggcggcatgctctgcatcatgggcaacgcccagtatttcatccacaaggccgcgcacggcagggcgaagcacatcgggaacgatatgtgggacgtcgccatggagcgccgcgacnagaagctcgtggaaacatcctccnggcactaggggattgatccaccctcaacttttctggaaggtgaacaacctcgttcaaaagccaaaaggacgggccttttgtttccgggacaattgagaccaaaacttggttgttttgctttgaaaatcaaccgttcggaaaaaaaatcggtccgaacccctgtttattgaaaaaccaaaaatttttgcaagtggtggagaaaattatttcccccccgggggaattttttaccccaaaaaaaccttttttcaaaaaaaaaaaaaaaatttttttcccccccccccggggggggggccgaccccccccccccaaaagggagaaatacgcccccccgggcggtgttaaaa

SEQ ID NO: 47840 - protein, 64 aa, Zea mays
  misc_feature: Ceres CLONE 1456023-F
  misc_feature (55)..(55): Xaa is any aa, unknown, or other
  misc_feature (63)..(63): Xaa is any aa, unknown, or other
MARLHWLEAVLPLGIIGGMLCIMGNAQYFIHKAAHGRAKHIGNDMWDVAMERRDXKLVETSSXH

SEQ ID NO: 47841 - DNA, 832 bp, Zea mays
  misc_feature: Ceres CLONE 1456026-F
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (54)..(54): n is a, c, t, g, unknown, or other
  misc_feature (435)..(435): n is a, c, t, g, unknown, or other
taatgttgttatagagccctacttcaacaccnnnannnnaannnntaaaaaaanacaaagctggagctccccgcggtggcggccgctctttaatagtggatcccccgggctgcaggtattctcacgagaccattacctagaacatcctaatcgaaaagatcaaaatgaaaattactgagatgtcccctcggacacacagtggtcaaccgacgccgccggtgggtgcccggaatcccggatccttgtccgccctcctgctcactccactcgcctgccagccgcacaccaatcacctctgcggccggcggcgtctgcaacgccagtctctgatccgaccccgatcggcacacacgttctccatggcggagcagctcggatcccaagatgctcccaatccccctgctccggcacagagggtactggtgatttaatacncatggggaaaaaactcctcggcctgcttgcaccaccccccccccagaacaaggggtgggtagcccccccagccaaggacctaacggggttccaagggataattagccgtcttccaccggacccctgcgggttggagttaacctaagcaaaggaaattaaaggcgttctccccttctaaacttaaaccgaaaattggaaaaaagtgggagggggaattttcctcgaaccggcacctaccaaaaagggaggggtgctttaacttggccaccccgggtcgcccttcggaaagagccccccagaggaaaaattactacaccttacacaggcatattgttggggttcctcccccacaaggggggagctctggggtccctcacacaataaccccccccgaaca

SEQ ID NO: 47842 - DNA, 770 bp, Zea mays
  misc_feature: Ceres CLONE 1456030-F
  misc_feature: Encodes the peptide sequence at SEQ ID NO. 47843
aagctggagctccccgcggtggcggccgctctagaactagtggatcccccgggctgcaggaattcgcacgagaccattacctagaacatcctaatcgaaaaatcttccaccgcgcttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagctcgccaagctgaagaaggcgtccacggcttaaggagtctctttccgtgaatgtcatgttagagtttttggttatgagttggatcagcaattcgattgagcgttgtcaaagccagaattaccaatatgttccctgtaaacccatttcaactttatcaagcacgggcgtgctcaggatacttttgccatgaatgatatggaatatctatgggtagcttgtggcaaaaaaaaaa

SEQ ID NO: 47843 - protein, 134 aa, Zea mays; identical to SEQ ID NO: 12674
  misc_feature: Ceres CLONE 1456030-F
  misc_feature (44)..(120): Pfam Name: Ribosomal_L14e Pfam Description: Ribosomal protein L14

SEQ ID NO: 47844 - DNA, 747 bp, Zea mays
  misc_feature: Ceres CLONE 1456032-F
  misc_feature: Encodes the peptide sequence at SEQ ID NO. 47845
  misc_feature (369)..(369): n is a, c, t, g, unknown, or other
  misc_feature (411)..(411): n is a, c, t, g, unknown, or other
tggagctccccgcggtggcggccgctctagaactagtggatcccccgggctgcaggaattcgcacgagaccattacctagaacatcctaatcgaaaaatacgatctcatcacacttcttagttaccatctccagcgaccttcctcgggggtgctagccggatccgcgatcgtcgaaatcccaagctcctccacaggcccgagggtcggtcgtcctcatggcggggatcctggcgtgggcggctgacgtggtcggcggggccggcggcagcgacgacgaggcggactacgacgcgcgcgccgcggcgtcggccgccataaccccggcccagcggctccgcgccgccgacctggacgcgcgggaggtctcnctgcgccgcgccatccaggacctccgcctcagggtgcccccnccacacgtcgcgcagggcctgcccccactccacgccgactcactcgcgtcgtccgccgcgctcgcgctccagctcaacgggcactcctccacaaggagcagacccaccaaagagaagtacctctccaagaggaaaatgcagcctatgagaaagctatatccgagtgtaaacagaaaatttccggaaaagcgaaggaggccactcagcttctgagtaatccggaggaaatgggagtaaccaaacttaatttaaaacccagcttggaaaatgctcggaaggagctaaaggctgctcaacataaaacatccaaccgcaacctctggaaaaggtgaaaat

SEQ ID NO: 47845 - protein, 135 aa, Zea mays
  misc_feature: Ceres CLONE 1456032-F
MAGILAWAADVVGGAGGSDDEADYDARAAASAAITPAQRLRAADLDAREVSLRRAIQDLRLRVPPPHVAQGLPPLHADSLASSAALALQLNGHSSTRSRPTKEKYLSKRKMQPMRKLYPSVNRKFPEKRRRPLSF

SEQ ID NO: 47846 - DNA, 806 bp, Zea mays
  misc_feature: Ceres CLONE 1456033-F
  misc_feature (363)..(363): n is a, c, t, g, unknown, or other
  misc_feature (451)..(451): n is a, c, t, g, unknown, or other
  misc_feature (765)..(765): n is a, c, t, g, unknown, or other
  misc_feature (769)..(769): n is a, c, t, g, unknown, or other
gctctgaactagtggatcccccgggctgcaggaattcgcacgagaccattacctagaacatcctaatcgaaaaagcgtgtctcgtgctccccccaggctcctcttcctcgctttccctccaccccgggcgcaaaccctaaccctaccgtcgctcgccccgcggcgtctgccaatggggcgccccgtgtgagtgtgcccgagagaggggtagaccttgaggccgctacccggggaggacagcgagagatgtatcaacatgccgcagcgcggggaggggctgggctgggaccggaagcggataaacgacgcgttggaaaccatgttgggaagggggtgggtgggggccccaaagggggggggggncagaaaaaattatattaaaaaaaccgaactttccccccagacgaccagccacgtacgccctcccccacacccccaccccaaaaaaaanaaaccaagagtgtgaacggcaaataccctgcacgcttggtggttttcagatcttgcaaatcctctcgccggcgttttgtggatttcttcaacgcgaacgtgggagttgggttcgtccctatggcacctcactgagtggatcctcttagtgtatggatgtctccctgtggtgaggcggctcgctttctgtcaggggtgtcagtttgtctggcacgctgcctcgcgctcccgtcttttgatgcggtcgagtggtcaatagttgcagactcgtcttatctctcgcctcttttcccgtaggtctcttgtgtgttgggnacgntcgtgcacgtttgctgctcctcctcaaggtgtcgtgg

SEQ ID NO: 47847 - DNA, 765 bp, Zea mays
  misc_feature: Ceres CLONE 1456035-F
  misc_feature: Encodes the peptide sequence at SEQ ID NO. 47848
  misc_feature (376)..(376): n is a, c, t, g, unknown, or other
  misc_feature (380)..(380): n is a, c, t, g, unknown, or other
  misc_feature (400)..(400): n is a, c, t, g, unknown, or other
  misc_feature (412)..(412): n is a, c, t, g, unknown, or other
aagctggagctccccgcggtggcggccgctctagtttcagtggatcccccgggctgcaggaattctcacgagaccattacctacaacatcctaatcgaaaagttttcttcggaggctttatttatcatttatccacggaacttccggtgccggcggcgaccacttgtggcgatccatccctcaccatgtcgtcggaaaaggaggcggcgctcgccgccgtgctcgatgacagcccaaccatatttgacaagatcatcaaaaaggaaataccttctactgtggtttatgaggacgagaaggtactggctttcagggacataaaccctcaagctccaacacacattctcatcatccccaaagtcaaggatggattaantggnctggaaaagggtgaacacangcacatatacanaccccgccgcctcctctatgttgccaaggttgttgcgaagcacgaaggacttgaagatggctatcgcgtcgtcatcaatgacggcccaagtggatgtcaatctgtttaccacatccacgttcatctcctcggaggcaggcaaatgaactggcccccaggctaaaaatatcttgtgattgatcagtgctaatgccaaggactgctactccatttctctaaaaaaatccctgtaatttccattaaaactagtgcgcagtgcgctcaccttgtgctatattttggggaattaccggaagcatgctgctgttatctaaaaaaaaaaaaaaaaaacttaatcaataccgtccaacctc

SEQ ID NO: 47848 - protein, 129 aa, Zea mays
  misc_feature: Ceres CLONE 1456035-F
  misc_feature (25)..(124): Pfam Name: HIT Pfam Description: HIT domain
  misc_feature: SWISSPROT Homolog: EC 3.6.1.29 Bis(5'-adenosyl)-triphosphatase
  misc_feature (64)..(64): Xaa is any aa, unknown, or other
  misc_feature (72)..(72): Xaa is any aa, unknown, or other
  misc_feature (76)..(76): Xaa is any aa, unknown, or other
MSSEKEAALAAVLDDSPTIFDKIIKKEIPSTVVYEDEKVLAFRDINPQAPTHILIIPKVKDGLXGLEKGEHXHIYXPRRLLYVAKVVAKHEGLEDGYRVVINDGPSGCQSVYHIHVHLLGGRQMNWPPG

SEQ ID NO: 47849 - DNA, 762 bp, Zea mays
  misc_feature: Ceres CLONE 1456039-F
  misc_feature: Encodes the peptide sequence at SEQ ID NO. 47850
  misc_feature (418)..(418): n is a, c, t, g, unknown, or other
  misc_feature (430)..(430): n is a, c, t, g, unknown, or other
  misc_feature (468)..(468): n is a, c, t, g, unknown, or other
tggagctccccgcggtggcggccgctctagaactagtggatcccccgggctgcaggaattcgcacgagaccattacctagaacatccaatcgaaaaaaagcatcttgagtgttcgacagcgagccatggagaagacgtccgagaacgccatcccgccggcggcatccccgctgatgctgttcgggtcgtgggcgagctcgtacacgcaccgcgtgcagctggcgctgcggctcaagggcctggagtacgactacgtggaggaggacctggggaacaagagcgacgagctgctgcgccacaaccccgtccacaagaaggtgcccgtgctcgtccacggcggccgcgcgctcccggagtccgtcattatcctccagtaccttgacgacgcctgggcggagacccgcccgctgctccccgncgacgccttcgnacgcgcgctcgggcgggttctggtgccacttcccgaanaacaacttggggccggcggtgggcccgggttcccttccacgggggagggcccggaggcggcggtgcggcagtggcccaaaaacctggctttattaaacccaaatccccgaagggcgttttcggggcccccttttttttgggggaaaaaggggggctggggaacccccccgggggggggccccccagggtcccccgtttaaagagggggagggggggccccctggagaccaaacccttcccccctctccccgcgggggggccttttagcgcgggagaggggggagagaccccccg

SEQ ID NO: 47850 - protein, 180 aa, Zea mays
  misc_feature: Ceres CLONE 1456039-F
  misc_feature (14)..(87): Pfam Name: GST_N Pfam Description: Glutathione S-transferase, N-terminal domain
  misc_feature: SWISSPROT Homolog: EC 2.5.1.18 Glutathione transferase
  misc_feature (98)..(98): Xaa is any aa, unknown, or other
  misc_feature (102)..(102): Xaa is any aa, unknown, or other
  misc_feature (115)..(115): Xaa is any aa, unknown, or other
MEKTSENAIPPAASPLMLFGSWASSYTHRVQLALRLKGLEYDYVEEDLGNKSDELLRHNPVHKKVPVLVHGGRALPESVIILQYLDDAWAETRPLLPXDAFXRALGRVLVPLPEXQLGAGGGPGFPSTGEGPEAAVRQWPKNLALLNPNPRRAFSGPPFFWGKKGGWGTPPGGGPPGSPV

SEQ ID NO: 47851 - DNA, 766 bp, Zea mays
  misc_feature: Ceres CLONE 1456040-F
  misc_feature: Encodes the peptide sequence at SEQ ID NO. 47852
  misc_feature (585)..(585): n is a, c, t, g, unknown, or other
  misc_feature (587)..(587): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaaacattcacatcgcactctcctccagcctccaggcttggcaagcgtgcttcacatgaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacccctccctggacctcggcgagttcagggcgttccacgcgcgcggcggcggcggcgtggacaacgacgccgagctccgcgccgccttcgacgtctacgacgtcgacggcgacggccgcgtcacggcggccgagctgggcaaggtgctcgcgcgcatcggcgagggcggatgcancnccaaggagtgcgagcggatggtcgccggcgtcaacgccgacngctgcgtcgggttcgaggacttcaagaagatgatgtgccccccagcgcaaagcgaaacccggcgccgccgggcgggacagggcagaagcccgagccgaagaacaaggaggaatgacgggtgtagtcaggggggaact

SEQ ID NO: 47852 - protein, 200 aa, Zea mays
  misc_feature: Ceres CLONE 1456040-F
  misc_feature (106)..(134): Pfam Name: efhand Pfam Description: EF hand
  misc_feature (29)..(57): Pfam Name: efhand Pfam Description: EF hand
  misc_feature: SWISSPROT Homolog: EC 2.7.11.1 Non-specific serine/threonine protein kinase
  misc_feature (140)..(140): Xaa is any aa, unknown, or other
  misc_feature (141)..(141): Xaa is any aa, unknown, or other
  misc_feature (155)..(155): Xaa is any aa, unknown, or other
MSNSAASEKQSQQAGHRQRPPAASAADAEMQRVFCRIDADGDGRISASELAAVTRAISPPASSSHGRREVAAMMDELDTDRDPSLDLGEFRAFHARGGGGVDNDAELRAAFDVYDVDGDGRVTAAELGKVLARIGEGGCXXKECERMVAGVNADXCVGFEDFKKMMCPPAQSETRRRRAGQGRSPSRRTRRNDGCSQGGT

SEQ ID NO: 47853 - DNA, 862 bp, Zea mays
  misc_feature: Ceres CLONE 1456046-F
  misc_feature: Encodes the peptide sequence at SEQ ID NO. 47854
  misc_feature (13)..(13): n is a, c, t, g, unknown, or other
  misc_feature (19)..(19): n is a, c, t, g, unknown, or other
  misc_feature (20)..(20): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (316)..(316): n is a, c, t, g, unknown, or other
  misc_feature (348)..(348): n is a, c, t, g, unknown, or other
  misc_feature (424)..(424): n is a, c, t, g, unknown, or other
  misc_feature (427)..(427): n is a, c, t, g, unknown, or other
  misc_feature (464)..(464): n is a, c, t, g, unknown, or other
  misc_feature (466)..(466): n is a, c, t, g, unknown, or other
  misc_feature (467)..(467): n is a, c, t, g, unknown, or other
  misc_feature (478)..(478): n is a, c, t, g, unknown, or other
  misc_feature (479)..(479): n is a, c, t, g, unknown, or other
  misc_feature (481)..(481): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (515)..(515): n is a, c, t, g, unknown, or other
  misc_feature (519)..(519): n is a, c, t, g, unknown, or other
  misc_feature (528)..(528): n is a, c, t, g, unknown, or other
  misc_feature (553)..(553): n is a, c, t, g, unknown, or other
  misc_feature (597)..(597): n is a, c, t, g, unknown, or other
  misc_feature (599)..(599): n is a, c, t, g, unknown, or other
  misc_feature (666)..(666): n is a, c, t, g, unknown, or other
  misc_feature (667)..(667): n is a, c, t, g, unknown, or other
  misc_feature (674)..(674): n is a, c, t, g, unknown, or other
  misc_feature (677)..(677): n is a, c, t, g, unknown, or other
  misc_feature (725)..(725): n is a, c, t, g, unknown, or other
  misc_feature (735)..(735): n is a, c, t, g, unknown, or other
  misc_feature (754)..(754): n is a, c, t, g, unknown, or other
  misc_feature (859)..(859): n is a, c, t, g, unknown, or other
gtgccggcgcccnaccccnncccaccccnnnnnnnnaaaaannnnnaaaaaggggggctccaccccggtgggggccgccctacaactagtggagccccccggctgcagggattcccccgagaccattacctagagactcctaatcgaaaatatttgagtcgacgcccgctctgaatggctacaagtccagcagtggtcacaaccagtaacgcacgatcgatgcgaccggcaatacctacctccgctggatccagagcacttggcacaaatttgcaggattagaggcgtactgtatctgatcctactgtacgatcancctcggcggcggcggcaagaaggaaggatggnacagtgccttccaaagtacctgttgatacgaaaaatatggatgcacggaagaagagtttgtatagtttatgggggnaancttgaggtgggcagcatttggattggtgtggagatancnnaccagctcgtnncnaannntggcaaagaaacaattacttcgggcaggnatcncgaagaccntgggcttcaggaagggaagggggtnatgggcctgggacaaaggtgaataatggggtgctggggggagtncnttaggtggacatctcgtatgtgcgaatggctaggttttttgggcaagaaacactggacctattatgnnttgtggnccntcccccattcatggtaccctctatcgcgcaacagctaggttccactcnctctatggcngaaataccagtggtttaancaattccgcggtctagagaaccagcgccggcctcggccccccccctctcccgacccgtggtcattcccctcccaaagcgtgccgtcggcgcggccccacagaacnggg

SEQ ID NO: 47854 - protein, 35 aa, Zea mays
  misc_feature: Ceres CLONE 1456046-F
MATSPAVVTTSNARSMRPAIPTSAGSRALGTNLQD

SEQ ID NO: 47855 - DNA, 782 bp, Zea mays
  misc_feature: Ceres CLONE 1456048-F
  misc_feature: Encodes the peptide sequence at SEQ ID NO. 47856
  misc_feature (418)..(418): n is a, c, t, g, unknown, or other
  misc_feature (421)..(421): n is a, c, t, g, unknown, or other
  misc_feature (503)..(503): n is a, c, t, g, unknown, or other
ctggagctccccgcggtggcggccgctctagaactagtggatcccccgggctgcaggaattcgcacgagaccattacctagaacatcctaatcgaaaattttcactgctccagcgaaggcactagccgccgccgtttccatctccccggcgctccatcgctgggcacgcaggcgacggcgacggcgctcaggctcgtgctctcagggacggcgtcagctgcttcctttcccgcctcttgccagtagcctcgcgccctcctttgctcctccgcacggctgacatacatagactgatggcaacactgaaagatgcagcagcaaggaagtctatactggcaacaatccgtcttgttgtcccagccggtgcagcccgtcctgcacctccagttggtccagcacttggtttctacccgctcanttngatggctttttgcaaggacttcaatgcccggacccaaaaatacaaggcaaaaactccatgcaagtcaccctaactggctacnaaggaagcaccttccaagtcctggccaagccgccccgggtatcagggttcccccaaaaggcgacgggaattaaaacgcccggttcccccaaaccggggaaaagtttccccccccccccccccccctttcaaaaattccaaattaaaaggggggacccccttggaaagaaattttttttgggggggggtggagaccccttgggggccccccacctctgggggttgtggttttgaaaaattttgaaccccaccccccccttttttataaaaaaaaagtgtt

SEQ ID NO: 47856 - protein, 66 aa, Zea mays
  misc_feature: Ceres CLONE 1456048-F
  misc_feature (16)..(62): Pfam Name: Ribosomal_L11_N Pfam Description: Ribosomal protein L11, N-terminal domain
  misc_feature (42)..(42): Xaa is any aa, unknown, or other
  misc_feature (43)..(43): Xaa is any aa, unknown, or other
MATLKDAAARKSILATIRLVVPAGAARPAPPVGPALGFYPLXXMAFCKDFNARTQKYKAKTPCKSP

SEQ ID NO: 47857 - DNA, 738 bp, Zea mays
  misc_feature: Ceres CLONE 1456060-F
  misc_feature: Encodes the peptide sequence at SEQ ID NO. 47858
aaagctggagctccccgcggtggcggccgctctagaactagtggatcccccgggctgcaggaattctcactatacctttacctaaaacatcctaggcgtaaatgacgtgcgatttccgcccgtcaaagaatcagagctctgaggctgctcacatcacgccaccaccaacccctcacgtcggcggttggcgtcctcggcgaacgcagagatggcgtccgtggccgcagcggaggtcgcggcggcggcgctccggtcggtgctgtcgcgcgcgcatcatgcggcggcgcgggcggggcgcgcgccggggtccgtgcgcgtggtggcggtgagcaagaccaagccggtgcctgtcatccggggcgtctaggaagcgggccaccgctgcttcggcgagaactacgtccaggagcccaccgacaaggcgcctcagcttcctgaggatgttgagtggcacttcattgggaatctgcaaagcaacaaagccagagccctacttgctggcgtgccaaaccttgatatggttgagagtgtcgatgatgagaagattgctaaccgtactgatcgagtgttagctgacttggggagaaaaccccttaggttttggttcaagtcatcactactgaagaaaaatcgaaatttggagtacatcccctcgggagctagaaaactagcaaagtaggcaaactgaactgccccgaaccttgtgttctctgggcctgatagaaaattgggatgcct

SEQ ID NO: 47858 - protein, 52 aa, Zea mays
  misc_feature: Ceres CLONE 1456060-F
MASVAAAEVAAAALRSVLSRAHHAAARAGRAPGSVRVVAVSKTKPVPVIRGV

SEQ ID NO: 47859 - DNA, 748 bp, Zea mays
  misc_feature: Ceres CLONE 1456065-F
  misc_feature: Encodes the peptide sequence at SEQ ID NO. 47860
  misc_feature (349)..(349): n is a, c, t, g, unknown, or other
  misc_feature (415)..(415): n is a, c, t, g, unknown, or other
  misc_feature (471)..(471): n is a, c, t, g, unknown, or other
ctggagctccccgcggtggcggccgctctagaactagtggatcccccgggctgcaggaattcgcacgagaccattacctagaacatcctaatcgaaaaattgccatccatcacatcctctcccaccttactcaagctagtgcgagcatagcaatggggttcgcccggaagagtggagttgcagcagtaggggtttggtggctcctcctgctcgccggcgtgctgttgcctttggcggcggcatttggccggcacgccgatgccggcaacggacatgtgcgacatcaagtgccagcatcacagcgacccggccagaaggcagcagtgcgtggatgagtgccatagccggnagcaccatcaccctagcagagagttttgcgagatgaagtgccagcaccacatgaccctgcaggaangagatctgcgtacagcagtgcatgagctatggtctcagcccacgtgccagtgccantgttgtttaatagggtgaaaacccttccatggttggaaacaacgggggccggaggaatcctcagggggggggaccaccttccaattttttaaccgcccccctaaataaaaaaaaacctcccccccgtttccctataatatatgcctgcctgcctaaaaaaatccgggcaaaggcaaaaaaaaagggggggaaaaaaaaagcccgcgggtgttcctatattctccgagaatccccaaattttttttaaagcgtttttttttaaaaaaaaaaaaattct

SEQ ID NO: 47860 - protein, 76 aa, Zea mays
  misc_feature: Ceres CLONE 1456065-F
  misc_feature (31)..(31): Xaa is any aa, unknown, or other
  misc_feature (53)..(53): Xaa is any aa, unknown, or other
  misc_feature (71)..(71): Xaa is any aa, unknown, or other
MPATDMCDIKCQHHSDPARRQQCVDECHSRXHHHPSREFCEMKCQHHMTLQEXDLRTAVHELWSQPTCQCXCCLIG

SEQ ID NO: 47861 - DNA, 727 bp, Zea mays
  misc_feature: Ceres CLONE 1456066-F
  misc_feature: Encodes the peptide sequence at SEQ ID NO. 47862
  misc_feature (500)..(500): n is a, c, t, g, unknown, or other
  misc_feature (596)..(596): n is a, c, t, g, unknown, or other
ctggagctccccgcggtggcggccgctctagaactagtggatcccccgggctgcaggaattcgcacgagaccattacctagaacatcctaatcgaaaaaaaaacctccccagctgccacctcctctgcctccctgcgtcccccgagcaaagcagaacaaggggggaaaaagttgacatacgcttgcagcgatggcctttgccgcccgcgccgcgctcgtgcgcgtcctccctccgcgaccatcgccgacctcccaaccgaagcagctcaagcaaggtctaggcggccgcggcgggtcctcgctcgccgttcgggcgaaggactccgatgacttcggggcccttctgtcggagaagctcgatgcgcaggcgcctgagaagcgggatgggcgggatggttttgggagggaggcgagtagcgtggaggaggagaaggaggtgcagggcgagccggcttcgtggggtgtgctcaaccagatcggcgtcgagttggactctgacnaatcatattctgctctcatatatggcacatctgctctttgttgcatttggatatcatccatttgtggtttctgcacttgattcagtcccctttggntcctcaagtgatggaaagttgtttggccttggcttcccaatttgggtcacatcaagatacctgatatttaaggagacccgtgatgaacttttcccgaaagtcaccttcatcaagaaccaaatttgggggct

SEQ ID NO: 47862 - protein, 129 aa, Zea mays
  misc_feature: Ceres CLONE 1456066-F
  misc_feature (104)..(104): Xaa is any aa, unknown, or other
MAFAARAALVRVLPPRPSPTSQPKQLKQGLGGRGGSSLAVRAKDSDDFGALLSEKLDAQAPEKRDGRDGFGREASSVEEEKEVQGEPASWGVLNQIGVELDSDXSYSALIYGTSALCCIWISSICGFCT

SEQ ID NO: 47863 - DNA, 796 bp, Zea mays
  misc_feature: Ceres CLONE 1456077-F
  misc_feature: Encodes the peptide sequence at SEQ ID NO. 47864
  misc_feature (375)..(375): n is a, c, t, g, unknown, or other
aaagctggagctccccgcggtggcggccgctctagaactagtggatcccccgggctgcaggaattcgcacgagaccattacctagaacatcctaatcgtaaactcgttattccatcaccagttcaccaccgtcttcctcaactcttcctctcctctctcttctgcaccatctggtgtgtgtgcgcgttactcgccgcgtcgatcgaagaaagaggcgcacgggagcgagctacgcgaagcaaggcaatggcgaagggcgggctgtccaagcttcggtgcatgatcaagaggtggcactcgtccagccgcatcgcccgcgcgccgccgtctcccggccccggtgaggacgaccgctgcgccgcgcgcggcgcgtcnttccacggcgcggacgaggtgcccgaagggctgcaccccccctacgtcggcaagtcgcgccggccgtaactcgtccgccaaggaactggtgggcccacccgcttgtcccagaccctcttcaaccgcattcggggggggcggcacccgggccagcggcgggggggaaccgtcctccgcttgcaagtccgtgcttttccaccacctgctttggaatctgggaaaaagcgaaccccgccccggaatcccccaaaaaactctaaaaagtccacccggggtgaaaaaaaaaaataaaaattcccccccccccccccattttgccggggggcaacccggccccccaaggggggaaaaggaaaaagaaaccctctttaccgcgggggtttttattttttcttcgggaattttggggggtagtgggggg

SEQ ID NO: 47864 - protein, 65 aa, Zea mays
  misc_feature: Ceres CLONE 1456077-F
MAKGGLSKLRCMIKRWHSSSRIARAPPSPGPGEDDRCAARGASFHGADEVPEGLHPPYVGKSRRP

SEQ ID NO: 47865 - DNA, 796 bp, Zea mays
  misc_feature: Ceres CLONE 1456086-F
  misc_feature: Encodes the peptide sequence at SEQ ID NO. 47866
  misc_feature (364)..(364): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaaactctgaaacgtcgatgtcacggctactcccgcccgtgctctctcctttaccggcgttctcgctgccgccgccgcttcttcctcgcatccacatccgcacgtcggcggtgagaggcggtgcggcggagaacacgatggcgtccgggacgacggcgagggagcggcgcctggtcaaggtgcgggaggagcgccgccgccgcgagtacgaccgggagcacacctaccccggatgggccaaggtactggagaacgcctgcaggnatgatgaagagctccgcgccattctggntgatagcatcggcaaacccgagctcaatgaagcaacggatccaggaaaagggtgcgcaagaaaggcagggcccaatttcataaaatcaagaaagggctccatggttgcttttaaagccagctttcaagaactttaccccattgaaatcctttcattggggttggaggcctttggagaaccaaccgatccaaaaagttgacccgcctgggggggggaagccccaactttgttttttcttggggaaaggaagaaacctaaaaatttttaaattttggcgcgggggcccacccagaggggaaatcccccccctcaatagatttgtgaagaaattccccccgggaaggcgccccctcctccctataataccgggggggttgtggcccaaaaaaaaggggccggggggt

SEQ ID NO: 47866 - protein, 157 aa, Zea mays
  misc_feature: Ceres CLONE 1456086-F
  misc_feature (83)..(83): Xaa is any aa, unknown, or other
  misc_feature (92)..(92): Xaa is any aa, unknown, or other
MSRLLPPVLSPLPAFSLPPPLLPRIHIRTSAVRGGAAENTMASGTTARERRLVKVREERRRREYDREHTYPGWAKVLENACRXDEELRAILXDSIGKPELNEATDPGKGCARKAGPNFIKSRKGSMVAFKASFQELYPIEILSLGLEAFGEPTDPKS

SEQ ID NO: 47867 - DNA, 792 bp, Zea mays
  misc_feature: Ceres CLONE 1456088-F
  misc_feature: Encodes the peptide sequence at SEQ ID NO. 47868
caatagctggagctcctccgcggtggcggccgctctagaactagtggatcccccgggctgcaggaattcgcacgagaccattacctagaacatcctaatcgaaaatccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatgggctgggagggcaagagcgtcttcacacccccccccctcccaccattgggccccccaacccccctggcttctgaaccccggaccatccgtggcgacttttcttggcaacattggcaggaatgtcatttctggaaattgaccccttttgagagggctaattaagggaatttcgcctgggggtcccccaggggccctgttttattgcaaaaaagccctccccccctggttttcgggaaagtaaaaggggaaagtttctcttaaacccttttaaaccaaaaaaaactgccccctttttggttcaaacaagtgtctccaaaaaaatattcttggtttttgggacctttttctagggggcaaaattttttttttgtgccaaaaaaaaaaaaaaatctttttctcgccccc

SEQ ID NO: 47868 - protein, 126 aa, Zea mays
  misc_feature: Ceres CLONE 1456088-F
  misc_feature (2)..(114): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVVAMGWEGKSVFTPPPLPPLGPPTPLASEPRTIRGDFSWQHWQECHFWKLTPFERAN

SEQ ID NO: 47869 - DNA, 757 bp, Zea mays
  misc_feature: Ceres CLONE 1456089-F
  misc_feature: Encodes the peptide sequence at SEQ ID NO. 47870
  misc_feature (364)..(364): n is a, c, t, g, unknown, or other
  misc_feature (365)..(365): n is a, c, t, g, unknown, or other
  misc_feature (757)..(757): n is a, c, t, g, unknown, or other
tccccgcggtggcggccgctctagaactagtggatcccccgggctgcaggaattcgcacgagaccattacctagaacatcctaatcaaaaaatttcaacctgtacccggacatctcaaatgaaatcaagcatgcggaagcacagataaagcgaagaatgggcattggaagccacatatatgagcgacgcctgaatgatggactaaacaggatgggaatgaacgaatccattgtgagaagagctcttctgattatgcatcaaagagactaggtggactacaagagagagcgccatgtgatcgtccggaaggcttgatgtggagagtccagtcagactcattcgtggccttcaacgaacggtaatnncaacctctcctcaaacccatccatacctagacttgttatcccacatctgtctttcctgaggggaccaaacacgtcttagttggtctctgacatcactgactgatgctatcatccaaccgcttgaacatttacgccctgtttcctcaagtgcccaagcgatctgattgaagatgttgtgtgccgtgaaactagacaatcgcttccgaactgctaaatttgtgttctttctcgcaaaaaaaaaaatatgccgcctctcgattaccttcgaacctctaaggggtggtcccgatacctcaattcccccctaataggggagtctgtattttcggtgcgctacccttggctctggccgattctaaagacacgcccagggacatgcgccaaaactcctn

SEQ ID NO: 47870 - protein, 37 aa, Zea mays
  misc_feature: Ceres CLONE 1456089-F
MGIGSHIYERRLNDGLNRMGMNESIVRRALLIMHQRD

SEQ ID NO: 47871 - DNA, 711 bp, Zea mays
  misc_feature: Ceres CLONE 1456096-F
  misc_feature: Translation starting site: 133
  misc_feature (228)..(228): n is a, c, t, g, unknown, or other
  misc_feature (237)..(237): n is a, c, t, g, unknown, or other
  misc_feature (307)..(307): n is a, c, t, g, unknown, or other
  misc_feature (354)..(354): n is a, c, t, g, unknown, or other
aagctggagctccccgcggtggcggccgctctagaactagtggatcccccgggctgcaggaattcgcacgagaccattacctagaacatcctaatcgaaaaaaataaaaacacgccgccgccatcaatggcgatgtcgcgcttcgggcgctccgggcagccggagaaccgcgaatctttctccctcctcgtcctcaacgtctccttccgcactacggctgacgatctnctcccgctnctcgatcgatacggcaaggtcttagacatctacatcccgcgcgaccacaggactggggatccgccgaggnttcgcgttcgtgaggtacaattacgaggatgaggcccgggatgccantgaacggctttgatggaatgaggtttgaagggcgtgccctcctggggcaatttgcccaaatcggaacactggttgaaaaaattcctgggggtggaattcccgagagaattccaaagccccggggtttttttggaaaacccccttccaaaaaaaaaggtttccgaggggttttcggggaaaaaaaactttaaagggcggaacccccccaccaaaattggggggcgtatttaaaaccggcggggacaaaaaagagggtaaatctccccccccaaggaaccccaaaatatcccccgttttgttttggggagaagataacaaaaccgggtgtgttttctttttttttattcacccccccca

SEQ ID NO: 47872 - DNA, 779 bp, Zea mays
  misc_feature: Ceres CLONE 1456097-F
  misc_feature: Encodes the peptide sequence at SEQ ID NO. 47873
aaagctggagctccccgcggtggcggccgctctagaactagtggatcccccgggctgcaggaattcgcacgagaccattacctaaaacatcctaatcgaaaaaggagcaggagaggggagagaaaacctcgccgtcaatgtcagcgttcgttcccaagggcgctagggtttaaccccccaactgttcggtctctctctctccccgaatccaattcagcgtcatctagtccgggagcctgcgacatggggtacctccaggaggcccgggagaatcacgtcaagaagaaggtcgaggaagctttgcggagcaaaatgaaacaaaaggctcttcaggaatgtgatttctattgttcaaaatatgctgagtgtgtacgggaaacaacattttctgtggtatggaaatgccgcaaacaacccccaccactcgaatgagtgccttcatcaatacacaaatgatgcaatcctggaagaaatgaagaaggcttatatgattgagcaaaagagcaaggagataaatcaataagcaaaaatccaatgcgcaatgtgcatcacaatcaccctgcttgtatgtatactgttgcctttgatagatactattcatgggcagcgttgccaacattgttctccccacttgcataaccttgaacctagtattgggtggcaaactggcaatcttgctgtttctgtcgaacatgcgatataagttgttttttttctggtgccattttccatccaaaaaaaaaaaaaaaaaagcttatcgattcccgccaccttggagg

SEQ ID NO: 47873 - protein, 62 aa, Zea mays
  misc_feature: Ceres CLONE 1456097-F
MGYLQEARENHVKKKVEEALRSKMKQKALQECDFYCSKYAECVRETTFSVVWKCRKQPPPLE

SEQ ID NO: 47874 - DNA, 772 bp, Zea mays
  misc_feature: Ceres CLONE 1456098-F
  misc_feature: Translation starting site: 201
  misc_feature: SWISSPROT Homolog: EC 2.6.1.42 Branched-chain-amino-acid transaminase
  misc_feature (376)..(376): n is a, c, t, g, unknown, or other
  misc_feature (413)..(413): n is a, c, t, g, unknown, or other
  misc_feature (469)..(469): n is a, c, t, g, unknown, or other
  misc_feature (705)..(705): n is a, c, t, g, unknown, or other
  misc_feature (706)..(706): n is a, c, t, g, unknown, or other
acaagctggagctccccgcggtggcggccgctctagaactagtggatcccccgggctgcaggaattcgcacgagaccattacctagaacatcctaatcgaaaagaccgccgccttcgctcctccacctccccgctcgctcttctgcctccgcgcgggccgcggatcccttcactcgccacagcaagcgctagaagagggaatggagcccggcctcgcatcccgcgtcgcccgttcagccgctcagccgctttccggctgcctgtcgcggcactcgctctcgccgtggctcaagatccagaaccacatttatccgatgccaagtctctgtcacaaggttcctagcacggcaaaatgccacacttctatgacaacaanctacatggaaacatcacatgtcactgatttggactgncacaaccttggctttggcctcatcgagactgactttatgtacgttgcaaaatgtgnaacttgatggaatcttttcccaaggtgaaatcctcccatttgggtccatagcactgaagcccttcccctggagtcctaaatataggggcggggattggtttgaaggcctaaaacctatacggaaacctgatgggtccctccttctatttccccccaaaggagaatgctatagggttcctaacgcgggcgaaaaggatgtgaggcccgcccccccggtgaacccatccccggaaccnntaaaccaacggtttgggcaaaaagaaaagggggcccctccgggaaaggttccttactaccggcccg

SEQ ID NO: 47875 - DNA, 833 bp, Zea mays
  misc_feature: Ceres CLONE 1456111-F
  misc_feature: Encodes the peptide sequence at SEQ ID NO. 47876
  misc_feature (262)..(262): n is a, c, t, g, unknown, or other
  misc_feature (383)..(383): n is a, c, t, g, unknown, or other
aaagctggagctccccgcggtggcggccgctctttaactagtggatcccccgggctgcaggaattcgcacgagaccattacctaaaacatcctaatcgaaaatgtttcctgtctcctaccctcttgcgggcttgccagcgccccctcctcccttcgtctccgccgccgcggactcctcgccggaaccctaaatggaccccggcgccggcgcacactactccggccgtaccgcggaggaagtcttccgcgatttccgcggccnccgcgcgggcatgatcaaggccctcaccaacaatgtggagaagttctaccagctgtgcgaccccggtgagtctgctcgacctcctcggggccgccgacggtaactttgttccccccccggnccccccccccccctggttggggtcccccccccctttttgtggccccccgtggccccccaaatgaaaaaccaccaccctggcccccttccagggaattccgcttgtatgacccaactgctttgtgactacccttggactggctgcaaccaccacgcacacccatttacaagcaccccacagaccacccaagggaaagcgtaattgagtttgtgtgtgggaataccatatgtttccggccattgtgtgtcccgctaccacattttttagctgtgtcctccctatgtgggtgtctctccaaccatcgctcacccactctctttgtgcactgttcacacagcagtggtgttgtgcggcggatgatccgccccccccccacgcccaatggttatgagagatccctcatctgtgttacctgtggctacacccttgttgttgccagcctcttgcgtg

SEQ ID NO: 47876 - protein, 57 aa, Zea mays
  misc_feature: Ceres CLONE 1456111-F
  misc_feature (24)..(24): Xaa is any aa, unknown, or other
MDPGAGAHYSGRTAEEVFRDFRGXRAGMIKALTNNVEKFYQLCDPGESARPPRGRRR

SEQ ID NO: 47877 - DNA, 763 bp, Zea mays
  misc_feature: Ceres CLONE 1456118-F
  misc_feature: Encodes the peptide sequence at SEQ ID NO. 47878
  misc_feature (421)..(421): n is a, c, t, g, unknown, or other
  misc_feature (567)..(567): n is a, c, t, g, unknown, or other
  misc_feature (570)..(570): n is a, c, t, g, unknown, or other
  misc_feature (573)..(573): n is a, c, t, g, unknown, or other
  misc_feature (574)..(574): n is a, c, t, g, unknown, or other
  misc_feature (581)..(581): n is a, c, t, g, unknown, or other
  misc_feature (588)..(588): n is a, c, t, g, unknown, or other
  misc_feature (599)..(599): n is a, c, t, g, unknown, or other
aagctggagctccccgcggtggcggccgctctagaactagtggatcccccgggctgcaggaattcgcacgagaccattacctagaacatcctaatcgaaaaactcataaaccactcctgcactttcactctatcatcacctaccaggctactagcataacaagtcgccaatccctcccccgagagagtcagaaatggcatcacctcatagttgctttcgcggctggcagagcacgagccacgtcgcacttgcgctggtgtccgtgctgatcctgagctcggcacgtctctccgcgggcggcaggagcctgctggagctgtacaagccgccggccagcgcgatcctgacgtaccacaacggcgccgtgctgcagggccgcatcccggtgtccataatctggtacggccgcttcacgccagcncacaaggccgtggtcaccgacttcctcgggtccctcaccaccgccgccgcctcgccgctggcaccgtccccgtccgtgtcgcagtggtggagcaccatcgaccagctgtacctctccaaggcgcggggaaggggccagcggcgagncgncgnnggtggtnagagganccgcggaagangggttatactgtacatctgtgcggtcgttaagcgccggcttccgcttttccgctctgcgatggggttaagtccgtagggggctgttggggatatgtaggtctcctgggcccgagggactgactcttccgcaaaggtttcattcagtggcgcgatccgctcaact

SEQ ID NO: 47878 - protein, 160 aa, Zea mays
  misc_feature: Ceres CLONE 1456118-F
  misc_feature (125)..(125): Xaa is any aa, unknown, or other
  misc_feature (126)..(126): Xaa is any aa, unknown, or other
  misc_feature (127)..(127): Xaa is any aa, unknown, or other
  misc_feature (130)..(130): Xaa is any aa, unknown, or other
  misc_feature (132)..(132): Xaa is any aa, unknown, or other
  misc_feature (136)..(136): Xaa is any aa, unknown, or other
MASPHSCFRGWQSTSHVALALVSVLILSSARLSAGGRSLLELYKPPASAILTYHNGAVLQGRIPVSIIWYGRFTPAHKAVVTDFLGSLTTAAASPLAPSPSVSQWWSTIDQLYLSKARGRGQRRXXXGGXRXRGRXVILYICAVVKRRLPLFRSAMGLSP

SEQ ID NO: 47879 - DNA, 753 bp, Zea mays
  misc_feature: Ceres CLONE 1456127-F
  misc_feature: Translation starting site: 317
  misc_feature (743)..(743): n is a, c, t, g, unknown, or other
ctcaccgcggtggcggccgctctagaactagtggatcccccgggctgcaggaattcgcacgagaccattacctagaacatcctaatcgaaaatctccgtgctcgccagtgggttgctgacagagatggtagtggccgccgcggccgcactctacctcgctgtaaagcccctgcccctcgtcctcgtcctcgtccaccacagccgccccgcgccctcctccgcgctccgcctcccccgccgaaccgccagcgcctggctgccgcgcttcccctcctgctcgacctcagcgccgccgccgttcgcagccgtcgcatccatggacgcgccgccccagggttaccgcaccaacgtcggcatctgcctcgccgacccatccctcaccaagattttctcggcttctaggatcgacattcctagcgcgtggcagatgcctcagggtggtatagatgcaggggaagaaccaagggcggctgccttcagggaattgagagaagaaactggtgtcacatccgcagagatcgtggctgaggtttttatttaggcttactggaaatgatgatgagattaaccttaatggtgatggatctgagaagccagagtttggtgaatggacatggatgactccccaggaagttattgaaaaggcagttgatttcaagaaacctgtatatgaggaagcattgaaacactttgccccctacctacagtcagatcccgccgcttcatcatagaagattcgaccnatttgcatat

SEQ ID NO: 47880 - DNA, 786 bp, Zea mays
  misc_feature: Ceres CLONE 1456131-F
aaagctggagctccccgcggtggcggccgctctagaactagtggatcccccgggctgcaggaattcgcacgagaccattacctagaacatcctaatcgaaaaattcaagtgtcaccgcgatggcaatgatatatacgctattagctcgttgaactttcatcctgtgcatggtacattcgctactacaggctctgatggaagtttcaacttttgggataaggacagtaagcaaaggctgaaggcttataataggtgtccatcccccatcacatgcagcgcattcaatcatgatggctctatatttgcttacgcggtatgttatgattggagcaaaggtgctgaaaagcataatccttctactgcaaagaacaatatatttctacatagtgcacaggattctgacgtgaaaagaaaaaccccgcgctggaaaaaaataggcgtaacaatgataaatcagtgactggtgatcgtaagacaagaaatccctttcccttccccggaaaattaagggatttttttggaaagaaccaaaaataaaaaagggccttttttccaaacccttggttttgcccttttggaaaaaaaatttcgggggggggcgcctttgcgggggtttttttaaaaaggaaccactttgggggcgggggtattttttttttttaaaaaaaaaaaaaatttttttaacccgggcccccgggagggggggcgcccaccaccccctcccccataaagaaaaaaaaaaaccccccccccgcgccctttttataaagcgggggagggaaaccc

SEQ ID NO: 47881 - DNA, 708 bp, Zea mays
  misc_feature: Ceres CLONE 1456132-F
  misc_feature: Encodes the peptide sequence at SEQ ID NO. 47882
aagctggagctccccgcggtggcggccgctctagaactagtggatcccccgggctgcaggaattcgcacgagaccattacctagaacatcctaatcgaaaaaaaatccgacacccggcgacccggggcgcaccacgctgtgagtgactcggtcgcatcttccccattcgccatcgacgcaccggcggcggcgcaagtgaagcgaataggaaaggaagctactagatgtcagcgaccactgcaacggtgcccttctggcgggcggcggggatgacctacatcggctactccaacatctgcgctgcgctggtccggaactgcctcaaggaccccttcaagtcggaggccgcgtcccgcgagaaggttcatttctccatttccaagtggacggatggcaagcaagagaagccaactgtccgcacagaatcggatgactaagggctggcgccatgacgacatattccttcctacggatgatttgaagcgtcgttgacagtttctgggacttgttatttagttggcttgatttgtaatcaatgctgaagaataaatactttttgcgacaatggtctttttacaatgacgagatgatttcgatgcatattgcacttgccctaccctaagtcagcatgtgaactaatggaatgcttcagctttgacaagagaaaaaaaaaaaagcttatctataccgacgaccgcgcgggggggc

SEQ ID NO: 47882 - protein, 70 aa, Zea mays
  misc_feature: Ceres CLONE 1456132-F
  misc_feature (9)..(57): Pfam Name: ATP-synt_Eps Pfam Description: Mitochondrial ATP synthase epsilon chain
MSATTATVPFWRAAGMTYIGYSNICAALVRNCLKDPFKSEAASREKVHFSISKWTDGKQEKPTVRTESDD

SEQ ID NO: 47883 - DNA, 760 bp, Zea mays
  misc_feature: Ceres CLONE 1456134-F
  misc_feature: Encodes the peptide sequence at SEQ ID NO. 47884
  misc_feature (15)..(15): n is a, c, t, g, unknown, or other
  misc_feature (41)..(41): n is a, c, t, g, unknown, or other
  misc_feature (674)..(674): n is a, c, t, g, unknown, or other
acccgcggtggcggnccgctctagaactagtggatcccccngggctgcaggaattcgcacgagaccattacctagaacatcctaatcgaaagaaatactacaaaaaaagggagaagagacgaagaaaagctcgatgattaattggcggcgaagccagtacattaaacacttcgtcaaccccaaccgtagtagtgctcaaggggagacggaggaggaggaggaagcggtataaagccgcggcgtcgttcgtcggcagccgcgtcctgagtcgctcgcagtcgcagccgacgccttttcctcctccttgtcttcttcctcgctgcagctctcgccgccgaggtcctgggcgccgtcgacaaaccacctccctcccccgtctctcgtcgtctcggaaggaacggccgcccgtcgcgccaaggattcaagggtgtgggagctgagttgggaggaggactgctgctgcagccatgaaggccctcattctcgtcggaggcttcggcacccgcctgcgcccgctcacgctcagcgtccccaagccgctcgtggatttcggcaacaagcccatgatcctgcaccagatcgaggctctgaaggaagttggtgttacagaggttgtcctggccatcaattaccagcctgaggtcatgctcaacttttctcaggacttcgagagncagcttggcatcaagatcacctgctcgcaggagacggagcccctctgtaccgcatgcccgctggccctggccagcgacaagctcgc

SEQ ID NO: 47884 - protein, 97 aa, Zea mays
  misc_feature: Ceres CLONE 1456134-F
  misc_feature: SWISSPROT Homolog: EC 2.7.7.13 Mannose-1-phosphate guanylyltransferase
  misc_feature (69)..(69): Xaa is any aa, unknown, or other
MKALILVGGFGTRLRPLTLSVPKPLVDFGNKPMILHQIEALKEVGVTEVVLAINYQPEVMLNFSQDFEXQLGIKITCSQETEPLCTACPLALASDKL

SEQ ID NO: 47885 - DNA, 809 bp, Zea mays
  misc_feature: Ceres CLONE 1456135-F
  misc_feature: Encodes the peptide sequence at SEQ ID NO. 47886
  misc_feature (318)..(318): n is a, c, t, g, unknown, or other
  misc_feature (398)..(398): n is a, c, t, g, unknown, or other
tagctggagctccccgcggtggcggccgctctagaactagtggatcccccgggctgcaggaattcgcacgagaccattacctagaacatcctaatcgaaaaatagcctgcagccttccatccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaagtacaaggtgttctaccccaccatgtacgccatcgagtcggagaacagggacgccnaagctcttcactgcgtgcagagggggcaccagaactctctagagtggatgcccgttttcttcgtcatactgctgctgggnggtctgcaccacccaccatcggcggcgggtctggcggaatctaaatcgtccgcgagggtccttctaacttcagggaaaaccccccccggggttccggaaaaccggtcccaaatttggggggcccaccaacttgggggtggttgggcctagaaatttggcaaagaattttttcgggaaaacccgggtctaaagggaagagccccaaaactttgggtgttaaatgagaaccccccccgggggggtaacccccacaaaattcctgtggtgggagaaaaaaaaattttggaaacaacacgcggggggggtttaaaagagaaaaaaccccctctttcttcgccggggggggaacaaaaaaaagagggccgcccccttatattttgtggaaaaaaaaaaaaaaaagggtttaccccg

SEQ ID NO: 47886 - protein, 132 aa, Zea mays
  misc_feature: Ceres CLONE 1456135-F
  misc_feature (9)..(128): Pfam Name: MAPEG Pfam Description: MAPEG family
  misc_feature: SWISSPROT Homolog: EC 2.5.1.18 Glutathione transferase
  misc_feature (57)..(57): Xaa is any aa, unknown, or other
MAVSIELTKEYGYVVLVLVAYVFLNLWMGFQVGKARRKYKVFYPTMYAIESENRDAXALHCVQRGHQNSLEWMPVFFVILLLGGLHHPPSAAGLAESKSSARVLLTSGKTPPGVPENRSQIWGAHQLGGGWA

SEQ ID NO: 47887 - DNA, 764 bp, Zea mays
  misc_feature: Ceres CLONE 1456137-F
  misc_feature: Encodes the peptide sequence at SEQ ID NO. 47888
aagctggagctcaccgcggtggcggccgctctataactagtggatcccccgggctgcaggaattcgcacgagaccattacctagaacatcctaatcgaaaaactcaacgtatcattttgaacccgctgcccgagggctaagcttacggcaacaacaactatgcacatgcgatgacctcggatttccctgccccatctacagggggcaacacaagcggccagctgccggcccaggtcaacgaccggaggaggcagctggccctcatcctcgcggccaacgggttcgcgggcgtcaccaaaaagctgtcgaagatgacggtgcctcgcacttcagttgcaaccgcgctcacggcgatcacagacagggaaacagtggcgctcacggacgtgtagtagaccaagcgtttcccaccccccccgcccccaaaaaaagagggtggactcggtatgtgactaatcaaacaccaactctccttgaggacggatagggagaaaaagcgcaacaaccacttccccgtgaggaattatgctgtcaaggcctaggttaggaggacatgttttaccggccaagttttgctcacaagtggaatgaattttatactctgcggggacaccgctgctaatgaggcactatgtcatcgaatagcgtgcttgaaattgcaactaacggtaattgaccctttgatcaaaaaaaagaaaaaaagaactatatggatacccccgaactccccagggggggaccaggtaaccaattacgctactaga

SEQ ID NO: 47888 - protein, 73 aa, Zea mays
  misc_feature: Ceres CLONE 1456137-F
MTSDFPAPSTGGNTSGQLPAQVNDRRRQLALILAANGFAGVTKKLSKMTVPRTSVATALTAITDRETVALTDV

SEQ ID NO: 47889 - DNA, 768 bp, Zea mays
  misc_feature: Ceres CLONE 1456143-F
  misc_feature: Encodes the peptide sequence at SEQ ID NO. 47890
  misc_feature (725)..(725): n is a, c, t, g, unknown, or other
aaagctggagctccccgcggtggcggccgctctagaactagtggatcccccgggctgcaggaattcgcacgagaccattacctagaacatcctaatcgaaaaagttcgcggcttgccactctgcttccgtgcttggcttgctcgctttcctttcccgtctcgactctcgagtctcgactcctcgcattcgccgctgcgtcaacgtgtcttccttcccgcggtctctccgccgcctcccagatccggcggccatggcaaggaacccgggctgcaccgtcttcataggtaacttggatgacaaggttcctgagagggttctgtatgaaattcttattcagatctctgggcaagacaaaccctcattaaatggcaatatccctgtaactcctaggttaaactctgtaccacagccaaagcctcatcaacctatgaggtctagtgatactcctttgccacagcatgcaccactgaatggcaggaatgccgggtatggtatcccaccaaatcattcatacgacacgcacactcaagcactgtcgagtgggttaccgaatagaggactaagcaacggtacatatgaatatagtaggcgtgtatttggttctgttctgaatgatgttagccgtcgagctaccagggaaccaatcccgtacccgtcatactagcatgttgagcaccggtgactgactctgtgctgacagaaatatttctgaagatgttctctngtgtgtcagccagctagtatatctctgtactcaccattcatgc

SEQ ID NO: 47890 - protein, 137 aa, Zea mays
  misc_feature: Ceres CLONE 1456143-F
MARNPGCTVFIGNLDDKVPERVLYEILIQISGQDKPSLNGNIPVTPRLNSVPQPKPHQPMRSSDTPLPQHAPLNGRNAGYGIPPNHSYDTHTQALSSGLPNRGLSNGTYEYSRRVFGSVLNDVSRRATREPIPYPSY

SEQ ID NO: 47891 - DNA, 749 bp, Zea mays
  misc_feature: Ceres CLONE 1456146-F
  misc_feature: Encodes the peptide sequence at SEQ ID NO. 47892
  misc_feature (530)..(530): n is a, c, t, g, unknown, or other
ggagctccccgcggtggcggccgctctagaatagtggatcccccgggctgcaggaattcgcacgagaccattacctagaacatcctaatcgaaaaaagaccgcaggaggagctatcccccatgactatgctgatccgcccattcacgagatccttctcactggagcccggacggctcgtttcactagttgacagcgacggcaaggaggttggcaggggcaacatattccaagcgccagggaagagcccacccccattggagagccgcatctgcacggttgatgtcccccagctcagagacccagaagtggagggagctcccacacccttctgaggcatctggcaggaccttccatgaggcgaacgcaaggaatggtggaatcatgacggtctcttgagactccggcaggctgttgcctgaagtgtaacaaggcatagacttttcgtcaggttgctgtataccgctatgcacaaggtgaacagagtgatcctttgctttaaggcgagagactggatcatggcattcttgtncgcctaagtaacactgctaaaacctgtggttaactgtggtgtatccatcagctaattgtctcacgcaatgcatgtagagtagttactaatttttcaaaaaacacaaacaagcttatcgataccgtcgacctctaggggggccctgtacccaatcgccctatagtgagtctaattacgcgcgctcactggccgtccttttaaacgacgtgactgccaaac

SEQ ID NO: 47892 - protein, 70 aa, Zea mays
  misc_feature: Ceres CLONE 1456146-F
MTMLIRPFTRSFSLEPGRLVSLVDSDGKEVGRGNIFQAPGKSPPPLESRICTVDVPQLRDPEVEGAPTPF

SEQ ID NO: 47893 - DNA, 778 bp, Zea mays
  misc_feature: Ceres CLONE 1456149-F
  misc_feature: Encodes the peptide sequence at SEQ ID NO. 47894
aaagctggagctccccgcggtggcggccgctctagaactagtggatcccccgggctgcaggaattcgcacgagaccattacctagaacatcctaatcgaaaaaaaaaaaaaaactcctcggccccagcattttcgtgcaaggggcgagccgccagctactgctggccttttccctcacacaagtcacacgcacacccgctagcccccgtcccccgtcccgcccgtaccttcctccgccgcctccgtcctcgttccaaccgtgggcagcaggcaggcccaagtatctgcagtacattggtggagaggaagaagacggcaggcacccacgcagatcaaacgtgctccgccacccttggtttcggcgaatcggcgccgtacgccgtaaatcgagccgtctccgagcagatcgacgcgctgcatagcaattcaacccgtctccggccaaatcgacgtccagagctgcaaattgacccatctccgcgctgacctccgcttgtgcctgccgaggagcgccgaagttactcccttctcgtgaagatataccatggagcgtccacgatttagtgatcatcttgaagcaatcaaatttatctgcaaagacttctggtcagagctgttcaagaaacagattgacaatctgaaaacaaatcatagggtgatgcaaaaatacgtccctgactgtttttccttctcgataaccactgacatctcttgactacctatacatgcagggtacctttgtctttcagataaccgttttcgggggcttactcgtgtt

SEQ ID NO: 47894 - protein, 56 aa, Zea mays
  misc_feature: Ceres CLONE 1456149-F
MERPRFSDHLEAIKFICKDFWSELFKKQIDNLKTNHRVMQKYVPDCFSFSITTDIS

SEQ ID NO: 47895 - DNA, 695 bp, Zea mays
  misc_feature: Ceres CLONE 1456151-F
aaagctggagctccccgcggtggcggccgctctagaactagtggatcccccgggctgcaggaattcgcacgagaccattacctagaacatcctaatcgaaaagagggtgctccggcccttcgacgaggtgtccaggctcctccgcggcatccgggactaccgcgtggcggtcctggaggcgaacccgcgctcattcgtggtgcccagccacaccgacgcgcactgcatctgctacgtggcggaaggcgagggagtggtgacgactatcgagaacggcgagaggcggtcatacaccatcaagcaaggcacgtcttcgtggcgcggccggggcggtcactacctggcaacactgacggcggaagaactggtctcgccagatcctcataccatctcgtggctggcgagtccagtcttctccgcccggcgggagacccggaatcgtccggtcagcttcccagaccttccgaaagtggatacaaacccgaggactttggaaggctttccgaggttgcagaaaaagggaaacttggccccccgggagaaaaaccggatgggggccccccccagaagggcccacccccaggggcccgccctttttgaaaaccggcccccatccccttgggagggggcctttccccccgggggggtttttagggggggggggttttcaccccgcgagaaaggtgttctcttcc

SEQ ID NO: 47896 - DNA, 752 bp, Zea mays
  misc_feature: Ceres CLONE 1456153-F
  misc_feature: Encodes the peptide sequence at SEQ ID NO. 47897
  misc_feature (457)..(457): n is a, c, t, g, unknown, or other
  misc_feature (482)..(482): n is a, c, t, g, unknown, or other
  misc_feature (517)..(517): n is a, c, t, g, unknown, or other
ctggagctccccgcggtggcggccgctctagaactagtggatcccccgggctgcaggaattcgcacgagaccattacctagaacatcctaatcgaaaacatcggctccggcgccgcctccgtcgtgccttctgatccgctctactccgtctacgccgccaccaaagcgtatgttgaccaattctcaagatgcctctatgttgagtacaagagcaagggtattgatgtgcaatgcctcgtgcccctatacgtgacgacaaagatggcatctatcatgaaggcttccttcatggttccatctactgacacctatgctcgtgctgccgttcgtcacattggatacgaacctaggtgcacaccgtactggacacactcggtcgtgtggttactgatctcaattcttactgagtcccttatagacagcatgcagcctgggcaagtgcatttaacatcctaancaagggcctagcccaggaacccaangaagaaaggcctgtggatgaaggtttcaaatggcngtcccaaatccaaaatttccttttcccccgtgaaaaaattgggcccttcctaaacccctttattaccccgggaatggttaaaaaaccagaaggctttttcccccccccggggtttaaggaaaaaaaatattttttttctttcgaagggggacccttttcccaaagggggtgcggggtttcctttgaaaaatttgtgggccccctttttttttcggggagaaaaaaaaaaaagcct

SEQ ID NO: 47897 - protein, 64 aa, Zea mays
  misc_feature: Ceres CLONE 1456153-F
MASIMKASFMVPSTDTYARAAVRHIGYEPRCTPYWTHSVVWLLISILTESLIDSMQPGQVHLTS

SEQ ID NO: 47898 - DNA, 741 bp, Zea mays
  misc_feature: Ceres CLONE 1456155-F
  misc_feature: Encodes the peptide sequence at SEQ ID NO. 47899
acccgcggtggcggccgctctagaactagtggatcccccgggctgcaggaattcgcacgagaccattacctagaacatcctaatcgaaaaatccccgatctcaacccaagaataaaaatggccaccgccaccactgaagccgaattccgtgagtccctcggcacgaagttcggtcgcctcacggaacaggggaaagacatggcctccaggcaccccgtcgctggagccgcggccgtcatcgctgtcagcgccgtgggcgcctacttcttgtggcccgtggcagccccggccgtggccaatgatgaaggcgcctggaatccggcggagtgctcatctcccgcgcggcgtttctcggaaagaaggagctgtacttcaagcgcttgcgcaccgggcacgttgccgtggcggtcgccgctttggcgtagctgcacgtgcgctaacggaacatgctgatcgcgaacgagcgacgggccggacgtttcaggttgtatgttgaccaggatgctactactacttatctttcgttggagtggagtctcgactcgtcgagttgggattatctgatcaaaacctatgtattcctgcgagatcaatatgatgagtactgggattctttttataaacagagcgaggtagatgtcctctcatataaaagaagggcttatcgattccgtcaaccgctaggggcggccaggtacccaatgtctcctatggtgagcccgatgccccgcgtgcactggc

SEQ ID NO: 47899 - protein, 111 aa, Zea mays
  misc_feature: Ceres CLONE 1456155-F
MATATTEAEFRESLGTKFGRLTEQGKDMASRHPVAGAAAVIAVSAVGAYFLWPVAAPAVANDEGAWNPAECSSPARRFSERRSCTSSACAPGTLPWRSPLWRSCTCANGTC

SEQ ID NO: 47900 - DNA, 751 bp, Zea mays
  misc_feature: Ceres CLONE 1456158-F
  misc_feature: Translation starting site: 421
acaaactggagctccccgcggtggcggccgctcctagaactagtggatcccccgggctgcaggaattcgcacgagaccattacctagaacatcctaatcgaaaaattttcccagaaccacccaaacccacacaacccactcggcggcggcgacggcggcggcggcggaacacgcgaaaatggtgaagttcctgaacccgggcaaggcggtgatccttctccagggtcggttcgcccggccggaaggcggtcattgtgcccgttttccaggagggcacgcgcgaactgcctctacggccactgcctcgtcgccggcctaaccaagtaccccaagaaggtgatccgtaaggcctccgccaagaagccggcgaacacatcccgcgtgaagtgcttcctgaagctggtcaacttcacccacatcatgcccacccgctacaccctggatgtcaaccttcaggacgtggcctcccggcgggcccgaaccccttcccacccccgacaagaaggtcccctcctgcaaggcccccaaggcacctctccgaggaaaggttcaagaccggcaagaacaggtggttcttcaccaagctccccttctaggaagcaaacgtctttacaatactagtattccttgttcttgcaatcaatagcacactgagctatcctctatcactgtttttgtattgtccatgaagattttgtgtttagtatgatcctcggaaaagagttattcaggcatgatcataatgatgact

SEQ ID NO: 47901 - DNA, 815 bp, Zea mays
  misc_feature: Ceres CLONE 1456159-F
  misc_feature: Encodes the peptide sequence at SEQ ID NO. 47902
  misc_feature (104)..(104): n is a, c, t, g, unknown, or other
  misc_feature (300)..(300): n is a, c, t, g, unknown, or other
  misc_feature (416)..(416): n is a, c, t, g, unknown, or other
aagctggagctccccgcggtggcggccgctctagaactagtggatcccccgggctgcaggaattcgcacgagaccattacctagaacatcctaatcgaaaacgncaccgccgccactcgccttttcattccgcaccgccgccaacccgccgcctcttctttccatggaagtggacgacggtagccgcgccaccccgccactggacgccgtggccgccgccttcaagtcccaagtcatggagttgcaggacctcgtcctcgcccgcagcatgttcccggccacggcgctgcccgacctcgncaacgtgaacgcgttggtgacggcgatggagtcgcaggtggaaccatcagccgccgcctttcaggagagcttgacgccatcccttaaggcaagagctagtccagcggtctttgaangaggaagaaaacctgcacatatgcttgcaaacttacctttcggagatgccccaaattgattttgctatccccccaaaaaagagtcccccggggagcggcgccctttttaacccccttttaacggacccaagggggggggcacggaaaaaaaagggaacaccctgtcgccctccaaaaaaagaaaaaacccgccccccccttggaatattcaccccgagggagtggttttctcccttctttggggggggaaaaacaccttttttaaagaaatattcccccaaaaagagggggggtttaaaaaaaagaggggcgctctttttttgttccctccaaaaaaaattgtaaaaaaaaagggagaaactttttttataaaattttttttccgggggggggagaaaa

SEQ ID NO: 47902 - protein, 103 aa, Zea mays
  misc_feature: Ceres CLONE 1456159-F
  misc_feature (46)..(46): Xaa is any aa, unknown, or other
  misc_feature (85)..(85): Xaa is any aa, unknown, or other
MEVDDGSRATPPLDAVAAAFKSQVMELQDLVLARSMFPATALPDLXNVNALVTAMESQVEPSAAAFQESLTPSLKARASPAVFEXGRKPAHMLANLPFGDAPN

SEQ ID NO: 47903 - DNA, 765 bp, Zea mays
  misc_feature: Ceres CLONE 1456162-F
  misc_feature: Encodes the peptide sequence at SEQ ID NO. 47904
  misc_feature (713)..(713): n is a, c, t, g, unknown, or other
aagctggagctccccgcggtggcggccgctctataactagtggatcccccgggctgcaggaattcgcacgagaccattacctagaacatcctaatcgaaaaagttttaaattttcgaatatttttaagcaaagatgaaaagccactctcctccctggtggagtcgaccgatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattaattttcataaggcctactacatactggatgagattctcatcgctggtgaacttcagaatctagncagaagatggttgcagacttattgctgcacaggaatcattggtcgaagctgc

SEQ ID NO: 47904 - protein, 125 aa, Zea mays
  misc_feature: Ceres CLONE 1456162-F
  misc_feature (1)..(122): Pfam Name: Clat_adaptor_s Pfam Description: Clathrin adaptor complex small chain
MINFVLLISRQGKVRLTKWYSPYTQKERTKVIRELSGLILTRGPKLCNFVEWRGYKVVYRRYASLYFCMCIDAEDNELEVLEIIHHFVEILDRYFGSVCELDLILIFIRPTTYWMRFSSLVNFRI

SEQ ID NO: 47905 - DNA, 754 bp, Zea mays
  misc_feature: Ceres CLONE 1456167-F
  misc_feature: SWISSPROT Homolog: EC 3.2.1.23 Beta-galactosidase
aagctggagctccccgcggtggcggccgctctatactagtggatcccccgggctgcaggaattatcaatacaccctacctcgagggtcctactcgaaaaacattcgccctattttgggactcattactcttggtcactgggcgtccttttacacgtcgcgagtggtaaatacctgccggtacccatcttattcgtcttgaagcacatccccctttcaccagctggagtagtaccgaagaggaccgcacagatcgaccttcccaacgttgcccttcctgaatggataacgggaattgtactcctcaatattttgttaaaatatgcggttaaatttttgttacactccctcatttttttgacaggtagggtgaactcagcccaatcccttatggctcagaacaatagacctagatagggttgagtgttattacccttaggaacaggacgtccactattatggaacgcgtcctcctacgtctgagggagaaaatccgtctatccggccaaatggcccaatacgtgaaccatcccccctaaccaagttgttttggcgtggaggagccctaaagcaattaaatcggaaccctaaggggaacccacccatttacacctcgtcggagaaagccggggaacgtggcccgaaaggaagggaagaacccgaaaggagcggcctctaggcccctggcagtgtatcggacacgatgttcgtaaaaactaacccgcttctctaatgagccgtaaagggcgcgtcagg

SEQ ID NO: 47906 - DNA, 750 bp, Zea mays
  misc_feature: Ceres CLONE 1456172-F
  misc_feature: Translation starting site: 216
  misc_feature (367)..(367): n is a, c, t, g, unknown, or other
  misc_feature (433)..(433): n is a, c, t, g, unknown, or other
caaagctggagctccccgcggtggcggccgctctagaactagtggatcccccgggctgcaggaattcgcacgagaccattacctagaacatcctaatcgaaaaagtattctgctcaagccgagcaccgcagaaaaagaaaaagaaaagccaaaggcaaaggcaaaggaatcccaatcaggcaagcaaaaggaagaaccagctgctgcggccggagatgtcgtcgcagctgatcgaggagcaccggtcgggcgcggaggtgcacgtcgggcacgagctgtgcgagcgcaagtcgcgcgagttcatggtggaagctgggcatccccgacgggctcctcccgctgcccagcctggacgaagtgggctacnacccgtcgacggggttcgttgtggctgcggaagggccccggcctaacccaaactttcggtccatcnggaaaaaagtgtggaaccaagggaaggaacggcttccggggaaccggggggaatccccggcccccccgggtgaaaaacaaaggacccccccccggggcccacatcccaaaatggcccccccccccccgggaaaaaaaaggtgtcccccccccgcggggggggggggcccctttctggtgcccctcttaaaaaaaccccggggggaggggaaccaaaaaaaaaaaaaaaaaaccccccccccccccccaatatttttttttcttcctgggggagcctttgtgtccaatcaataggggggggggtttataaaaacacaa

SEQ ID NO: 47907 - DNA, 765 bp, Zea mays
  misc_feature: Ceres CLONE 1456173-F
  misc_feature: Encodes the peptide sequence at SEQ ID NO. 47908
aaagctggagctcaccgcggtggcggccgctctagaactagtggatcccccgggctgcaggaattcgcacgagaccattacctacaacatcctagtcgaaaatcccttttccattttttctagcgccctctgcctccatccaccgacgcggcgcccgacgcccgacgccgcactcgcctcgcctcgctgaatcgtccccgccagacgtcgggtgcccgacgctgcagcacggcagccgcacaaccgcagctcccaccgctgccgcgctcctccgcgcaacctcgatcgcgcacagaggcccattccgccgaggagtggcacgaggagagacgacaggtgcggggatggggtcagttttgctgccaacgctgcggctgaagagtgaggtcgacgccgccatccgcgacacccccccaaaggtcctcgttctccgatttggtcgcgccaccgacgccacttgcctccacctagatgacatcctggataaatcttcttgggacatatccaagtttgctatggtagcattagttgacatggactctgacgacattcaggtttacattgactactttgacattactttggttccagcaaccattttcttcttcaatgcccaccccatgaagatggcttcagggacagctgacctcgacaaacggatggtttcttttaacacgaaccaagactttgtcggatgtgtttgatgcaatattccgaggtgggatgaagggcgaactgaaagttgtcttgccccctttctgctga

SEQ ID NO: 47908 - protein, 119 aa, Zea mays
  misc_feature: Ceres CLONE 1456173-F
  misc_feature (5)..(120): Pfam Name: DIM1 Pfam Description: Mitosis protein DIM1
MGSVLLPTLRLKSEVDAAIRDTPPKVLVLRFGRATDATCLHLDDILDKSSWDISKFAMVALVDMDSDDIQVYIDYFDITLVPATIFFFNAHPMKMASGTADLDKRMVSFNTNQDFVGCV

SEQ ID NO: 47909 - DNA, 745 bp, Zea mays
  misc_feature: Ceres CLONE 1456176-F
  misc_feature: Encodes the peptide sequence at SEQ ID NO. 47910
aaagctggagctccccgcggtggcggccgctctagaactagtggatcccccgggctgcaggaattcgcacgagaccattacctagaacatcctaatcgaaaaaagtttggcgatcgccgatcgggaccttccctcagccacaggccgacagcccacgccgtcgaacggccggggatccggtacctccgctccgcccccgactccctctcgccggacggctgcagatccggtcaggccgatccgtctcggacccggtggtagcagtggaggaatcctctgccggtccatcgatcgggagagatgcggcagcagcggggcggggtcggggtcggtaggagggaggatgacccggggctcctcacgagagccgtcaccagggcgttacgcttcgttcgcctcgtcgagttcgagatcttcttcgtcctcttcttcctcatcggcttctttctcttcaaggaactcatgtcacaggcctcaataacatcagctatttgttcaggagcctgatctaaataacccctggccttaggagtacggaacttactttggggaatagttggagcccaacaacccggttctttcttttaattggggtggaaggatcctttgaagcccggttaaagggacttgttttttgattaagttaaggatttccttcgggaacaagaaaaaatttagcgtgcctttttaaataaaaaaaaaaaaaaaatttttttttccccccaactcggggggggcccgggac

SEQ ID NO: 47910 - protein, 68 aa, Zea mays
  misc_feature: Ceres CLONE 1456176-F
MRQQRGGVGVGRREDDPGLLTRAVTRALRFVRLVEFEIFFVLFFLIGFFLFKELMSQASITSAICSGA

SEQ ID NO: 47911 - DNA, 765 bp, Zea mays
  misc_feature: Ceres CLONE 1456178-F
  misc_feature: Encodes the peptide sequence at SEQ ID NO. 47912
aaagctggagctccccgcggtggcggccgctctagaactagtggatcccccgggctgcaggaattcgcacgagaccattacctagaacatcctaatagaaaaattctccacagcacgcaggcagcacccagcaccacaccacagaccaaaacgaccaccgcacccgcagcagcgaagtgtccaagcggcggcatggcggagagcaaggcgcgtgtcgcgctgttcctggcggcgctcgcggcggcgagcctgctggcgctggccccggccggcgccgcgacgacgtgcgcgccgacgcagctgaccccgtgcgcgcccgccatcgtcgggaacgcggcgcccaccgcggcgtgctgcgccaggctcaaggcgcacccggcgacctgcttctgccagtacaagaggaaccccagcatgcagcgctacgtcaactcccccaacggcaagaaggtcttcgccgcctgtaaggtgtccctgcccaggtgctgatgctgagtgagtcgtctgccgccccatcaggtcgatgtcgatccatcctgctcgatcgatcgatcatgctactacttgagcacctttgggcagagtttagtattgctcgagaataataaacggagacgtaccactcccagtacttggtacagtgtgagttcgatctgctctctgcagaaagacttggtatatatgccgtcatgtatgtatacgtgtcacgtgtactactatgaactatgatgtttacaagacgaatacaggtggtgccactaaaaa

SEQ ID NO: 47912 - protein, 98 aa, Zea mays
  misc_feature: Ceres CLONE 1456178-F
  misc_feature (32)..(98): Pfam Name: Tryp_alpha_amyl Pfam Description: Protease inhibitor/seed storage/LTP family
MAESKARVALFLAALAAASLLALAPAGAATTCAPTQLTPCAPAIVGNAAPTAACCARLKAHPATCFCQYKRNPSMQRYVNSPNGKKVFAACKVSLPRC

SEQ ID NO: 47913 - DNA, 767 bp, Zea mays
  misc_feature: Ceres CLONE 1456180-F
  misc_feature: Encodes the peptide sequence at SEQ ID NO. 47914
aaagctggagctccccgcggtggcggccgctctagaactagtggatcccccgggctgcaggaattcgcacgagaccattacctagaacatcctaatcgaaaaactgtttctctctcgaaatcggccgtctctctcccgtccggcacttcctccgatcgactagcctgcggcggcgccggcgccggcaaccagcggccatgcgggtggcacccagggtgctcttcctcgtccgcgacgccgcgggctacggcgctgccctcgccgacgcgctccgcccgccgcccgggctaactagggagtcctcgcccttcgagctcgcccttgagaagtaccgcctcaacggagagaaggcgtgcgccgagctcctgagcttttccgatgcgagtggctctccacagtgaccattttttgtctgcagactataaccaacctctgcagctgggtttgaaatggggtctttgaactgatttcttctaacctactccccggaacaaaacctatttgcccttaccccaaagatccttcccctttccctttggacggaaagtgcacaaaggcccccctggctcttgggggggtaaaaaagggggaaaacagaaaaacccccccgggggggtggggagaccaaaaccccctctctcttttgaaaattggggagaaaaatttttttcttttaaaagggggccggtaaaaaaagcccaccttttttttgccccccggggggcaccaaggggaacccccccctcttttgtttgggagcgcgcaaa

SEQ ID NO: 47914 - protein, 67 aa, Zea mays
  misc_feature: Ceres CLONE 1456180-F
MRVAPRVLFLVRDAAGYGAALADALRPPPGLTRESSPFELALEKYRLNGEKACAELLSFSDASGSPQ

SEQ ID NO: 47915 - DNA, 803 bp, Zea mays
  misc_feature: Ceres CLONE 1456181-F
  misc_feature: Encodes the peptide sequence at SEQ ID NO. 47916
  misc_feature (803)..(803): n is a, c, t, g, unknown, or other
ggagctccccgcggtggcggccgctctagaactagtggatcccccgggctgcaggaattcgcacgagaccattacctagaacatcctaatcgaaaaataggttggagatcgccgatcgggaccttccctcagccagaggccgacggcccccgccgtcaaacggccggggatcctgtacctccgctccgcccccgactccttctcgtcggagggctgtagatccggtcaggtctatccgtctccggaacggtggtataaaagaaccaatcctctgtcggaccggcaatgaggagaggatggggcacctccggggagggtttgggctctcgaggaggcaggaagacctgggatttttttgagagccttccaaagggggggggggctctatcgcctcccaaaaaacaggcccccccccccccccaaaaatcaaaaaggcttcgttcttttcagggagccccggaccaaggaccccaaaaatctggtttcttccgagagacgggtgggcctcaagagccctggggcttcccaggtcccccctggactgtctcagttaagctcaggcgctccgtcctccccccccccctccctggtgggagcgttgcctcctcccgccctaaaaccgagtttggggggggcccgccgtctcccttaggccacgaccgccctccctcctctggtagtgaccccccccgcgccagcctatcctcgcggaaggaggggccccccgcggcgctctccaatccataacaggctggccctcgccagccggccccttatctacccgccatcgctcaccagtcgan

SEQ ID NO: 47916 - protein, 153 aa, Zea mays
  misc_feature: Ceres CLONE 1456181-F
MRRGWGTSGEGLGSRGGRKTWDFFESLPKGGGALSPPKKQAPPPPQKSKRLRSFQGAPDQGPQKSGFFRETGGPQEPWGFPGPPWTVSVKLRRSVLPPPLPGGSVASSRPKTEFGGGPPSPLGHDRPPSSGSDPPRASLSSRKEGPPAALSNP

SEQ ID NO: 47917 - DNA, 737 bp, Zea mays
  misc_feature: Ceres CLONE 1456182-F
  misc_feature: Encodes the peptide sequence at SEQ ID NO. 47918
acccgcggtggcggccgctctagaactagtggatcccccgggctgcaggaattcgcacgagaccattacctagaacatcctaatcgaaaaaatctgggagtggtgttaacagcgccgcaccacctcgtgccgtgggaggtcgagctcgtcgatgcgacgctcctcggagagcagcgcctcctcctgcgcggtcttcttcggcgcgagggcgggcgggacggagggcgccgaggaggaggcggtggcggaggagctagggttagggttcgccgccgccgtctgagctgcggcgtcgaggttgctggggtcggaaccggtagcagctgcggcggaattcgcggagggcaccgacgtgccggccttggcgagcagctggcggtgctcgtcgcggcgcttctggagctgcttctgctccagctccgaccgccgcacgaagctcttgctcccgaagtcggccgtcgccgccttccgcttcttctccagttcccgcttcagcagatccattacgcccgccgcccagttcggcttcgattctccgagaggcggtgcgccgtgccggtgctgcggataccggccgtgtacgcgtatttgaccgttccctcaaatagaagaggactcgactcgatcactcgactttggatcgtgttgtgggcagactaataaagcgtgcaagtccgttaaaaaaaaaaaaaaagcttatcgataccgtcgacctcgagggggggcccggtacccat

SEQ ID NO: 47918 - protein, 43 aa, Zea mays; identical to SEQ ID NO: 8458
  misc_feature: Ceres CLONE 1456182-F

SEQ ID NO: 47919 - DNA, 731 bp, Zea mays
  misc_feature: Ceres CLONE 1456183-F
  misc_feature (515)..(515): n is a, c, t, g, unknown, or other
gatccccccgggctgcaggaattcgcacgacaccattacctagaacatcctaatcgaaaaaggaaaggcacctcagaagcccttctcgtccgcgccgcctccttgaccccgctggccggggagctgctcagcgcggtttttttttgcatccacaaggcctgagctcggccaatgtacattgcctggagctgcaatctagggcacgtcatctaacgaaatttgaaggtttggagtttcgggcacatacaattaatcacatcttaatttggccggaaaagccgtgggaataggaatattgacgactggtgaaatggattgtgttttttgtaggtggtgtgtttaaatagaaatttttggggggaactatttggttgttggtggcccccccacctgaacttgggatataaggtggataacgggagacaggagcatccccccaccccccctcaaacacaagcaggcagcgtgcccgacgtttgggacggggcagggacaaagagcgggggaataaatangagctccagcagcaagagatttgcatctgcgtgatcagacatactatacatactattaatgtccgccacacccaacagggaagtcactcggtctacggtattagtggaagcgcggaagtctactagtacacttctattgagatttcgccccccgagtacttccgcaccaaaatcacgaccacctacctcacacgaacgaatcctctctaagacccc

SEQ ID NO: 47920 - DNA, 751 bp, Zea mays
  misc_feature: Ceres CLONE 1456185-F
  misc_feature: Encodes the peptide sequence at SEQ ID NO. 47921
ggagctccccgcggtggcggccgctctagaactagtggatcccccgggctgcaggaattcgtctcacccctaatcgaaaaatcggactcatctccttcgattcagcagaggacagcgctctgcctctccactacttgacagccacggatccttccatccctcgcctagcgaacagacctggctggccatcctcaacgcacccctcccattttccattcggatgtatgcgtgggtgaccagcacatcgaggagttccacaagcacacatgaggtatctgaaactgaatccaaagtacgaagtcagtaatgaggagtgtgtctctctcaggcttgaactgtcgcagagttcagtgaaactcgacactatctttgaggcatctttcaagttcatgatatatgatcagttaatcggaaagcacaaggtgcatctaggtaaccacagcttccagactgcaagtacgagctctgccatcgcattcatgttacctctgaaagcactcagacaatcctctagatttattgtcaataacagctgcgtatttggcattggcttcatcaaagttgccactatcaaagttaacacgacgctagaaacactgtttgtcaggagatgaacatcttcaacggagccaaagtttacacttggaaaatcgaggatttctctgctctgaagaacccgtcccctcaccggagtttgagatccctggatacacatggattatctctttgaacccatcctacgatggtaccc

SEQ ID NO: 47921 - protein, 115 aa, Zea mays
  misc_feature: Ceres CLONE 1456185-F
MRYLKLNPKYEVSNEECVSLRLELSQSSVKLDTIFEASFKFMIYDQLIGKHKVHLGNHSFQTASTSSAIAFMLPLKALRQSSRFIVNNSCVFGIGFIKVATIKVNTTLETLFVRR

SEQ ID NO: 47922 - DNA, 769 bp, Zea mays
  misc_feature: Ceres CLONE 1456187-F
  misc_feature: Encodes the peptide sequence at SEQ ID NO. 47923
  misc_feature (717)..(717): n is a, c, t, g, unknown, or other
aagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcataaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctaactaaatatgaaccttttgtctcttaagntgttaactaacgaaatcatctgacaaccaaaaagaaaaacgagacgctcgag

SEQ ID NO: 47923 - protein, 72 aa, Zea mays; identical to SEQ ID NO: 47800
  misc_feature: Ceres CLONE 1456187-F

SEQ ID NO: 47924 - DNA, 742 bp, Zea mays
  misc_feature: Ceres CLONE 1456188-F
  misc_feature: Encodes the peptide sequence at SEQ ID NO. 47925
ggagctccccgcggtggcggccgctctagaactagtggatcccccgggctgcaggaattcgtctcacccctaatcgaaaactctctgtcgccgacaactacgccaggtcttcttcggggcccacgtcgctgccgcctacataaggggccccaagttttcctaggagccctcgccggccacgaggaccaccagcttggttcactcccaacaaaatgtcggccaatgtgggtgaatcaactagcgcgtgtcagcagcagcgatgcatgctggggggagctttgaatgcaacatatgcttctagctgcctcaggagcacaaagtgactctctgtggccactctcttctgctggccgtgccttggccggtgggtgcacattcacgcacactcaccagagtgcccactgcaccaggccctcgtggaggaggacaagctcgtccccctttatgggcgtggcaaggatcacgtcgaccctaggtcgaataccatgcccgagggcgatattcctcaccgaccaacgggcaagaggcctgcctcagcccgccgggccgatgctaacagcaactttgccaatgccaatgccaatccatggttcccgggcgcaagactccctctggcaaatgcgcgatgggggaactacccattctcagctgctttcgggggactgctccctatgcttagatatcaggtacatggggttcacgacgccgccgcttacgcgcaccctgatgggttcaactatgg

SEQ ID NO: 47925 - protein, 36 aa, Zea mays
  misc_feature: Ceres CLONE 1456188-F
MSANVGESTSACQQQRCMLGGALNATYASSCLRSTK

SEQ ID NO: 47926 - DNA, 767 bp, Zea mays
  misc_feature: Ceres CLONE 1456192-F
  misc_feature: Encodes the peptide sequence at SEQ ID NO. 47927
  misc_feature (698)..(698): n is a, c, t, g, unknown, or other
aaaactggagctccccgcggtggcggccgttctagaactagtggatcccccgggctgcaggaattcgtctcacccctaatcgaaaagtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccacagaattgctataccaacaccagcataacaaaaggatgagctgccctgccatggcacagctcctctccaataccctgtactacaagcgcttcttcccatattacgccttcaatgtgctcgggaaagggtgtgttttcacctatgatgcagtaggttcctatgagagaactggttatagtgctcaggggacgggatctactttgattatgccagtcctggacaatcaactaaatcaccaagtcctctattgctcactgggcaggatgctgtcacacatttgtcgagtcagaggccatcgatctacttaaggatgtgtttgcatctgncactgagagagacatctacactggagacaagttggaaattgtagccatcaacaaagtcgggactaagcc

SEQ ID NO: 47927 - protein, 176 aa, Zea mays
  misc_feature: Ceres CLONE 1456192-F
  misc_feature (10)..(174): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKALHKNLAATELLYQHQHNKRMSCPAMAQLLSNTLYYKRFFPYYAFNVLGKGCVFTYDAVGSYERTGYSAQGTGSTLIMPVLDNQLNHQVLYCSLGRMLSHICRVRGHRST

SEQ ID NO: 47928 - DNA, 877 bp, Zea mays
  misc_feature: Ceres CLONE 1456193-F
  misc_feature: Encodes the peptide sequence at SEQ ID NO. 47929
  misc_feature (29)..(29): n is a, c, t, g, unknown, or other
  misc_feature (30)..(30): n is a, c, t, g, unknown, or other
  misc_feature (40)..(40): n is a, c, t, g, unknown, or other
  misc_feature (42)..(42): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (464)..(464): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (568)..(568): n is a, c, t, g, unknown, or other
  misc_feature (641)..(641): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (680)..(680): n is a, c, t, g, unknown, or other
  misc_feature (689)..(689): n is a, c, t, g, unknown, or other
  misc_feature (694)..(694): n is a, c, t, g, unknown, or other
  misc_feature (718)..(718): n is a, c, t, g, unknown, or other
  misc_feature (720)..(720): n is a, c, t, g, unknown, or other
  misc_feature (737)..(737): n is a, c, t, g, unknown, or other
  misc_feature (743)..(743): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (805)..(805): n is a, c, t, g, unknown, or other
  misc_feature (830)..(830): n is a, c, t, g, unknown, or other
  misc_feature (831)..(831): n is a, c, t, g, unknown, or other
  misc_feature (845)..(845): n is a, c, t, g, unknown, or other
  misc_feature (875)..(875): n is a, c, t, g, unknown, or other
  misc_feature (876)..(876): n is a, c, t, g, unknown, or other
acacaagtggtgtaggtcccctgcgcccnncccccatatntnaacacaccgtggctcaccgcggtggcggccgctctaaaactagtggatcccccgggctgcaggaattcgtctcacccctaatcgaaaaaccgatcccattccccaggcccaagcgcccatggatcccaagcccgacgccagcgcgcccgccgcggtgcctgcggagcacgcggcgtacccgaggctgtcaccggaggacatcgccccgccgccgccgcctgttgtgacgccgtccggggccaacccctacgggctctccgccccggtctctagcccgcccgcctagagcgcttgggagactctgacggagatgttcgccatggcgcggaagaagttcaacgaggccgcgcgcaagaccggtgggtatcggtgggtgttttnnnnnnatgttaactagaaaacgggatccatgtatccttggngcccgccccgagcgggggattgccccacaataccccggggtaaagggtgaaaggggaggcnnncaacacaagacatttgcgaaaaggaatgttgaaagggactngccgcagaaggagacagacgccgggggggtatacagcctccgccagccctacccgctaggccccaaggcaacnaaggtgtcgccacgtgnnngnannnnccacacacagcanccgggaagnccccngttgcggggctcgctcccggtcantnctttctcaacgcccgcncacgangcccaacctccannnnnnaaatagagaacattacacccatacaaccccgcgnnnnccggatnactcccacgctaaatcccccccgcnncctctgtgttgggngcatgagaggctgagctctcggtaacaccnnc

SEQ ID NO: 47929 - protein, 55 aa, Zea mays
  misc_feature: Ceres CLONE 1456193-F
MDPKPDASAPAAVPAEHAAYPRLSPEDIAPPPPPVVTPSGANPYGLSAPVSSPPA

SEQ ID NO: 47930 - DNA, 768 bp, Zea mays
  misc_feature: Ceres CLONE 1456194-F
  misc_feature: Encodes the peptide sequence at SEQ ID NO. 47931
  misc_feature (488)..(488): n is a, c, t, g, unknown, or other
aagctggagctccccgcggtggcggccgctctagaactagtggatcccccgggctgcaggaattcgtctcacccctaatcgaaaacactacatcttctttgtcttgaacctctacgccagtgtcaccgtggttgagagtttgatgatggccattgcaagtgtcatacccaatttcctcatgggcatcatcataggagctggaattcagggaatattcatgcttgtctccggatacttcagacttccatatgacatcccgaaggttttctggagataccccatgcagtacatcagcttccattactgggcactacagggccaatgccagaatgacatggacggtctcctattcgacaaccaatacccggatcagccgaagatccctggggagttcatcctgaagtacatcttccaaatcactgtgcaccggtcgaagtggatcgacctgtcggtcatcttcagcatgatcttcatctacagcctgctgntcttcatcatgatcaaggtgaacgaggacgtgatgcccctgaatccggggctacgtcgcgaggaaaaggcttcataagaaggtgcctgccatccggcagacgcttccctgaaaaggttatgttgggaatccggggcttggcccctaccaaggctaaaaaaattaaccttggggtttctggagcccaaaaaaaaaggcccccaaccggttcttgggggaatttttcctagggcaaaaaacgggaaatttttaccgtttaaaaaaacaaaaaaaaacccccc

SEQ ID NO: 47931 - protein, 139 aa, Zea mays
  misc_feature: Ceres CLONE 1456194-F
  misc_feature (115)..(115): Xaa is any aa, unknown, or other
MAIASVIPNFLMGIIIGAGIQGIFMLVSGYFRLPYDIPKVFWRYPMQYISFHYWALQGQCQNDMDGLLFDNQYPDQPKIPGEFILKYIFQITVHRSKWIDLSVIFSMIFIYSLLXFIMIKVNEDVMPLNPGLRREEKAS

SEQ ID NO: 47932 - DNA, 784 bp, Zea mays
  misc_feature: Ceres CLONE 1456196-F
  misc_feature: Encodes the peptide sequence at SEQ ID NO. 47933
  misc_feature (52)..(52): n is a, c, t, g, unknown, or other
  misc_feature (129)..(129): n is a, c, t, g, unknown, or other
  misc_feature (282)..(282): n is a, c, t, g, unknown, or other
  misc_feature (340)..(340): n is a, c, t, g, unknown, or other
  misc_feature (356)..(356): n is a, c, t, g, unknown, or other
  misc_feature (362)..(362): n is a, c, t, g, unknown, or other
  misc_feature (368)..(368): n is a, c, t, g, unknown, or other
  misc_feature (383)..(383): n is a, c, t, g, unknown, or other
aaagctggagctccccgcggtggcggccgctctagaactagtggatcccccngggctgcaggaattcgtctcacccctaatcgaaaaatcagtctccccttccaaaaccggatttgcgaaccacacctnagcagccgaggttagcacgcgtcctgcgtccatggaggacgaggagcacgaggtgtacggccaggagattcccgttgacggcgaggacgtcgacatggctgccggcgacgatgccaccaagctgcaggaacttgacgatatgaagcgccggcntcaggaaatggaggaggaggccgccacgctccgcgagatgcaggccaagggttgccanggagatgcaggtgtanatcccnatgcanccacatctgaaaacnaagaggagatggattctcggtcagtattcatggaaatattgactatgcgtgccctcccaaagaagtgcagcaaccctttcaattctggtgggactgtcaacagaattacaatcctgactgacaagtttgggcacccaaaggtttttgcttacctggaattttgtggaaatttaaaccttttcagaacctttcatgttaaacaatccaatttcccggccccccttcaagggggccccaaaaaaaaataactcccggggaaaaaacccccccgggggggggttttattttgacgcgggcccccccttgagggcgcgtgggtttaccccttttggtttgggggaaccccccaaattgcccccgccgagaaactttttttaggccccgctcccctttgaaaaaaa

SEQ ID NO: 47933 - protein, 156 aa, Zea mays
  misc_feature: Ceres CLONE 1456196-F
  misc_feature (41)..(41): Xaa is any aa, unknown, or other
  misc_feature (60)..(60): Xaa is any aa, unknown, or other
  misc_feature (66)..(66): Xaa is any aa, unknown, or other
  misc_feature (68)..(68): Xaa is any aa, unknown, or other
  misc_feature (70)..(70): Xaa is any aa, unknown, or other
  misc_feature (75)..(75): Xaa is any aa, unknown, or other
MEDEEHEVYGQEIPVDGEDVDMAAGDDATKLQELDDMKRRXQEMEEEAATLREMQAKGCXGDAGVXPXAXTSENXEEMDSRSVFMEILTMRALPKKCSNPFNSGGTVNRITILTDKFGHPKVFAYLEFCGNLNLFRTFHVKQSNFPAPLQGGPKKK

SEQ ID NO: 47934 - DNA, 781 bp, Zea mays
  misc_feature: Ceres CLONE 1456197-F
  misc_feature: Encodes the peptide sequence at SEQ ID NO. 47935
aaactggagctccccgcggtggcggccgctctagaactagtggatcccccgggctgcaggaattcgtctcacccctaatcgaaaaacaaacagatacagcccgtccattccccaatccccgtgtcgcctgtgcccctctgccacctcgccgtcggcatgacaacagggtcgaccccgggttctgccccctctcatagaaaacgaaattctaccaaggattccgttgccctgtacgcggtgcaatgctataagtgctacaaatggagaacggttccaaaagaaaaatttgagacgcttcgtgaaaacttcactaacgatccatggttctgcatcacacgaccagacagctcttgtgaagacgatgctgacattgattacaacagcacccgcatttgggttttggacaagcccaacataccaaagcctccaccagagactgataggctagtggttatgaggggcgactacagcaaaatggacacatattatgtcatgcccaatgggaagcgtgcaaggtgtgctggtgatgtggataagtttctggaggcaaatccggagtacaaagaccgcatatctgcttcggatttcatctttgcgccacccaaggttgttgaggagactgtttctcactaccctgcctggcaagctgccaaggccaacaagcatgagaatgcatatgcacataagtgaatgatactcccaacggtgccttgtgttatgttttaaatgataatccgctcaagatcatgccccagtcctatctagtgtgtacttgcctatc

SEQ ID NO: 47935 - protein, 177 aa, Zea mays
  misc_feature: Ceres CLONE 1456197-F
  misc_feature (25)..(73): Pfam Name: zf-CW Pfam Description: CW-type Zinc Finger
MTTGSTPGSAPSHRKRNSTKDSVALYAVQCYKCYKWRTVPKEKFETLRENFTNDPWFCITRPDSSCEDDADIDYNSTRIWVLDKPNIPKPPPETDRLVVMRGDYSKMDTYYVMPNGKRARCAGDVDKFLEANPEYKDRISASDFIFAPPKVVEETVSHYPAWQAAKANKHENAYAHK

SEQ ID NO: 47936 - DNA, 763 bp, Zea mays
  misc_feature: Ceres CLONE 1456198-F
  misc_feature: Encodes the peptide sequence at SEQ ID NO. 47937
  misc_feature (653)..(653): n is a, c, t, g, unknown, or other
  misc_feature (664)..(664): n is a, c, t, g, unknown, or other
  misc_feature (673)..(673): n is a, c, t, g, unknown, or other
  misc_feature (734)..(734): n is a, c, t, g, unknown, or other
  misc_feature (743)..(743): n is a, c, t, g, unknown, or other
aacagctggagctccccgcggtggcggccgctctagaactagtggatcccccgggctgcaggaattcgtctcacccctaatcgaaaaaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaacaaccatatgttgtggagcttgatcagcgagaggatggctcaaagattcaggatgccttacttgagatagttgggaggcgtactgtccctccagttttttgtccatggaaagcacctgggtggttctgacaatactgttgactcctactaaagtggaaaactggctttacttcctaaccttcggagtcaggaacgacctttgagggacgtgttaaatccggccagccaggttcgtttggtttaaatccgaaggggctcctccgcaccccaaaatggntttcgcccctngtggttacngctcccccaccctacatacgtattttaaaccccaaacagaacgtccccacctctctctttnttggagttnccaagcccacttttgcgcta

SEQ ID NO: 47937 - protein, 111 aa, Zea mays
  misc_feature: Ceres CLONE 1456198-F
  misc_feature (44)..(105): Pfam Name: Glutaredoxin Pfam Description: Glutaredoxin
MVALLGRRIGVAAAAAAFIALVAFGSASSSPKSFVKSTVSAHDVVIFSKSYCPYCKRAKAVFKELELKKQPYVVELDQREDGSKIQDALLEIVGRRTVPPVFCPWKAPGWF

SEQ ID NO: 47938 - DNA, 766 bp, Zea mays
  misc_feature: Ceres CLONE 1456200-F
  misc_feature: Translation starting site: 110
  misc_feature: Pfam Name: Translin Pfam Description: Translin family
  misc_feature (677)..(677): n is a, c, t, g, unknown, or other
tggagctccccgcggtggcggccgctctagaactagtggatcccccgggctgcaggaattcgtctcacccctaatcgaaaaaaactgtcaaaacggggacacaggccagatggtgcttctgcgcgtttgccgtcacttcggccacctgcgcttcgcctccttcctctcaatggcggcgccccagcaatccgctcccctgtccgggtcggcgcccaagaggctcagggcgatggccacagacgccgctgcagtgccgaatcccccagcctctagtggctgccccgcgatgaaggcggagttcgccaagcacgccgagtacctcaacaccctgaatgacaagagagaaaggcttgtgaaagctagtcgggatattacaatgaacagcaaaaaggtcatctttcaggtccacagggacgaagttctctcgaaggcagaaaatgatcttgctgcagttgttaatcaatacattgcaaaactagtaaaagaattacaaggaactgacttctggaaactcagaagagcctacacctttggtgtacaagaatatgtcgaagctgcaacactctgtagattttgcaagactggcactctattaagccttgctgaaacaatgattctttactagcactaagtggtcaatctgttgagcccttacagttaaatgtgcttgactatcntttaggggttgctgaattgtccggagagcttatgaggctcgcaataggccgtatatctgatggggaagtgaatatgcaaaactatctgt

SEQ ID NO: 47939 - DNA, 781 bp, Zea mays
  misc_feature: Ceres CLONE 1456203-F
  misc_feature: Encodes the peptide sequence at SEQ ID NO. 47940
ctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaaagctctgacagcatggcgtgcgcgtgaactatgaatgtatgagtcactccgaagctaaactggttgagtacaatgctaagctgaggagctgcattcacatcatgtggtggaaccccaagggaagcttctttattcggacagcctcatttggtcaccgaccaaacagggaccccccccaagcccgggaataccctgggttttggcttttggacttaaaacaaccccctggttttcccaaaacccatatccaaaccgaaaaaaaaagtgcttttaaacccccaggggctccccccccccaaaaattgggacgcgccttggaaaagggcgaaaaaagcccctttaaaaaaaaaaaaaaaaaagggggccggagggaccccctcccccccaatagggggcaaaaaacccccgctccggggcgctc

SEQ ID NO: 47940 - protein, 71 aa, Zea mays; identical to SEQ ID NO: 46198
  misc_feature: Ceres CLONE 1456203-F

SEQ ID NO: 47941 - DNA, 771 bp, Zea mays
  misc_feature: Ceres CLONE 1456205-F
  misc_feature: Encodes the peptide sequence at SEQ ID NO. 47942
  misc_feature (645)..(645): n is a, c, t, g, unknown, or other
  misc_feature (683)..(683): n is a, c, t, g, unknown, or other
  misc_feature (707)..(707): n is a, c, t, g, unknown, or other
  misc_feature (725)..(725): n is a, c, t, g, unknown, or other
ggagctccccgcggtggcggccgctctagaactagtggatcccccgggctgcaggaattcgtctcacccctaatcgaaaatcccttcccctttcgctcgagtctgctctagggtttttgccaagccgccgtcgccgtcgctctgccctcgtatcccctcccacgacaccgagacaccaagatgacggcgcagaccgcggaggagctcgccacccagatcgagcagcagaagctcgaggagcagaagaccgaggcagaggaagttgtggtggaggatgaggaggaggaagatgaggacgatgacgatgatgacaaggatgatgatgaactcgatggggatgccagtggcaagtcaaagcaaagcaggagtgagaagaagagccgcaaggccatgctgaagcttggcatgaagcccatcactggtgtcagccgcgtcactgtaaagaaaagcaagaatatactctttgtcatctccaaaccagatgtgttcaagagcccgaattccgacacgtatgtcatattcggcgaggctaagatcgaggacctcagctcccagctgcagacccaggcagcagagcagttcaaggctcctgacttgagccagatgatcttgaatccagagacgtctggcccgggacaggaggancatgatgagggagtcgacgaaactggtgttgaggccanggacatgagctggtgatgacccangcatctgtttcagggccnaggctgtcaggcccctcaggctctatggggacatgtcactgccatc

SEQ ID NO: 47942 - protein, 172 aa, Zea mays
  misc_feature: Ceres CLONE 1456205-F
  misc_feature (62)..(121): Pfam Name: NAC Pfam Description: NAC domain
  misc_feature (155)..(155): Xaa is any aa, unknown, or other
  misc_feature (168)..(168): Xaa is any aa, unknown, or other
MTAQTAEELATQIEQQKLEEQKTEAEEVVVEDEEEEDEDDDDDDKDDDELDGDASGKSKQSRSEKKSRKAMLKLGMKPITGVSRVTVKKSKNILFVISKPDVFKSPNSDTYVIFGEAKIEDLSSQLQTQAAEQFKAPDLSQMILNPETSGPGQEXHDEGVDETGVEAXDMSW

SEQ ID NO: 47943 - DNA, 769 bp, Zea mays
  misc_feature: Ceres CLONE 1456206-F
  misc_feature: Encodes the peptide sequence at SEQ ID NO. 47944
  misc_feature (601)..(601): n is a, c, t, g, unknown, or other
  misc_feature (602)..(602): n is a, c, t, g, unknown, or other
  misc_feature (616)..(616): n is a, c, t, g, unknown, or other
  misc_feature (660)..(660): n is a, c, t, g, unknown, or other
  misc_feature (706)..(706): n is a, c, t, g, unknown, or other
  misc_feature (708)..(708): n is a, c, t, g, unknown, or other
  misc_feature (769)..(769): n is a, c, t, g, unknown, or other
ggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttacaccgcgacctcttttttttcctaaggaacgtacattgtcatttttggaagcttctgaaagcatgccgagcgcatgaactatgaatgtatgaatcactccgaagctaaactgtttgagtactatgcaaagctgaagagctgcttccccatcattgggtggaccgccaaggaaggttctttactcgaaaagcctcagttgaacacggaaaaatcaaggaaccccccaacccggggaaaaaccctgggtttggctttggccaaaaaaaaacccttggttttggcaaaaacccaanntaacccaaacaacnatgttttttaaaaccccagggcccccccccctacacaaaatttnggccctctttgcacaccgcgggaaaacatcccctttaaaaaaaaananacggcggccccggggggcccacctcccccccatggggggaaaactcccccgcccccgccgn

SEQ ID NO: 47944 - protein, 71 aa, Zea mays; identical to SEQ ID NO: 46198
  misc_feature: Ceres CLONE 1456206-F

SEQ ID NO: 47945 - DNA, 759 bp, Zea mays
  misc_feature: Ceres CLONE 1456208-F
ggagctccccgcggtggcggccgctctagaactagtggatcccccgggctgcaggaattcgtctcacccctaatcgaaaactcccgcatagccgccgacaactctctttaccgtctgatacccccagaagcagcccggcgccggcgaccgtgtctgacggaaataaccttacgatctccgagggaaagaagggtggaaatacacccaccgtccaccctttctctaccaccgataggaatgacttcccggccccgtcggtgttccgagtgcgccacatcgggaacactctcgtatccttgacacaagttaccaggattgcttcttagggtctgaaccacacagtctttgaggtttgcctatctcatcctccgggcgacgaggatcaatcttacttgaaactctcgctccgtacttaatatgtgctggccacgaatgtgctcacaaaattttcttctatgaattttaccactgataaactgacatccctactgaacatgtgattcacattaatctaagcccctgttgatgtcatgacacccgacaactacctgttgcatgtagctctgcatcttcttcacgagaatgcgcccaaaccaagtatagataacctgctatgctcaggtatcccaaatccgtccgatccgccgaaagatgattaatatcaggatcttcccggcttctctgtgtgacctgtaagaacttgcttcgaagttcattcgagatctattgggcaaagctactgatacatctacctacagc

SEQ ID NO: 47946 - DNA, 774 bp, Zea mays
  misc_feature: Ceres CLONE 1456212-F
  misc_feature: Encodes the peptide sequence at SEQ ID NO. 47947
ctggagctccccgcggtggcggccgctctagaactagtggatcccccgggctgcaggaattcgtctcacccctaatcgaaaagaaaaaaaaaactactgcggagattgacctgaccaccaccaccggcctgcgttaccgcggccgccaccgccatggttgccgctgccccccatgcatactcctccctcgtgcctgtttcggctgcgcggcctctctccggaagcacagtttctttcggtgcttcgtgccacaaatggaggaaggttccggcatggcgactccactgtgttgctgaagacgaagcagaggaagtcaaagattttggagtcaatatggcactatccatgctaaaattttacaaacgagaaatatcacctttactaccttcaagctgccgatatgtaccaacttgcagtgagtactctatgcaagcgtacaaacgatatggtgttgtaaagggttccatcttgactgcttggcgcctttgccgttgtaatcctcttggtggatatgggtatgatcctccaaaatggtttggcgaggaagatgtacctctgcaataataatgcctagtaattgaaagtacaggcattgtaattcttcagatccagacttgcagcagtttttatgttctggtcactgtcacatacaatgcacaactgtatgtggaagtttcaagccaaagcctccacatcgactatactgccaaggaacttgattggatttctgacatttctatgctgaagatacataaatggcaacgggaagagctg

SEQ ID NO: 47947 - protein, 136 aa, Zea mays
  misc_feature: Ceres CLONE 1456212-F
  misc_feature (58)..(125): Pfam Name: DUF37 Pfam Description: Domain of unknown function DUF37
MVAAAPHAYSSLVPVSAARPLSGSTVSFGASCHKWRKVPAWRLHCVAEDEAEEVKDFGVNMALSMLKFYKREISPLLPSSCRYVPTCSEYSMQAYKRYGVVKGSILTAWRLCRCNPLGGYGYDPPKWFGEEDVPLQ

SEQ ID NO: 47948 - DNA, 758 bp, Zea mays
  misc_feature: Ceres CLONE 1456214-F
  misc_feature: Translation starting site: 202
  misc_feature (718)..(718): n is a, c, t, g, unknown, or other
tggagctccccgcggtggcggccgctctagaactagtggatcccccgggctgcaggaattcgtctcacccctaatcgaaaaacacacaacaccagtcaccagctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgcgccgccgccgaggaggaggcagacaagaagcgcgccgccgccgaggaggaggcagacaagcagcgcgacgcggagacagcacccccggcggccaagtgagtagctagatctgagcaccgaaacgttcagagggaaccgaacgtgtgtctctcgtacgtacgttacgtgtacgtacgtagcatatctatctcttctgtgcgcatatgctgccggtggtgctcacgcgcgccagctacttgtcaccaactcttgcagggcgcccgtggtcggatggccaccggtgaggtcgtaccggaagagctgcttccagcaggcaaagcagcaggccgtcagcagcagcagcagcaaggcggccgacaaagaggatgctgcngcgccggcgccgagctgcacggcgtccgcagccgcctcaa

SEQ ID NO: 47949 - DNA, 771 bp, Zea mays
  misc_feature: Ceres CLONE 1456217-F
  misc_feature: Encodes the peptide sequence at SEQ ID NO. 47950
ggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtctcccttccagcataaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgttaaataaagaaaattatctgacacacaaaaaagaaacacgagacgctcgacgtacc

SEQ ID NO: 47950 - protein, 72 aa, Zea mays; identical to SEQ ID NO: 47800
  misc_feature: Ceres CLONE 1456217-F

SEQ ID NO: 47951 - DNA, 770 bp, Zea mays
  misc_feature: Ceres CLONE 1456223-F
  misc_feature: Encodes the peptide sequence at SEQ ID NO. 47952
aaactggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaacacattctgttccaagcgtgaactgctcgagtttgcttattatcatggaggcggctgtaattctcttttccaccgcgacctcttttttttcctaaggaacgtacattgtcatttttggaagcttctgaaagcatggcgtgcgggtgaactatgaatgtatgaatcactcccaacctaaactgtttgagtactatgctaagctgaggagctgcattcacatcatgtggtggagcgcgagggaggcttctttatcggacagcctcacttgtcaccgacgcaatcaggcacccccccaacccgtggactacgctggggtttggctttggaatgagaaacaccgctgtgtttgtcataagtcatatcctaactagaaaaacaattagctttaaatcccaatgtatcaccttcctacggaactatgggagcttcttgaaataaggccggaaataccccttctaaaaaaaaaaaaaaaacgcaagcccctcgaggacccaattccccccaatagggaggtcgattacgcgggg

SEQ ID NO: 47952 - protein, 72 aa, Zea mays
  misc_feature: Ceres CLONE 1456223-F
TGAPRGGGRSRTSGSPGLQEFVSPLIENKWERQRFGLQGGFVTNPLAEPNISSAGKTMVTHEGRKKDKTLQK

SEQ ID NO: 47953 - DNA, 731 bp, Zea mays
  misc_feature: Ceres CLONE 1456225-F
  misc_feature: Encodes the peptide sequence at SEQ ID NO. 47954
  misc_feature (584)..(584): n is a, c, t, g, unknown, or other
agctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctctttttttttcctaagaacgtacattgtcatttttggaagcttctgaagcatggcgtgcgcgtgaactatgaatgtatgagtccactccaacctaaactgtttgaatactaggctaacctaagggaactgcttcccatcattggggggaccccaaggaaagtttctttttggaaaaccccctttttacccaaccaattagggcccccccccaaccgggaaaaccctgggttttggttttgaaaaaaaaccccccgtgttttctcaanacttttcccaaccaaaaaaaaagatcttttaaacccccggtcccccccccccaaaaaaagggggcgccttttaaaaagggggagaaaaaacccttttaaaaaaaaaaaaaaaaaaaagggcggggggcccctctccctttttttggt

SEQ ID NO: 47954 - protein, 70 aa, Zea mays
  misc_feature: Ceres CLONE 1456225-F
APRGGGRSRTSGSPGLQEFVSPLIENKWERQRFGLQGGFVTNPLAEPNISSAGKTMVTHEGRKKDKTLQK

SEQ ID NO: 47955 - DNA, 801 bp, Zea mays
  misc_feature: Ceres CLONE 1456237-F
  misc_feature: Translation starting site: 97
  misc_feature (332)..(332): n is a, c, t, g, unknown, or other
ctccccgcggtggcggccgctctagaactagtggatcccccgggctgcaggaattcgtctcacccctaatcgaaaatcatagctgttatacgtacaatgtatggagatttgccaccagcaattatacttgttgggcatagcatgggcggttcagtggctatacatgtggctgcaagaaaagaaattacaaatcttcatgggcttgttgtcgttgatgttgtcgagggaacagcaatggcttcattagttcatatgcagaagatcttagcaaaccgggcacagcatgtttcttagcattgataaagcaattgaatggagtgtcaaaggtcggnccataaaggaacatcgagtctgctcgtgtgtccattcatctaccctgaaatacgatgaatcccgaggatgctaaacttatccccctcctcttgaacaaaccgaaaaatactggaaaaggatggtttgagggtcttttcaaaaaatttctaatctttgcccaggcaaaaataacctggtttttacttggtccccaaagactggaaaaaattttaaaaattgggccaagggaaggaaaaattctaagggggggggattccccccacccggacccttttttccaagaaaaagttcccgaaaaaattttttccccccccccccgagattctttcccccccaaaaaaaagggccttatgggcccaaaaaaccccgcccctattaaaaaaaggccccccaaaaaaaaaagaaaaaaacccccccctccaaaaaaatattctaaaaaaaaaaagagttcccctcccctcttttttt

SEQ ID NO: 47956 - DNA, 750 bp, Zea mays
  misc_feature: Ceres CLONE 1456239-F
  misc_feature: Encodes the peptide sequence at SEQ ID NO. 47957
  misc_feature (543)..(543): n is a, c, t, g, unknown, or other
  misc_feature (610)..(610): n is a, c, t, g, unknown, or other
  misc_feature (622)..(622): n is a, c, t, g, unknown, or other
tccccgcggtggcggccgctctagaactagtggatcccccgggctgcaggaattcgtctcacccctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgncaacacggcgcggcaggcgttccagcgcaccccggactacgtggaggaagcgcaccgcaggatggcngaagccgcggcncacgccggccacaagaacgcgcaggcaggccagggcatccagggcagggcccaagagggccgccccgggggaggtgcaggtgccggcgctggcggcggccgcagggcctcctccatagcaagtcatcc

SEQ ID NO: 47957 - protein, 190 aa, Zea mays
  misc_feature: Ceres CLONE 1456239-F
  misc_feature (44)..(161): Pfam Name: Oleosin Pfam Description: Oleosin
  misc_feature (122)..(122): Xaa is any aa, unknown, or other
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCLXNTARQAFQRTPDYVEEAHRRMAEAAAHAGHKNAQAGQGIQGRAQEGRPGGGAGAGAGGGRRASSIASH

SEQ ID NO: 47958 - DNA, 722 bp, Zea mays
  misc_feature: Ceres CLONE 1456242-F
  misc_feature: Encodes the peptide sequence at SEQ ID NO. 47959
  misc_feature (402)..(402): n is a, c, t, g, unknown, or other
  misc_feature (403)..(403): n is a, c, t, g, unknown, or other
  misc_feature (440)..(440): n is a, c, t, g, unknown, or other
ctcaccgcggtggcggccgctctagaactagtggatcccccgggctgcaggaattcgtctcacccctaatcgaaaaataatattttcagcattcaaaaacacaccaagcgaagcgcactagcaacgacctaacaccaatggctaccaagatattagccctccttgcgcttcttgcccttttagtgagcgcaacaaatgcgttcattattccacagtgctcacttgctcctagtgccagtattccacagttcctcccaccagttacttcaatgggcttcgaacatccagccgtgcaagcctacaggctacaactagcgcttgcggcgagcgccttacaacaaccaattgcccaattgcaacaacaatccttggcacatctaaccctacaaaccattgcaacgnncacacaacaaacacaggtttctgccatcactgagccnacctagcggtggtgaaccctgtcaactacttgcaacagcagctgcttgcatcccaaccacctgctcctgggaacgtagctgataccagaaacaacacagttggaaaatttatgccagtgccaatcaatagcctggggaaacctgccgttaccaaaaatattttattacccccccccggggggaatggcccttttccccaaaaaagttgggcaaaaatttcccccctaaacaccaggggggaaaaccgggccaattaaaaattggcccatcccaaagggtggc

SEQ ID NO: 47959 - protein, 102 aa, Zea mays
  misc_feature: Ceres CLONE 1456242-F
  misc_feature (89)..(89): Xaa is any aa, unknown, or other
MATKILALLALLALLVSATNAFIIPQCSLAPSASIPQFLPPVTSMGFEHPAVQAYRLQLALAASALQQPIAQLQQQSLAHLTLQTIATXTQQTQVSAITEPT

SEQ ID NO: 47960 - DNA, 669 bp, Zea mays
  misc_feature: Ceres CLONE 1456243-F
  misc_feature: Encodes the peptide sequence at SEQ ID NO. 47961
  misc_feature (530)..(530): n is a, c, t, g, unknown, or other
tggagctccaccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctctttttcaccgcgacctcttttttttcctaagaacgtacattgtcatttttggaagcttcttgaagcatggcgggcccgtgaactatgaatgtttgagtccctcaaaacctaactgtttgaataccagctagctgaggaactgcttccatccttggggggaccggcagggaggttcttttccgaaaaccttatttgacccaaacaaattgggccccccccaaagcnggagaaccccctgggtttggcttttgcaagaaaaacacccctgggttgttgcaaaaccctccccaaacaaaaaaaaaaaaagttttttttaaaccagggggggcccccccccccaaaaaaaaagggggccgcccctgta

SEQ ID NO: 47961 - protein, 71 aa, Zea mays
  misc_feature: Ceres CLONE 1456243-F
ELHRGGGRSRTSGSPGLQEFVSPLIENKWERQRFGLQGGFVTNPLAEPNISSAGKTMVTHEGRKKDKTLQK

SEQ ID NO: 47962 - DNA, 751 bp, Zea mays
  misc_feature: Ceres CLONE 1456245-F
  misc_feature: Encodes the peptide sequence at SEQ ID NO. 47963
  misc_feature (691)..(691): n is a, c, t, g, unknown, or other
  misc_feature (711)..(711): n is a, c, t, g, unknown, or other
ggagctccccgcggtggcggccgctctagaactagtggatcccccgggctgcaggaattcgtctcacccctaatcgaaaacactctacccgcacagcgcccctcgcccccacaccccaacccaaccatccgctccttgtcgccttccgacgctgagtttgctggtgtcgatttgcgccggcggatgctcgatctggtagctgcatgtgccgacctactcgtcgaatccgttatctaacgtaatggatgggcaaggcacaaagcacaggattttgatggtgtccgactttttctttccaaactttggtggggtggaaagccatatctactacctgtcacaatgtctacttaagcttggccataaggttgttgtcatgacacatgcatatggaaacagatctggagtacgatatgtcacaaatggtttaaaggtctattatgtaccatggaggccattcctgatgcagaatacacttcctacactatccttgacgtttccaattgtaaggacaattattattcgagagaagatttctgtcgtgcatggacatcaagctttttcaacactgtgtcatgaagcattaatgcatgctaggacaatgggatattgatcaggcaatatgtgtctcacatacaagcaaagagaacactgtcttgaggtctgggatatctccagaagaagttttcatgantcctaatgcagttgacactngcatgtttactccctctcccagcgcttaaactgtgatgaa

SEQ ID NO: 47963 - protein, 122 aa, Zea mays
  misc_feature: Ceres CLONE 1456245-F
  misc_feature (47)..(122): Pfam Name: PIGA Pfam Description: PIGA (GPI anchor biosynthesis)
  misc_feature: SWISSPROT Homolog: EC 2.4.1.198 Phosphatidylinositol N-acetylglucosaminyltransferase
MDGQGTKHRILMVSDFFFPNFGGVESHIYYLSQCLLKLGHKVVVMTHAYGNRSGVRYVTNGLKVYYVPWRPFLMQNTLPTLSLTFPIVRTIIIREKISVVHGHQAFSTLCHEALMHARTMGY

SEQ ID NO: 47964 - DNA, 769 bp, Zea mays
  misc_feature: Ceres CLONE 1456248-F
  misc_feature: Encodes the peptide sequence at SEQ ID NO. 47965
  misc_feature (377)..(377): n is a, c, t, g, unknown, or other
  misc_feature (396)..(396): n is a, c, t, g, unknown, or other
  misc_feature (403)..(403): n is a, c, t, g, unknown, or other
  misc_feature (421)..(421): n is a, c, t, g, unknown, or other
  misc_feature (735)..(735): n is a, c, t, g, unknown, or other
ctggagctccccgcggtggcggccgctctagaactagtggatcccccgggctgcaggaattcgtctcacccctaatcgaaaaatagtattacacaaccagcaaggccgcccgcttgccggcaacatgaagaagatcttcggcgccaagaagaacaaggatccgccgcccacaatccaggacgcaaccgacagaatcaccaagcgcggcgacaccgtcgatgaaaagatcaagaagctcgacgccgagctcgcgcgctacaaggagcagatcaagaagacgcgcccaggccccgctcaggaggccgtcaaggcacgagccatgagggtcctcaagcagcgcatgatgtacgaagggcagcgtgacatgctctacaccnaaacatataaccttgaccnagttgcnttttgcgcagagggactnagagatgctcaacaaactatgactgcgatgaacgctgcccataaagagctcaaagggatgatgaaaactgtcaagctcgaagattttgatagcatgcaagatgaaaaggagggatcttatggaaggggaccctgaaatacaaaaaaccttgggaaaaactacacctccccaatagatcgttaaagaaaactttggggggaccccatgtttttgacccaaattggattcaaaaaaaatggccctttttccctcaaacaaaaaaaaacgtattttttttcgggggcccaaagggcggtgggggccccaaaaacccnaaaggagaaacagtggtttcaagccccaaatttc

SEQ ID NO: 47965 - protein, 143 aa, Zea mays
  misc_feature: Ceres CLONE 1456248-F
  misc_feature (12)..(142): Pfam Name: Snf7 Pfam Description: Snf7
  misc_feature (85)..(85): Xaa is any aa, unknown, or other
  misc_feature (91)..(91): Xaa is any aa, unknown, or other
MKKIFGAKKNKDPPPTIQDATDRITKRGDTVDEKIKKLDAELARYKEQIKKTRPGPAQEAVKARAMRVLKQRMMYEGQRDMLYTXTYNLDXVAFCAEGLRDAQQTMTAMNAAHKELKGMMKTVKLEDFDSMQDEKEGSYGRGP

SEQ ID NO: 47966 - DNA, 757 bp, Zea mays
  misc_feature: Ceres CLONE 1456253-F
  misc_feature: Encodes the peptide sequence at SEQ ID NO. 47967
ctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagttgtaaataaagaaaatatctgacaaaaaaaaaaaaaaacgaga

SEQ ID NO: 47967 - protein, 72 aa, Zea mays; identical to SEQ ID NO: 46899
  misc_feature: Ceres CLONE 1456253-F

SEQ ID NO: 47968 - DNA, 749 bp, Zea mays
  misc_feature: Ceres CLONE 1456254-F
  misc_feature: Encodes the peptide sequence at SEQ ID NO. 47969
  misc_feature (519)..(519): n is a, c, t, g, unknown, or other
  misc_feature (520)..(520): n is a, c, t, g, unknown, or other
  misc_feature (528)..(528): n is a, c, t, g, unknown, or other
  misc_feature (565)..(565): n is a, c, t, g, unknown, or other
  misc_feature (647)..(647): n is a, c, t, g, unknown, or other
ctggagctccccgcggtggcggccgctctagaactagtggatcccccgggctgcaggaattcgtctcacccctaatcgaaaagcgttggccgccaatcgcagtatcggcaccgttcttccccgcttctccagtccagctcaccagccgccccccctccgctgctgacactgcgaagtgcgaatcaaagccaccaccgcgcacaaaccatggcaccggtggaggcggagcagcaccggcggagggcgttggcgctcgcggcgcacgacgcctccggcgccgtctcccccatccgcatctcgcgaagggacactggagatgacgatgttgccatacagatactgtactgcgggatatgccactctgacctgcacaccatcaagaacgagtggaagaacgccaactaccctgttgtccctgggcacgagatcgccgggctgatcaccgaggttggcaagaacgtgaagaggttcaacgtcggagacaaggttggcgtcgggtgcatggtcaacacatgccanntccttgcnagagctgcgagggagggcaccaaaaactactggcccnagatcatcttcactacaactccacgacaggacggcaccgtcactacggtgctactctgaacatgttgtcgtcaatgagcgcncgtcaatcggttccctgatgcatgcccctcacgaagcgcgcgctgctctgtgcaggataccgtgtacaccccctgaacaccagggctaaacagcagcagccc

SEQ ID NO: 47969 - protein, 138 aa, Zea mays
  misc_feature: Ceres CLONE 1456254-F
  misc_feature (37)..(120): Pfam Name: ADH_N Pfam Description: Alcohol dehydrogenase GroES-like domain
  misc_feature: SWISSPROT Homolog: EC 1.1.1.255 Mannitol dehydrogenase
  misc_feature (104)..(104): Xaa is any aa, unknown, or other
  misc_feature (105)..(105): Xaa is any aa, unknown, or other
  misc_feature (120)..(120): Xaa is any aa, unknown, or other
MAPVEAEQHRRRALALAAHDASGAVSPIRISRRDTGDDDVAIQILYCGICHSDLHTIKNEWKNANYPVVPGHEIAGLITEVGKNVKRFNVGDKVGVGCMVNTCXXLARAAREGTKNYWPXIIFTTTPRQDGTVTTVLL

SEQ ID NO: 47970 - DNA, 610 bp, Zea mays
  misc_feature: Ceres CLONE 1456255-F
  misc_feature: Encodes the peptide sequence at SEQ ID NO. 47971
  misc_feature (152)..(152): n is a, c, t, g, unknown, or other
  misc_feature (203)..(203): n is a, c, t, g, unknown, or other
  misc_feature (379)..(379): n is a, c, t, g, unknown, or other
aaagctgggagctccaccgcggtggcggccgctctagaactagtggatcccccgggctgcaggaattcgtctcacccctaatcgaaaatgtattagaaaaagatttgaacatgagtgagcatcatcattttgcgtttgtgcacggtgcaggncatggaggatggtgttggtacaagctcgccaattcactgagagagaatggnacataggccacctgcatcgacctcaagggcgctgggatcaccctaactgatccaacactgtctcctctcttgatgactacaaccaggctctttatgaattcctttccaaattcccctcgacaaaaaggtatttcggtgaccccacccttggaggaaggaactaaccgctcccttgnccattcccttccaaagccccaggggtgttaccccccacccccctgggaaaaccgggcaccaattccccccctttcaggagaaaccaaaaaattttccggggttaaaacccccccctcaaaaataggggccccccttttgggaagggcccccaaaacccccccccttttttatgaaaaaccctgttttttccgcgcaaaatttttaaaaagaccccccccgggggaaaaccc

SEQ ID NO: 47971 - protein, 68 aa, Zea mays
  misc_feature: Ceres CLONE 1456255-F
SWELHRGGGRSRTSGSPGLQEFVSPLIENVLEKDLNMSEHHHFAFVHGAGHGGWCWYKLANSLRENGT

SEQ ID NO: 47972 - DNA, 767 bp, Zea mays
  misc_feature: Ceres CLONE 1456256-F
  misc_feature: Encodes the peptide sequence at SEQ ID NO. 47973
  misc_feature (398)..(398): n is a, c, t, g, unknown, or other
  misc_feature (443)..(443): n is a, c, t, g, unknown, or other
aaagctggagctccccgcggtggcggccgctcctagaactagtggaatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcataggaacgtacattgtcatttttggaagcttctgaaagcatggcgtgcgcgtgaactatngatgtatgagtcactccgagcctaactggttgagtactatgctancctgaagagctgcatcccatcagggggtggaacgcaagggaggcttccttaacggacagcctccattttccccgacgcaatagggccccccccagcgggggaacaccgtgggttggctttgcaagagaacacaccgtgtgttttcccaaaccccttccgaataggagaaaagggtgtttttaacccaaggtgccccccccccaaaaatttggggtttttttaaaagggccgaaaaacccctctttaaaaaaaaaaaaaaaaaagccgggggcgcccctcccctatttgggtgcattccccccccgccgcgggggttttaaccgg

SEQ ID NO: 47973 - protein, 73 aa, Zea mays
  misc_feature: Ceres CLONE 1456256-F
SWSSPRWRPLLELVESPGLQEFVSPLIENKWERQRFGLQGGFVTNPLAEPNISSAGKTMVTHEGRKKDKTLQK

SEQ ID NO: 47974 - DNA, 770 bp, Zea mays
  misc_feature: Ceres CLONE 1456260-F
  misc_feature (396)..(396): n is a, c, t, g, unknown, or other
  misc_feature (417)..(417): n is a, c, t, g, unknown, or other
tggagctccccgcggtggcggccgctctagaactagtggatcccccgggctgcaggaattcgtctcacccctaatcgaaaaatctctaaaatagtctcccctgtgcaggcatccacttcttctctccctgatccaaatcgtgaaatagcgtcggcggttccctgcgctcctcccctctttttctagcggcgcgcagcagccacgaccggtgttctggcgatcctggacgccccctgcccagactgcgatccattttcgagcttcgaggaatcgacagtcaagcttcggcgaccaagtgatctggctcttcatgttctacaaagttgaagaccctgagcatctgttttggtgaaggttgcctttggtgcaatctatgctcaggtaaagaagaaggcntcaagatggatctcccagagntccaggacgttgatgagtttcaaggattaagctagcaacctcccccagtcagctgcctgggggcattttcttcaccgaccccggggaaaaatccccgaaggcaccccggagaggccacaggaaaaaaaattcccaaagtggcccaggaggaaataaactgtggaagaccccaaccccggggccccaggggctctttaagagctcataatttggggaaaaaaacccctgaaaaaaaaaaattgccctcggaaaaaaaaaaaaggggggggaaaccccctttggggggggcccccccagaggggggggggcccccaaagaaaaaatttggggggcaaccccttttataaaaaagg

SEQ ID NO: 47975 - DNA, 772 bp, Zea mays
  misc_feature: Ceres CLONE 1456265-F
  misc_feature: Encodes the peptide sequence at SEQ ID NO. 47976
  misc_feature (749)..(749): n is a, c, t, g, unknown, or other
ggagctccccgcggtggcggccgctctagaactagtggatcccccgggctgcaggaattcgtctcacccctaatcgaaaacttcccctcgagcgccgctcctgtcctccctgacagcgacgacgccgagccgccactgcagctgtagcctgtctctatggcccgtaatacggtgaaccagctccgggggaagaccgacaccgacctgcagacgcacctcctggagctgagctctgatctctcctccctccgcgtagtgaaggacaccggagggccacccaacaagttctcctggatcaaggtgatgcgcacctctatcgcttgtttgttcgcagtgatctctgacacccctacctctgggttgctgaatgctgacaatgaagaggaacctgttccctctcgagttccgccctaacaagaccggtgcaatccgctgccgtctgatgtagcgccatctttctctgaatatcgagagggaaaagaagcttctgatctacttccccatgaggaagtatgctatatgcgcctaggtcttaactgcgagatgctgtgcttatcagatcatccgctgcgtcttaattcttggtttgtctggactcttgttgtgagtcggaaatacgatgcattcctctgttgccgtagctggctccattggtgtgactggcgattcatgaaatacgagacggtcgacgctgctatttcgccctatagtgaggtcgatttcgcggctcactggccgtctatatcaanggtcatgactggtagatcccttg

SEQ ID NO: 47976 - protein, 85 aa, Zea mays
  misc_feature: Ceres CLONE 1456265-F
  misc_feature (6)..(64): Pfam Name: Ribosomal_L29 Pfam Description: Ribosomal L29 protein
MARNTVNQLRGKTDTDLQTHLLELSSDLSSLRVVKDTGGPPNKFSWIKVMRTSIACLFAVISDTPTSGLLNADNEEEPVPSRVPP

SEQ ID NO: 47977 - DNA, 730 bp, Zea mays
  misc_feature: Ceres CLONE 1456266-F
  misc_feature: Translation starting site: 199
  misc_feature: SWISSPROT Homolog: EC 1.11.1.15 Peroxiredoxin
  misc_feature (455)..(455): n is a, c, t, g, unknown, or other
  misc_feature (474)..(474): n is a, c, t, g, unknown, or other
  misc_feature (498)..(498): n is a, c, t, g, unknown, or other
ctggagctccccgcggtggcggccgctctagaactagtggatcccccgggctgcaggaattcgtctcacccctaatcgaaaactgttagatatccaaccgtacgtaaactagtcacaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaacaaccatatgttgtggagcttgatcagcgagaggatggctcaaagattcangatgccttacttgagatangtggcaggcgtactgtccctcaangttttgtccatggaaagcacctgggtggttctgacgatactgttgactcctacgaaagtgaaaactggctagacttctaaacatcggattcaggacgacctttgagtgactgctacatcggccaccctgttctttggtttcaaccggacgggctcaacaacttaaaatggtttttgcccccgggatacccccccaagtcttaaaatttgatttatccgaacgaacccccaac

SEQ ID NO: 47978 - DNA, 790 bp, Zea mays
  misc_feature: Ceres CLONE 1456269-F
  misc_feature: Encodes the peptide sequence at SEQ ID NO. 47979
  misc_feature (1)..(1): n is a, c, t, g, unknown, or other
  misc_feature (7)..(7): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
ncttgtngtgtcnnnnnttnatccgctgcctgnganntatatatccnccccaaacgattgggtacgggccccccctcgagccactgcagtggtaaagggtgctgtggtaaaggtgggttggcttctcctccccctccggttcgggttcgggttcgtgaggttctccggggttcgggttcgtgggtgagcggatcgagatggcggcgtcggatgttgagtgccgctgcttcgtcggcggcctcgcctgggccacggacgaccactccctccacaacgccttcagcacctacggcgaggtcctcgagtccaagatcatcctcgatcgggagactcagaggtccggcggcttcggcttcgtcatcttcttcacggaggaggcgatgtgtaacgctctcgagggcttgaacggcaaggagttggacggccgtaatatcggtggtcaatgagggataagacccgagaacagcccggaaggaagattgaactcggccacagaggccggccctgggtagggccgctcctattagccgttggcgagttcttcgtagctgtgcgcggtggcggcccacccttggcgccgtaggcgggcgtccttgttggggcaggggggtcttgcgttctctgttttgtttttctgtccgaacttccggcgttcttattttgccctcgtgttgtgggcgccacgttttgtccacgcccatagtccgttgctacactgtgcggcgggctggcccccccttgtgtctccaattattttcccccgctatgccgtcccgcgcctccggccccg

SEQ ID NO: 47979 - protein, 82 aa, Zea mays
  misc_feature: Ceres CLONE 1456269-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVECRCFVGGLAWATDDHSLHNAFSTYGEVLESKIILDRETQRSGGFGFVIFFTEEAMCNALEGLNGKELDGRNIGGQ

SEQ ID NO: 47980 - DNA, 689 bp, Zea mays
  misc_feature: Ceres CLONE 1456270-F
  misc_feature: Encodes the peptide sequence at SEQ ID NO. 47981
ccattgggtaccgggccccccctcgagccctgcagtggtaaagggtgcatcaggcatccaagaagctcaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgactaagccgtcagccgcgaagagcggcggcttaagaaggctgagcagaagccccgggaacccaaaaggaggggaagagcagccaacagggcgcgggcgcccaaaagtgacgtacagtacgtgtgggagtgaatgggaacttccctggatgaatgaatccatggcctggtatggagggagggccctccttttcctggaacctccatgggaaggcgggggggggcccccctcctgggggaaggtggccgaagaatcctaccaataaaactttgtttgtgctggtttcaaaaaaaaaaaaaaaaacccgacccttgggaattcctggagcccgggggaatccccttattcttgagagggggccgccccggggggggagctccagctttttggtcccctttagggggggttaaatttcgagcctgggggcgaaacacggggccctacggtgggtttctcccggggggaaaaatcgcacg

SEQ ID NO: 47981 - protein, 114 aa, Zea mays
  misc_feature: Ceres CLONE 1456270-F
MASLKAAKPSGVAAQGKEPAPKLSETATKPSAAKSGGLRRLSRSPGNPKGGEEQPTGRGRPKVTYSTCGSEWELPWMNESMAWYGGRALLFLEPPWEGGGGPPSWGKVAEESYQ

SEQ ID NO: 47982 - DNA, 724 bp, Zea mays
  misc_feature: Ceres CLONE 1456278-F
  misc_feature: Encodes the peptide sequence at SEQ ID NO. 47983
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (661)..(661): n is a, c, t, g, unknown, or other
  misc_feature (666)..(666): n is a, c, t, g, unknown, or other
  misc_feature (667)..(667): n is a, c, t, g, unknown, or other
  misc_feature (669)..(669): n is a, c, t, g, unknown, or other
  misc_feature (671)..(671): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (683)..(683): n is a, c, t, g, unknown, or other
  misc_feature (684)..(684): n is a, c, t, g, unknown, or other
  misc_feature (687)..(687): n is a, c, t, g, unknown, or other
tcgagccctgcagtggtaaagggttaaccacccgactccacctaaaatagccttccttttccgtccatggccgcgcaaccctaacggcgcccttcccgtgccgcgcgcatggcggaccccggcggctgcctcgaggtccggctcttctacgtgcgcgtctcgccgcacggcggcgcggcccctcccccgcgcctcgcgctcgagctccgccctgcgggcggcgaggcggcccccgtcccgctgcgcctcgaccgccacgacgccgcctcgggcgaggccacctacgttctcacccgcggccgcgcgggtttgccccgccatccgcgggccttcgatgtgggccgaccaccgcgggcgtcgcggctgctccgggggctcgctttcgggggaggccccggcgccaagggccgggtccccccccctggggaaatttgattggggttccccggccgctgggggggggcccccctccggccctcggccttttaaagggggtaacttcgccgggggtggtaaagaccgggcaaaccccccccggggggtaaacagaaaaaccctgggggggttatagccacccccggaaggaaagcttgtgtgtgccccccttttggatttgggggggccgaaaaagggggggaccactgcgttnnnnnnnnntttnccgcnntntntnnnnnannntnnaantatttatctccatcaatattattacacacccaccggg

SEQ ID NO: 47983 - protein, 108 aa, Zea mays
  misc_feature: Ceres CLONE 1456278-F
MADPGGCLEVRLFYVRVSPHGGAAPPPRLALELRPAGGEAAPVPLRLDRHDAASGEATYVLTRGRAGLPRHPRAFDVGRPPRASRLLRGLAFGGGPGAKGRVPPPGEI

SEQ ID NO: 47984 - DNA, 638 bp, Zea mays
  misc_feature: Ceres CLONE 1456280-F
  misc_feature: Encodes the peptide sequence at SEQ ID NO. 47985
  misc_feature (428)..(428): n is a, c, t, g, unknown, or other
  misc_feature (450)..(450): n is a, c, t, g, unknown, or other
  misc_feature (464)..(464): n is a, c, t, g, unknown, or other
  misc_feature (471)..(471): n is a, c, t, g, unknown, or other
  misc_feature (485)..(485): n is a, c, t, g, unknown, or other
cgattgggtccgggccccccctcgagccactgcagtggtaaaggagcaaccaactttcttctccgtcacctgactcacacctccactcacctccggtccaccaacccctgccggccatggcggctgcggcggcgcagaagctcctcgaggcgagcacgaagatcatcggcgtcgggcgcaactacatcgcccacgccgaggagctcggcaacccggtccccaaggagcccgtactattcctaaagccgacctcgtcgttcctccacgctggcgtggccaccgccgccgtcgagatcccggagccgctcgaatcgctacaccacgaggtcgagctcgccgtcgttatctcccggcgtgggcgtgacattcctgaagcgtctgccatggacttcgtcggaggctatgcacttgctttggacatgacagcnaggggcctttcatgctgtgctnagtctgcaggcttnccatggnacttgggctaaggncaagacacattcactcccagtaggggcagaggtccaaaatcatctgtccactatcctgacaatctcgaggtatgggctaagggaaatgatgaactacggccaaaaggatcgacaaggggcatggaattccaagattcccttttcggatcagcc

SEQ ID NO: 47985 - protein, 121 aa, Zea mays
  misc_feature: Ceres CLONE 1456280-F
  misc_feature (30)..(122): Pfam Name: FAA_hydrolase Pfam Description: Fumarylacetoacetate (FAA) hydrolase family
  misc_feature (112)..(112): Xaa is any aa, unknown, or other
  misc_feature (116)..(116): Xaa is any aa, unknown, or other
  misc_feature (119)..(119): Xaa is any aa, unknown, or other
MAAAAAQKLLEASTKIIGVGRNYIAHAEELGNPVPKEPVLFLKPTSSFLHAGVATAAVEIPEPLESLHHEVELAVVISRRGRDIPEASAMDFVGGYALALDMTARGLSCCAXSAGXPWXLG

SEQ ID NO: 47986 - DNA, 661 bp, Zea mays
  misc_feature: Ceres CLONE 1456288-F
  misc_feature: Encodes the peptide sequence at SEQ ID NO. 47987
  misc_feature (505)..(505): n is a, c, t, g, unknown, or other
caattgggtaccgggccccccctcgagcactgcagtggtaaagggcgctttggttctcctcccgtccatccgcggcgagaacgaccgacgacgacagggcgagatgtgctgctgcccgagcaaggcgtgctgcatctgcacgctcatcgtgctggtgctggtggccgtcggcctcgtcttcggcttcagcgtctacagccgcggcttccacaagctcaccaacaacatgcacctgcaggacgatgcatacggccgcggtggcgccggcggctccttccgcgcctacggccactttgccccgccgccgtactagaaggaccgccgccccttctccgagatctagggcctggatgctgggcgattcgagcctcgctccgctctcggtggagttggatgaactgacgccgccgccggcgcctgtaaaaagagatgtatcatgagattttcgttgtttgctgcattttggttttgtctgcaccaatcgactggaatgactagaaattcnatttgttgaagaacgactgagatccgacaacatattaaaaaaaaaaaaaaaaaaccagaccttctggaattcctgcacccccgggggattcactagttctagagcggccgccaccgagggggaaactccccgcttttgttccctatgagtgaaggg

SEQ ID NO: 47987 - protein, 69 aa, Zea mays
  misc_feature: Ceres CLONE 1456288-F
MCCCPSKACCICTLIVLVLVAVGLVFGFSVYSRGFHKLTNNMHLQDDAYGRGGAGGSFRAYGHFAPPPY

SEQ ID NO: 47988 - DNA, 658 bp, Zea mays
  misc_feature: Ceres CLONE 1456289-F
  misc_feature: Translation starting site: 99
  misc_feature (1)..(1): n is a, c, t, g, unknown, or other
  misc_feature (508)..(508): n is a, c, t, g, unknown, or other
  misc_feature (509)..(509): n is a, c, t, g, unknown, or other
  misc_feature (523)..(523): n is a, c, t, g, unknown, or other
  misc_feature (543)..(543): n is a, c, t, g, unknown, or other
  misc_feature (581)..(581): n is a, c, t, g, unknown, or other
  misc_feature (610)..(610): n is a, c, t, g, unknown, or other
ncgattgggtaccgggccccccctcgagccactgcagtggtaaaggggaggcgcgggcggacaaggagcaggcggaggaggagctgtgccaagccacaatgggtatctcgcgtgactcgatgcacaagcgccgggccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaaaaaacccctgctgcaaagaaggataatgctgannggacagaggttgangcagcagctgaagaaacganaagagcaaccatgtcacgaggaagcttgagaagcgcanggagggacgtacccttgacccacacattngagagcaatttggcagtggacggtttgctgcatgcatttcttcccgcc

SEQ ID NO: 47989 - DNA, 641 bp, Zea mays
  misc_feature: Ceres CLONE 1456290-F
  misc_feature: Encodes the peptide sequence at SEQ ID NO. 47990
cgattgggtaccgggccccccctcgagcactgcagtggtaaaggggggtccagccgggcaaccataacacgcgcccgcgttggcgtattctattcgccaagagccaaggggattggggaggccgtccatgttgcgtgttgtttagacgcgccaaaaggcaaaagcgtggaggaggctcatcaagcacaagcacgccacgcgatccacacacggcaagcaacgcccagggctcgtgctcgccccgcgacccgcgaaagatctgtgctggttcgctcgctcgctcgcgccgcgccgccgcgtgggggtgccgatgagctgcgctgggcaggccgacggatggctgctcgactactcgctggtggaggaggacatccaggactccgagtgcatctacatggtcgacgacccggacgtctccagcgtgatactggtgcttgatgctcccagaaaggaagacggcgtccaggactaccccggtgccaagaagagatcccggccggagtctagcgcgccacccggccaccaagcttgccgcgagaagctcccgctagactgactcaatgaaaggttcaacgagttctgtgccatctttggatcttggcaagcacccaaggcctacaaagtcggttttctaagcgacg

SEQ ID NO: 47990 - protein, 81 aa, Zea mays
  misc_feature: Ceres CLONE 1456290-F
MSCAGQADGWLLDYSLVEEDIQDSECIYMVDDPDVSSVILVLDAPRKEDGVQDYPGAKKRSRPESSAPPGHQACREKLPLD

SEQ ID NO: 47991 - DNA, 657 bp, Zea mays
  misc_feature: Ceres CLONE 1456297-F
  misc_feature: Encodes the peptide sequence at SEQ ID NO. 47992
  misc_feature (1)..(1): n is a, c, t, g, unknown, or other
  misc_feature (276)..(276): n is a, c, t, g, unknown, or other
  misc_feature (413)..(413): n is a, c, t, g, unknown, or other
  misc_feature (657)..(657): n is a, c, t, g, unknown, or other
ncgattgggtaccgggccccccctcgagccactgcagtggtaaagaagctccggccggaccgccccaccgcgcgcgcgcatacactcagagatagagagaccgcacggtcgttcggggttcctttggccaggcgcacgacccgagcatggcgcagcgcgacaagaaggaggagcccacggagctgcgggcgccggagatcgcgctctgcgccaacaactgggggttcccgggcaactcggccacgaagaacctgcgccagagctgcttgtcggcgncgaggttttcatcgtcgtcttcttcgctaccggcctctacttcctgtacctaagtttccgcgccgggcgtcgaggtggagttcctcagttctctcctcctggacgatgacggagatgggggaggcgagggacgaggncgaacccccccctgtggagccgtcccagaggacttttgtccgggggagcatcctctgccagaacctcgagcgcgtgaaggactttcggtgccgcttcaattacctgttctccgggcagctcaggtgcttggagggttccgagtgcctgtactaagggcggccccatcctggggagatcccctagttccgggacgaaccaggttggggcaacaccctttaaaatgggtcttgttcctgggtcccn

SEQ ID NO: 47992 - protein, 60 aa, Zea mays
  misc_feature: Ceres CLONE 1456297-F
  misc_feature (44)..(44): Xaa is any aa, unknown, or other
MAQRDKKEEPTELRAPEIALCANNWGFPGNSATKNLRQSCLSAXRFSSSSSSLPASTSCT

SEQ ID NO: 47993 - DNA, 668 bp, Zea mays
  misc_feature: Ceres CLONE 1456299-F
  misc_feature: Encodes the peptide sequence at SEQ ID NO. 47994
  misc_feature (119)..(119): n is a, c, t, g, unknown, or other
cgattgggtaccgggccccccctcgagccactgcagtggtaaaggcaacttccggcgcagcttctcctccgcgtcctccgcgggccacagccacggcgtgcggcggcggcgaatccaanaaacaaaggcaccatcgtcatgaacggcggatattacggcggccgctataacggttccactggcaggaacaacggccgtgttgtcttcacaacgcagggtaacgctccggcggccccgtacggaatgtagaagcgaaacatcgaggccaacggcgacgagagggacttgcagccgcacaagaccgagaaggtgtattgccgcgccaaccccaaatacgacatgagctaccacaacggaaaggtggtgttagggccggcaaaccccaagcactactaccatctctggatcaaggacatgtggtgcatcccgatcatcatggacaaagacggataccagggttacgcgctgatgaataagtgaccggggaggccatcatctcctcgttgggcaagaccaacccggtgcgcgtggtggcttaaaacccgaaattcatgaacaaatcggggttgtgaattgaaagccaggacttcgggaacggcttcccctgcggccagagggacaacaaattaacctaaattttaattgcccttcacggaaaaaagaggaac

SEQ ID NO: 47994 - protein, 46 aa, Zea mays
  misc_feature: Ceres CLONE 1456299-F
MSYHNGKVVLGPANPKHYYHLWIKDMWCIPIIMDKDGYQGYALMNK

SEQ ID NO: 47995 - DNA, 658 bp, Zea mays
  misc_feature: Ceres CLONE 1456300-F
  misc_feature: Encodes the peptide sequence at SEQ ID NO. 47996
  misc_feature (1)..(1): n is a, c, t, g, unknown, or other
  misc_feature (523)..(523): n is a, c, t, g, unknown, or other
ncgattgggtaccgggccccccctcgagccctgcagtggtaaaggaggcacgcggaagatagacagagagagacagatcaccaacttaacaacaataatggccaccgccatagttcccacagacgccgagctgctgcaggcgcatgccgacctgtggcgccacagcctctactacctgacatccatggcgctcaagtgcgcggtggagctccacatcccgaccgccatccacaacctaggcggtgctgccacgctgccggacctcgtggccgctctgtccctgccagcggccaagctcccgttcctcgggcgcgtgatgcggctgctggtcacgtccggcgtcttcacgtcgtcgtccgagtccggcgacgactaccggctgaccccgctgtcctgcctgctgatggagggcgtggactcccacgaccacacctaccagaagtacttcgtgctgcgcaccgtctcccggcactacgtggaggccgagatgtccctggccgactggttcaagaaggacgaggancgagaccggcagctgccgtcaccgttcgaggccctgcacggcgtgcccctcttccacgagagcaccaagctgctggacgacgaactgtacagggtcgtggtagaaggcgtggccacgcacaacaacctggccatg

SEQ ID NO: 47996 - protein, 187 aa, Zea mays
  misc_feature: Ceres CLONE 1456300-F
  misc_feature (30)..(78): Pfam Name: Dimerisation Pfam Description: Dimerisation domain
  misc_feature: SWISSPROT Homolog: EC 2.1.1.146 (Iso)eugenol O-methyltransferase
  misc_feature (142)..(142): Xaa is any aa, unknown, or other
MATAIVPTDAELLQAHADLWRHSLYYLTSMALKCAVELHIPTAIHNLGGAATLPDLVAALSLPAAKLPFLGRVMRLLVTSGVFTSSSESGDDYRLTPLSCLLMEGVDSHDHTYQKYFVLRTVSRHYVEAEMSLADWFKKDEXRDRQLPSPFEALHGVPLFHESTKLLDDELYRVVVEGVATHNNLAM

SEQ ID NO: 47997 - DNA, 665 bp, Zea mays
  misc_feature: Ceres CLONE 1456315-F
  misc_feature: Encodes the peptide sequence at SEQ ID NO. 47998
  misc_feature (392)..(392): n is a, c, t, g, unknown, or other
caattgggtaccgggccccccctcgagccactgcagtgataaaggtgctggatgctcccgaggagggcatgtgcgtgcccatgaagaatgtgctcgagcccggtgacatccccaagcttgctgatctcgggctcactgcaccaccaggcatgtcacaggactcaaaacctgctgttggctctactctcattggtggtgagacataagctctggagaggttgaagaagtttgctgcataatgctctatgcagccaaacaaagtatacaaaagcattacccaaaatagcatatatggtgctaatttctcttgcataatttctccatggcttgctacaagttgcctctctccatggttcatgtatgacgagttgaagaagcatgctactaaagcnattccttttgagtcaacacccaagaataatgatggcacatctgatgctggaacaaattgattaatgtttgacttgctgtgcagacatttcttcacgttcatcacatagaaatacagctctgtacagaaacatctgatgttgccctggctgcactccacgcccagcgcttgaatgacctcacttagacaagctgattgccagctgcttttttggaatgataacttatgtgcattttcactgcagtctattgtatgacgacatcatgctggcatt

SEQ ID NO: 47998 - protein, 67 aa, Zea mays
  misc_feature: Ceres CLONE 1456315-F
IGYRAPPRATAVIKVLDAPEEGMCVPMKNVLEPGDIPKLADLGLTAPPGMSQDSKPAVGSTLIGGET

SEQ ID NO: 47999 - DNA, 654 bp, Zea mays
  misc_feature: Ceres CLONE 1456316-F
  misc_feature: Encodes the peptide sequence at SEQ ID NO. 48000
  misc_feature (356)..(356): n is a, c, t, g, unknown, or other
  misc_feature (394)..(394): n is a, c, t, g, unknown, or other
  misc_feature (420)..(420): n is a, c, t, g, unknown, or other
cgattgggtaccgggccccccctcgagccctgcagtggtaaaggtaggcccccgcgttcacgagccacaagagaagagaggctaaccaccgcagcggctgcggcctgcgagtgcgacaacctccgcggaggagttggagccggcggcggggatatttgcttgcccggctggggttgcggcggaaggagggagagacaaccggcgatggcggcgtccgcgaggtccggggagagggcgaccagcttcgccgtcgcgtgcagcctcctcagtcgcttcgtccgccagaacggcgtcgcggctgccgagctaggcctcaggatcaaaggcgaggtcgagcagcagaggacgccggcgancactaactcgctcccccgagcggagggcgaggaagtcnaaaggaggaaggagaccctggagctngtcccgcaaagcgtcgggttcagcatcaaggatgctgctggccccttgggaggagcaagaagattaagaggagccctaagcactccccatccttctatggccgggaaaggggctgggattttaccaatttccccgccccacaaggcaaaagatcctgatggccccgggcccccaaggggccccccccagggggcaaaaaaccttgttttttgcccccaacccccctggggggtg

SEQ ID NO: 48000 - protein, 150 aa, Zea mays
  misc_feature: Ceres CLONE 1456316-F
  misc_feature (51)..(51): Xaa is any aa, unknown, or other
  misc_feature (64)..(64): Xaa is any aa, unknown, or other
MAASARSGERATSFAVACSLLSRFVRQNGVAAAELGLRIKGEVEQQRTPAXTNSLPRAEGEEVXRRKETLELVPQSVGFSIKDAAGPLGGARRLRGALSTPHPSMAGKGAGILPISPPHKAKDPDGPGPPRGPPQGAKNLVFCPQPPWGV

SEQ ID NO: 48001 - DNA, 693 bp, Zea mays
  misc_feature: Ceres CLONE 1456317-F
  misc_feature: Encodes the peptide sequence at SEQ ID NO. 48002
  misc_feature (452)..(452): n is a, c, t, g, unknown, or other
ctccccgcggtggcggccgctctagaactagtggatcccccgggctgcaggaattcgcacgagaccattacctagaacatcctaatcgaaaattttcctctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatggtctcagttgaagagtcttcagaagctgcaaagggcaagtccccagtgaaagtcagtgtgaagaaaaaactcagaatacngataaagagattaaagggcaaaggcaggaagaaagccaaaaatgcaaaaccaccctgcaaggaagaaagttgatgccatggtagcatgacggacaaaactgcatacatccctttgtatgttttcccaaaatttgccccatgaaccgacctcccgaaaactgggccggggaactgccccttgcatcttctggccgaaagggaaaaaaaacccccttgggcctggggttaatgacttccaaaa

SEQ ID NO: 48002 - protein, 124 aa, Zea mays
  misc_feature: Ceres CLONE 1456317-F
  misc_feature (101)..(101): Xaa is any aa, unknown, or other
MAKYNVVQKNKRQCNQDRKRAAHGEPGTGKLKQRTAPVSMSGKRKKKLERRLNRKQKEAAMIKALENNMGDVDMVSVEESSEAAKGKSPVKVSVKKKLRIXIKRLKGKGRKKAKNAKPPCKEES

SEQ ID NO: 48003 - DNA, 756 bp, Zea mays
  misc_feature: Ceres CLONE 1456328-F
  misc_feature: Encodes the peptide sequence at SEQ ID NO. 48004
  misc_feature (42)..(42): n is a, c, t, g, unknown, or other
  misc_feature (44)..(44): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (701)..(701): n is a, c, t, g, unknown, or other
tatattgagtgacggtagagcgtaacagtagaaaaaaaatantntcttttttcnnnctcgattgggtacgggccccccctcgagccactgcagtggtaaaggtcatcaatcaaatactcagacaaccatggggcaccagcaggcgcagcacggcaaggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgccagcgagatcccggcgtccaaccacgactacctccggcgggtcatgcgcacgctgacagccatgcgcatcttcgcggccagccacgaccccgccaaggccgacgacgcggccgccatctcctacccgatgaccccggcgtcccggctgctcgtcagcaccaccaccatcgtcaacgacgccgccggcgcctcgaaggaaaacactactacccccgagcatcctccccaaaatcgcccaacctggtcccgcccaaacaccatctcccctgcctgttcaaccatgggccgagttggatgaaaggactaaaaagcccggcctgccggtggtcccctggtacaaaaaccggtggcacccgccaaggccaatttttggcccttgccatcgnaaggaaccaacgccggcccaaaacatggggcccgagctttccttaacaaaaaaga

SEQ ID NO: 48004 - protein, 161 aa, Zea mays
  misc_feature: Ceres CLONE 1456328-F
  misc_feature (34)..(82): Pfam Name: Dimerisation Pfam Description: Dimerisation domain
  misc_feature: SWISSPROT Homolog: EC 2.1.1.146 (Iso)eugenol O-methyltransferase
MGHQQAQHGKDDTEELLAAHRQLWCHALGYVKSMALKCALDLRIPDTIDRCGGSATLGELLAASEIPASNHDYLRRVMRTLTAMRIFAASHDPAKADDAAAISYPMTPASRLLVSTTTIVNDAAGASKENTTTPEHPPQNRPTWSRPNTISPACSTMGRVG

SEQ ID NO: 48005 - DNA, 719 bp, Zea mays
  misc_feature: Ceres CLONE 1456337-F
  misc_feature: Encodes the peptide sequence at SEQ ID NO. 48006
  misc_feature (687)..(687): n is a, c, t, g, unknown, or other
agctccccgcggtggcggccgctctagaactagtggatcccccgggctgcaggaattcgcacgagaccattacctagaacatcctaatcgaaaaagagttttttttttcttccttttggcttactgcgcaagaagaagggtaacaagaggacggcggcgatggcgaagaggctgctcccatctctgaaccgggtgctggttgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagaacacgacattttgggcacacttgtggactgattcagagcatcagcaagcctgtcactagtcgttggtttctagacttctagtgggagatgcgtagtatcagaatcctggaatcaaaatcccctaaaacctctgaaactgccggggatggcataaatttttgggatgaaaacatcaaaattgccctgctttcttggtgcaagggaaacttttgcgttttaaaatgggtcaaaaaaaaaaaaaaaaaagcttttccaatcccgncaacccccgggggggggcgccgggcccctttt

SEQ ID NO: 48006 - protein, 98 aa, Zea mays
  misc_feature: Ceres CLONE 1456337-F
  misc_feature (4)..(96): Pfam Name: Cpn10 Pfam Description: Chaperonin 10 Kd subunit
MAKRLLPSLNRVLVEKLVQPKKTAGGILLPETSKQLNAAKVVAVGPGERDKAGNLIPVALKEGDTVLLPEYGGTEVKLAADKEYLLFREHDILGTLVD

SEQ ID NO: 48007 - DNA, 643 bp, Zea mays
  misc_feature: Ceres CLONE 1456340-F
  misc_feature: Encodes the peptide sequence at SEQ ID NO. 48008
  misc_feature (605)..(605): n is a, c, t, g, unknown, or other
ggagctccccgcggtggcggccgctctagaactagtggatcccccgggctgcaggaattcgcacgagaccattacctagaacatcctaatcgaaaaaaggaagaagcatgatccaagctagcagctcagctctccactccctctctgtgctgtgctgtgtagtcgttcattcatgcacttggcgttcttgcagttgcagcccccttctcctcctcatccttgtcggggcagttagctaggtgagaccgtgacagtagtgcagtggagctcaccaggccagcgataagcaattaatggaggtagaggcttgctacaactacggcttcctccctgcagacagaggcaggcaccaaccaccacctccaccacatgcaacccttcctcacgctgcagaggatgtaggtgagctgtgggagtacttcccttgccccttttgctacatcgaggtggaggtgcccttcatctgcaaccaccttcaggaggaacattgctttgacaccagaaatgctgttttgcccatctgcgccaacatctaaggaaaagacatgctgcacatttcagactgcagcacacgcatcttctcaagaagaggaagccctacaggncaagctcatgccctgcgggtggcaacaggccaagaaaa

SEQ ID NO: 48008 - protein, 80 aa, Zea mays
  misc_feature: Ceres CLONE 1456340-F
MEVEACYNYGFLPADRGRHQPPPPPHATLPHAAEDVGELWEYFPCPFCYIEVEVPFICNHLQEEHCFDTRNAVLPICANI

SEQ ID NO: 48009 - DNA, 915 bp, Zea mays
  misc_feature: Ceres CLONE 1456369-F
  misc_feature (45)..(45): n is a, c, t, g, unknown, or other
  misc_feature (433)..(433): n is a, c, t, g, unknown, or other
aatatatcaccaaaaccctactcaaccaggcgaatttctcctttnccccctcaaagctgagagtcaccgcgggggcggccgctcttttcctagtggatcccccgggctgcaggatttcgcacgagaccattacctagaacatcctaatcgaaaagccccagaacgagcctcctctgtccctccctctcccgtctgccccctcgcatccccaaattaagcctggcgcgcaaggcagcgaactcgccgcgcaccggaagggcccggggagctgcaccaggcggccccattgtggcatggctgctacggccgccgccgctggtgtttaattcgcgctcattggccatgccgtgcgccgggccatcccgacgagcacttcgcggtgtctgagttacagcgtcggcacctttccggggtactggtggcctgtggattnaaaaaaattccctgcagtataccgcaggcttgctctggtgcggtgcccgggcgtgttaggagatgttctcaatctttttcgtcccttgggagacggctggactctccagaatttgcgggggtgtggctttggaattccaacagagtcttctcggtttcgcccccgatccgatgcgtttcgccgatacttgtcctctccgggtctctttgccccgggatattgtttacccccctagcctgcgttggttttcctatgcagttgtccccaccttggcggcttttccgtttgggccacagggggtttctccacgagattgcgttatcgggataaaagcattgaggttctctctccaccgtgacctgtatatacctctcacccttttgtgtttctcacgcgccgctgtagatgcgccacccagcgcgacctgtgtggatccgcccacgaggaggtaagggacgccgtccgcccatacattaacaatt

SEQ ID NO: 48010 - DNA, 694 bp, Zea mays
  misc_feature: Ceres CLONE 1456371-F
  misc_feature: Encodes the peptide sequence at SEQ ID NO. 48011
tccccgcggtggcggccgctctagaactagtggatcccccgggctgcaggaattcgcacgagaccattaactagaacatcctaatcgaaaaaccacctttcccttcctctctcatccccaaatcgaggccagccaggggcaccgccaccatcacttcaccgccgccgtcgacttcactctctctctcactcccaaaccaagctaccttccgcccatgggcccaccgccgcgccgccgccaactcctgctgtctctcgcgctgctcgccaccgcggccgcctgctgcgcggcgggggcggcgcccaggctgtcgcccaactactaccgccgcagctgcccgcgcgtggagcggatcgtgtcggacgccgtcgccgccaagcagcgcgccaacccgtccacggctgcgggcacgctgcggctcttcttccacgactgcttcgtcaacggctgcgacgcctcggtgctggtctcgccgctctcctcctccggcgccgcgccggagcgcgccgcggagatcaacctgtccctgcccggggacgccttcgacgccgtggcccgcgccaaggcggcgctggaggccgcgtgcccgggcgtcgtctcctgcgccgacgcgctggcgctagcggcgcgcgacctcgtggccgccctgggcgggccccggttccccgtcgcgctgggccgccgcgactcccgc

SEQ ID NO: 48011 - protein, 160 aa, Zea mays
  misc_feature: Ceres CLONE 1456371-F
  misc_feature (48)..(160): Pfam Name: peroxidase Pfam Description: Peroxidase
  misc_feature: SWISSPROT Homolog: EC 1.11.1.7 Peroxidase
MGPPPRRRQLLLSLALLATAAACCAAGAAPRLSPNYYRRSCPRVERIVSDAVAAKQRANPSTAAGTLRLFFHDCFVNGCDASVLVSPLSSSGAAPERAAEINLSLPGDAFDAVARAKAALEAACPGVVSCADALALAARDLVAALGGPRFPVALGRRDSR

SEQ ID NO: 48012 - DNA, 742 bp, Zea mays
  misc_feature: Ceres CLONE 1456376-F
  misc_feature: Encodes the peptide sequence at SEQ ID NO. 48013
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (46)..(46): n is a, c, t, g, unknown, or other
ttttttcctttcctcttcccttcgctccttgttnnntgctatttanatcaaagtggtgctccccgcggtggcggccgctctatccctagtggatcccccgggctgcaggaattcgcacgagaccattacctagaacatcctaatcgaaaaacgctagcgagcgagagagacgcacatctatctgtcaagcgacgccgcggcctccatcaaagtctgaggcgaacacccccatggcggcggctggcggcggcgcaggagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcacgcaacgtgtttctgaaacatggatcggagctgcgtctcatccctcgcgatagggttggagctgtactcatgtcttccggttagaggatatatacagtccagtgcataacgagcaaaacttgagagaaataaagctttgatgttggccttgcttggctgtaggatgtcgttacaaggataataagcgaaccttaccggacatgtctcaagccgtatgcgctcagtctgcatgtggagagatttcggaaaatgaatccagtatctgaatccaaaaaaaaaaaaaaaaaaacttatcttta

SEQ ID NO: 48013 - protein, 98 aa, Zea mays
  misc_feature: Ceres CLONE 1456376-F
  misc_feature (10)..(85): Pfam Name: UPF0185 Pfam Description: Uncharacterised protein family (UPF0185)
MAAAGGGAGGKVSFKIILTSDPKLPFKVFSVPEAAPFTAVLKYAAEEFKVPPQTSAIITNDGIGINPQQSARNVFLKHGSELRLIPRDRVGAVLMSSG

SEQ ID NO: 48014 - DNA, 651 bp, Zea mays
  misc_feature: Ceres CLONE 1456381-F
  misc_feature: Encodes the peptide sequence at SEQ ID NO. 48015
  misc_feature (546)..(546): n is a, c, t, g, unknown, or other
cgattgggtacgggccccccctcgagccctgcagtggtaaagaggactcatcaagcaagccgtgaggaacgccacgaacgtcaaccccggcctcggcgccggcctcatccgcatggccttccacgactgcttcgtccggggctgcgacggctccgtcctgctcgacgcgacgccggcgaacccgcggccggagaagctcggcccgccaaactttcctagcctgcgcggctacgaggtggtggacgcggccaaggcggcgctcgagaaggcctgcccgggcgtcgtctcctgcgccgacgtcgtccagttcgccgctcgcgacgccgtcttcttcctcagcggctccaaggtgctctacagcctccccgggggccgcttcgacggcagggtgtccttcgagaacgagacgctcaggttcctgccgccgccgtccttcaacctctcccagctcatccagagcttcaaggtcaagggcatgagcgtcgacgacctcgtcgtgctctccggctcccacaccatcggccgctcccactgctcctccttctnccgacgcatctccacgccgccctccgacatgaaccctgccctcgccaccgtgctgaagcggcagtgcccggccaacccccacttcacaacgaccccacggtggtg

SEQ ID NO: 48015 - protein, 179 aa, Zea mays
  misc_feature: Ceres CLONE 1456381-F
  misc_feature (1)..(179): Pfam Name: peroxidase Pfam Description: Peroxidase
  misc_feature: SWISSPROT Homolog: EC 1.11.1.7 Peroxidase
  misc_feature (145)..(145): Xaa is any aa, unknown, or other
MAFHDCFVRGCDGSVLLDATPANPRPEKLGPPNFPSLRGYEVVDAAKAALEKACPGVVSCADVVQFAARDAVFFLSGSKVLYSLPGGRFDGRVSFENETLRFLPPPSFNLSQLIQSFKVKGMSVDDLVVLSGSHTIGRSHCSSFXRRISTPPSDMNPALATVLKRQCPANPHFTTTPRW

SEQ ID NO: 48016 - DNA, 651 bp, Zea mays
  misc_feature: Ceres CLONE 1456383-F
  misc_feature: Encodes the peptide sequence at SEQ ID NO. 48017
tcgagccctgcagtggtaaaggagtcaaaacccttatctactccagtacatgtgctacctacggagaaccagagaagatgcctattacagaagccacacctcagttccctatcaatccatatggaaaagctaagaaaatggcagaggatatcatgttagatttctcaaagtcgaagggagctgacatggctgtcatgattttaagatatttcaatgttattggctctgaccctgagggaagattaggtgaggctcctaggccagaactccgagagcatggtcggatatctggggcatgcttcgatgcagcattaggagtcattaccggattaaaggttaaaggaacagattatcccacaactgatggaacctgcataagagattatattgatgtcacagatttagttgatgctcatgtgaaagcactcaacaaggcagagcctagaacagtcagcatttacaatgttggaacaggaagaggtcgctcggttaatgagttcgtcgatgcctgcaagaaagcaactgggggttaacatcaaaattgagtacctcaacagaaggccaggaaattatgccaaagtatatagcgaccccacaaaaatcaacaaggagctcaactggaccgctcgatattctgatctttaaagagag

SEQ ID NO: 48017 - protein, 176 aa, Zea mays
  misc_feature: Ceres CLONE 1456383-F
  misc_feature (3)..(156): Pfam Name: Epimerase Pfam Description: NAD dependent epimerase/dehydratase family
  misc_feature: SWISSPROT Homolog: EC 5.1.3.5 UDP-arabinose 4-epimerase
EPCSGKGVKTLIYSSTCATYGEPEKMPITEATPQFPINPYGKAKKMAEDIMLDFSKSKGADMAVMILRYFNVIGSDPEGRLGEAPRPELREHGRISGACFDAALGVITGLKVKGTDYPTTDGTCIRDYIDVTDLVDAHVKALNKAEPRTVSIYNVGTGRGRSVNEFVDACKKATGG

SEQ ID NO: 48018 - DNA, 626 bp, Zea mays
  misc_feature: Ceres CLONE 1456384-F
  misc_feature: Encodes the peptide sequence at SEQ ID NO. 48019
ctcgagccctgcagtggtaaaggggggaaaggaaaaggggaagttctcgccagcgtgctgccttgcaagctgctaactagaataggaatccgacgtcgcccccgccccccccctgtgaaaattcgtgatgcggagaacagctaccgccgccctcgtcctcgtccccctcctcgctgcggcggtacagacctccgccctgcctttcatcgtcctgcacgggattggggaccagtgcgccaaccatggcgttgccaagttcactaaacttctcgccgattggtccggctccgacggctactgcctagagattggcagaggaacatgggactcttgggtcatgcctcttcaacaacaggctgatataatctgcaacaaggtcaaggaaatgaaacaactgagaggtggctacaacatagttggtctgtctcaggggaacttgattggtcgagcagtggttgagtactgtgatgatggaccgccggtcaagaatttcatctctctaggaggtcctcatgctggtaccgcttcagtgcctctttgtggttctggatttttttgcattattgttgatgctctgatcaaattggagatctactcagactatgtgcaggaacatcttgcaccta

SEQ ID NO: 48019 - protein, 166 aa, Zea mays
  misc_feature: Ceres CLONE 1456384-F
  misc_feature: SWISSPROT Homolog: EC 3.1.2.22 Palmitoyl-protein hydrolase
MRRTATAALVLVPLLAAAVQTSALPFIVLHGIGDQCANHGVAKFTKLLADWSGSDGYCLEIGRGTWDSWVMPLQQQADIICNKVKEMKQLRGGYNIVGLSQGNLIGRAVVEYCDDGPPVKNFISLGGPHAGTASVPLCGSGFFCIIVDALIKLEIYSDYVQEHLAP

SEQ ID NO: 48020 - DNA, 672 bp, Zea mays
  misc_feature: Ceres CLONE 1456386-F
  misc_feature: Encodes the peptide sequence at SEQ ID NO. 48021
acccgcggtggcggccgctctagaactagtggatcccccgggctgcaggaattcgcacgagaccattacctagaacatcctaatcgaaaaattcgccgcccagccctcacagactcgtctcgtcgtcggccactcccgtccgcgagccgctccatccaaccacctcatccctctccgacacgggccgcggccgaccgccggctccgtggccttgacaccagttgacgaggagcatctctactctacagcgcaaatcggcagatgcttggtcaatatccggcggcggcatatgtcaactctccccttatgcgatggaactgccaactcgccgtgctggtcggagtgctctggatcgaggcttgctgctgcgcgccgtgttgggagggaagctgccgtctcctgccgctgggagaagccggggaccctctgtttgctgagggcaaaatctccttccttgcgcaggcactcgaggaaggtgcaatgggctatcagaaccatgtccgacgacagcggtgaccaatcaggcaacagcactcgcctcttcagcgcgatccgttcattctggaaccagttgtctgccaagctgaagaaagcaaggagagggttgccagtgaagatcctattctttctgatcgggttctactgcgctaccgcgttcgctaccgtcatcgg

SEQ ID NO: 48021 - protein, 127 aa, Zea mays
  misc_feature: Ceres CLONE 1456386-F
MSTLPLCDGTANSPCWSECSGSRLAAARRVGREAAVSCRWEKPGTLCLLRAKSPSLRRHSRKVQWAIRTMSDDSGDQSGNSTRLFSAIRSFWNQLSAKLKKARRGLPVKILFFLIGFYCATAFATVI

SEQ ID NO: 48022 - DNA, 657 bp, Zea mays
  misc_feature: Ceres CLONE 1456399-F
  misc_feature: Encodes the peptide sequence at SEQ ID NO. 48023
  misc_feature (554)..(554): n is a, c, t, g, unknown, or other
  misc_feature (557)..(557): n is a, c, t, g, unknown, or other
  misc_feature (558)..(558): n is a, c, t, g, unknown, or other
  misc_feature (574)..(574): n is a, c, t, g, unknown, or other
cgattgggtaccgggccccccctcgagccctgcagtggtaaagggtgctggcggtgcggccggggaacgggcagaccgtgtgcgtcaccggcgcggccggctacatcgcctcgtggctggtcaagctgctgctcgagaaggggtacactgtcaagggcaccgtcaggaacccagatgacccgaagagcgcgcacctcaaggcgctggacggcgccgccgagcggctggtcctctgcaaggccgacctgctggactacgacgccatccgccgagccgtgcacggctgccagggcgtcttccacaccgcttcccccgtcaccgacgacccggagcaaatggtggagccggcggtgcgcggcacgcagtacgtggtcaacgcggcggcggaggccggcacggtgcgacgggtggtgttcacgtcctccatcggcgcggtcaccatggaccccggccgcgggcccgacgtcgtggtcgacgagtcctgctggagcgacctcgagttctgcaagagaacgaggaactggtactgctacggcaagggcgtggcggaacangcnngcgcggacttgtgccngcagcgcgggctggagctggcggtggtgaccccggtgctggtggtgggccccctgctgcagccggcgttgaacgcagcatcgg

SEQ ID NO: 48023 - protein, 107 aa, Zea mays
  misc_feature: Ceres CLONE 1456399-F
  misc_feature: SWISSPROT Homolog: EC 1.1.1.219 Dihydrokaempferol 4-reductase
  misc_feature (73)..(73): Xaa is any aa, unknown, or other
  misc_feature (75)..(75): Xaa is any aa, unknown, or other
  misc_feature (80)..(80): Xaa is any aa, unknown, or other
MVEPAVRGTQYVVNAAAEAGTVRRVVFTSSIGAVTMDPGRGPDVVVDESCWSDLEFCKRTRNWYCYGKGVAEXAXADLCXQRGLELAVVTPVLVVGPLLQPALNAAS

SEQ ID NO: 48024 - DNA, 674 bp, Zea mays
  misc_feature: Ceres CLONE 1456405-F
  misc_feature: Encodes the peptide sequence at SEQ ID NO. 48025
  misc_feature (365)..(365): n is a, c, t, g, unknown, or other
  misc_feature (539)..(539): n is a, c, t, g, unknown, or other
  misc_feature (545)..(545): n is a, c, t, g, unknown, or other
  misc_feature (546)..(546): n is a, c, t, g, unknown, or other
cgattgggtaccgggccccccctcgagccactgcagtggtaaaggagtcttcacctagcaacaacctgtccaagaaccagcagccaaaggacaagagacacaacgaaaggaaaggaaccaagagaaagatcgagaagagaggagccttcgcttttggacttgcaccgtcgtgatctgtcccgcgaccacatgaggatccacccagcatcccccaccgccggcggcaagaaggacctccggcgcctgccgcacgtgtacagcaaggtgctggagctgccgctcccggcggacaccgacgtccaggtgttcgaaggccccgacgccttccacttcgtcgcggcgccggccgccggtgcgcgtgcggnggccgccgccgccgccaccaccgtgcgggtgcgcaccgtcaggatccaccccggggtcaccaaggtcgtggtgcaggccggaggcgccgaacgggccgctgacgacgacgacgcgagcgacagcatggagctcgacaggtggcggtcccggctgcccgagccgacctgtccggncatggnncggtggcgggtacgtcgacggccagctcgtcgtcacgggtgccaagggcccgggtgccgagaaagcgccgacgcagggcaaggctaggttaccctggagtgcggcggcggaagcaaaatcactggaag

SEQ ID NO: 48025 - protein, 147 aa, Zea mays
  misc_feature: Ceres CLONE 1456405-F
  misc_feature (59)..(59): Xaa is any aa, unknown, or other
  misc_feature (117)..(117): Xaa is any aa, unknown, or other
  misc_feature (119)..(119): Xaa is any aa, unknown, or other
MRIHPASPTAGGKKDLRRLPHVYSKVLELPLPADTDVQVFEGPDAFHFVAAPAAGARAXAAAAATTVRVRTVRIHPGVTKVVVQAGGAERAADDDDASDSMELDRWRSRLPEPTCPXMXRWRVRRRPARRHGCQGPGCRESADAGQG

SEQ ID NO: 48026 - DNA, 676 bp, Zea mays
  misc_feature: Ceres CLONE 1456408-F
  misc_feature: Encodes the peptide sequence at SEQ ID NO. 48027
gctctagaactagtggatcccccgggctgcaggaattcgcacgagaccattacctagaacatcctaatcgaaaaactgtatcacccctgccttcctgctagttctccagagagagccgggagaacttggctgtctgccctgtctgcaagtacctcgtcttcttcctggagagaaaaagcagaagacaatacaaagatgtccaagatggcggaggagaaggcggcggcagtgggcggactcggaggagccggggcggcggacgcggcgcagcagcagcagctggcagcaggggaggccgcggcggcgcgggtgcggcccgtggagacgctgcttcgcgcggcaccgctggggctctgcgtggccgccatgaccgtcatgctccgtaaccagcagagcaacgagtacggcgccgtcgcctactccgacctgggaggcttcaagtacctcgtctacgccaacggcctctgcgctgcctactcgctggtatccgcgttctacactgccgtgccgaggcctgccaccgtgtcgcgctcctggctcgtcttcctcctcgaccaggtgttcacgtacctgatcctggcggcgggcgcagaccggcggcgggagcctgctgtacctccgcctaaaaccgggaccaaagaaggggacctgggaaggaagacttggcggcgttttt

SEQ ID NO: 48027 - protein, 160 aa, Zea mays
  misc_feature: Ceres CLONE 1456408-F
  misc_feature (36)..(132): Pfam Name: DUF588 Pfam Description: Domain of unknown function (DUF588)
MSKMAEEKAAAVGGLGGAGAADAAQQQQLAAGEAAAARVRPVETLLRAAPLGLCVAAMTVMLRNQQSNEYGAVAYSDLGGFKYLVYANGLCAAYSLVSAFYTAVPRPATVSRSWLVFLLDQVFTYLILAAGADRRREPAVPPPKTGTKEGDLGRKTWRRF

SEQ ID NO: 48028 - DNA, 551 bp, Zea mays
  misc_feature: Ceres CLONE 1456409-F
  misc_feature: Encodes the peptide sequence at SEQ ID NO. 48029
cgggccccccctcgagccactgcagtggtaaagggggcaccctccactcgcaccaccacactttagctctccccactgctataggcagcccacatgcgcgcacactcccaagtcctaagctagccagctgagctcgctcccagtccaagcgccggccccaccaccgcagctcgatcacaccatgagcaaggagaagcaccaccgcgactggatcctccggcgctgctgcggctacatcagcgactgcatcatgacgctggcgccgtcgtcggtttccatcgggtcgtttcatcctgagctggcccctcaagcgtccttcactgagggaaggaaatggggtcattcaattaggaccgggggtttccccgactcaagggaaaaccggccccgaacccaaaagaggggggcgggtataaaaaaaccgggagggttcccccctacccgaaaaaggggggaaagggaccccgggttaatccggggataaatccgggggcaccaaggcctttttctttggggccccccccccttatggggggaacacacaccccccc

SEQ ID NO: 48029 - protein, 100 aa, Zea mays
  misc_feature: Ceres CLONE 1456409-F
MSKEKHHRDWILRRCCGYISDCIMTLAPSSVSIGSFHPELAPQASFTEGRKWGHSIRTGGFPDSRENRPRTQKRGAGIKKPGGFPPTRKRGERDPGLIRG

SEQ ID NO: 48030 - DNA, 690 bp, Zea mays
  misc_feature: Ceres CLONE 1456411-F
  misc_feature: Encodes the peptide sequence at SEQ ID NO. 48031
  misc_feature (608)..(608): n is a, c, t, g, unknown, or other
tctccgcggtggcggccgctctattactagtggatcccccgggctgcaggaattcgcacgagaccattacctagaacatcctaatcgaaaaagcgaagcgacacagccgccgccgtttcctcgtctcccatcttcatcttcctcgcagcgccgggactccatcttccgcttcctctcttactcgtgctcggcacgcaggcgacgggagcggcgctcaggctcgggctctcagcggcgacttcagcggcttcccctcccgcctcgcgccctcgcctccggtcctccgcacatcggccggtgatcctgctttaagatgtcagaagcactcgagaaagataaggaatttgatgaagaggaagaggagtatgtattgctagagttggacaattgtctttattcagacatgtcgccaggtgctcccgttcgtactctctggtttggatcctttgacccctaccttgataggaggggacccgtcttagatgatcggaaaaaatgaagaaactatttggcacctggtatctattccccgaaactgaacctgaacccgaacccttcaaggaaagggaaggggccccttctgaaaaaaagccgaacaaacaagcttnctacccataaaggaaaccgcccccaaaggaggggaaaccctctcccccccggcttaaaaaaaaccctcaaaattccggcgca

SEQ ID NO: 48031 - protein, 61 aa, Zea mays
  misc_feature: Ceres CLONE 1456411-F
MSEALEKDKEFDEEEEEYVLLELDNCLYSDMSPGAPVRTLWFGSFDPYLDRRGPVLDDRKK

SEQ ID NO: 48032 - DNA, 710 bp, Zea mays
  misc_feature: Ceres CLONE 1456417-F
  misc_feature: Encodes the peptide sequence at SEQ ID NO. 48033
  misc_feature (335)..(335): n is a, c, t, g, unknown, or other
  misc_feature (356)..(356): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
ctccccgcggtggcggccgctctagaactagtggatcccccgggctgcaggaattcgcacgagaccattacctagaacatcctaatcgaaaaaataatagttcggtgcctttttctagcggggaggaggcaggcggcgcgatctggcaccggccatcacgttccctcccgccgcttccccctccctgccctcccgttccccagatccgaagccattaaaaccagcggatctcacctcggggcgcgtccgcggcatctgggcaagcgagtggtagagccagcagccatgagatggtatgcatcggtagcctcctgagggcgctggtcctgagtgcnggcgcgtctgcgggcaggcgncggggggcccagatcctgtgtggcacnnnagcgatgtacgcgtgactcctcggcacgaacacgctggcccggatcccgggcagtcacgggaaggatgatgctggactcctctgactgggcctctgctgcccccccccggaaggggggcagggccacccccaacccccccggggggggcccgggccctgggcacaaaaagggggtaaccccgggggggaggggaaaagaaatattggcccgtgggtttaaaagggtcaaaaaaaggaaacctgggccccttttttttttgtgggggggaaaacgggcttttcaacccttaaaaaggcgcctttttgggggcattttccattgggt

SEQ ID NO: 48033 - protein, 36 aa, Zea mays
  misc_feature: Ceres CLONE 1456417-F
  misc_feature (32)..(32): Xaa is any aa, unknown, or other
MVCIGSLLRALVLSAGASAGRRRGAQILCGTXAMYA

SEQ ID NO: 48034 - DNA, 707 bp, Zea mays
  misc_feature: Ceres CLONE 1456418-F
  misc_feature: Encodes the peptide sequence at SEQ ID NO. 48035
  misc_feature (707)..(707): n is a, c, t, g, unknown, or other
ggagctccccgcggtggcggccgctctagaactagtggatcccccgggctgcaggaattcgcacgagaccattatctagaacatcctaatcgaaaacccacaatctcacagccctcgaaggcaccacccgcgccgccgccaccgctccgaaattacagccatcgtagtgcggcggctaggtcggccggcgtttggaggagctccgaagatgtggtgccagtcgtgcaaggaagggtacgacgaggaggacgccgggacctgcaaggagtgctacgaggaggccagcgagacggaggaggagctcaagcgggagatcgacgacctccgctcccgcctcctcttcctccgcctcccctcccctaccctcgacgccgcatccgcccccaactgcgacctcctcctccacgccatcccctccaccggcgcgggaggcgaacgcgatgctgggcgcacccccgacacaccccccgtgcccgcccatcgcgtcatccttaagcccttctaaaacaaacaaatggcatctgacctcttggtgttggctgagaagtacgaagtaaaagcaccggaaggcatacgtgtgaaaagttcatagcctccaaagtgaatgacgacaatgctattacccactacgccttcgcgcaccgtcacagcgcaaagcagctgctggaggcctcgctttctgtgctcatggcccacatgtctacgcn

SEQ ID NO: 48035 - protein, 98 aa, Zea mays
  misc_feature: Ceres CLONE 1456418-F
MWCQSCKEGYDEEDAGTCKECYEEASETEEELKREIDDLRSRLLFLRLPSPTLDAASAPNCDLLLHAIPSTGAGGERDAGRTPDTPPVPAHRVILKPF

SEQ ID NO: 48036 - DNA, 694 bp, Zea mays
  misc_feature: Ceres CLONE 1456420-F
  misc_feature: Encodes the peptide sequence at SEQ ID NO. 48037
tggagctccccgcggtggcggccgctctagaactagtggatcccccgggctgcaggaattcgcacgagaccattacctagaacatcctaatcgaaaaaagtaatcagagtccaggcggcagcacagcagcttcctttcctccggcgatggcgaagaatcccaaagatgccgctccggaggaggagatgcccgccgcggccgaggaacaggcagcgcctgccgcgacggtgaaggtgctcttcttcgcccgcgcgcgggacctaacgggcgtggcggattccgcggtggaggtgccgccggggagcaccgcgggggagtgcctcgcgcgggtcctagcccagttccccaagctggaggagatccggggctccgtcgtgctcgcgctcaacgaggagtacgcggccgactcggccgcggtcgccgacggcgacgagctcgctgtcataccgcccatcagtggcggctgacgttattaaccacggccgacttgtgtggaggtaataaaagatatgaagacatcgatcgttgaggaaaaaaaaaagagagaagaaaggttcctctcccttcttcatggtcagtttatcaccacgaatgattgaaattattatatgctcgataaaataatctcttgttcttgattacaattttgttcacgttgatcaatagttttttgttgtcaaagaatggatgaaat

SEQ ID NO: 48037 - protein, 106 aa, Zea mays
  misc_feature: Ceres CLONE 1456420-F
  misc_feature (30)..(106): Pfam Name: ThiS Pfam Description: ThiS family
MAKNPKDAAPEEEMPAAAEEQAAPAATVKVLFFARARDLTGVADSAVEVPPGSTAGECLARVLAQFPKLEEIRGSVVLALNEEYAADSAAVADGDELAVIPPISGG

SEQ ID NO: 48038 - DNA, 714 bp, Zea mays
  misc_feature: Ceres CLONE 1456422-F
  misc_feature: Encodes the peptide sequence at SEQ ID NO. 48039
  misc_feature (336)..(336): n is a, c, t, g, unknown, or other
cccccgggctgcaggaattcgcacgagaccattacctagaacatcctaatcgaaaaatctctctcccttccttctccccgttctccgtgcaatctcggccgtttccgctcccgccatcgccatggaggaggccaaggttgtggagtccaaggacgggacgatctcagttgcttcagcatttgctggtcatcaggaagctgtgcaagacagggaccacaaatttttatcaaaggcagtggaggaagcataccgaggagttgactgcggcgatggaggaccctttggtgcactttttgtccttatgatgaaataatagttagctgccataaattgggnaagaagaaacttatccaactgcccatgctgaccacactggcatgagaaaaggcttgaaaaaacttgtggaaaaattgaacttgcgaatttttgaaatttaggatcttgggaaccctgcccaattgtttttgagggcagatattgtaatccggactaaaaaaccttggctttggaatcccagggcagaaccctccctttccccggcaaattttaaccatttttctgctgaaaattccttaaaaaaaattgggtaattgctctacacagcccccctgggaattataaccccgtggcacatgacaatgggacccctctgatttgcgaaataatagtttttataaataaattagagtccaaaatattcctctgtggtattga

SEQ ID NO: 48039 - protein, 63 aa, Zea mays
  misc_feature: Ceres CLONE 1456422-F
MEEAKVVESKDGTISVASAFAGHQEAVQDRDHKFLSKAVEEAYRGVDCGDGGPFGALFVLMMK

SEQ ID NO: 48040 - DNA, 687 bp, Zea mays
  misc_feature: Ceres CLONE 1456424-F
  misc_feature: Translation starting site: 202
  misc_feature (503)..(503): n is a, c, t, g, unknown, or other
aaagctggagctccccgcggtggcggccgctctagaactagtggatcccccgggctgcaggaattcgcacgagaccattacctagaacatcctaatcgaaaaacactctcaagtcccaactcccaacattacgagacgcctcgccggccgcgccgcgcccaactcctctgatcctcttccttgtccccaccctcttctccgatggcgacgctgcagctcaaccacatcgcgcgggagacctccgacgtggcccgactcgccgccttctacgaggccgtgctggggttcgagcgcatcccttcgcccacctactcgggcttccaggtcgcatggctccgcctcccgagctcccccgacgtcgcgctccacctcatcgagcgggaccccgccgcggcaccccgttcgcggttggcgccgagggcgcgccgccgtcgcagctgccccggcgccaccacctcgccttctccgtcgctgactacgacgggttcgtgaccgggctgaangcgcgcggcaccgagctgttcgagaaatcgcagcccggatgggcgcacgcgccaggtcttcttcttcgaccctgacggcatggcctagaggtactagcgctggtgcagggaatgacagtggacagagacggggatttgcagtctactttctgtttatcggggcatacctcagcaaacccgccta

SEQ ID NO: 48041 - DNA, 702 bp, Zea mays
  misc_feature: Ceres CLONE 1456425-F
  misc_feature: Encodes the peptide sequence at SEQ ID NO. 48042
tggagctccccgcggtggcggccgctctagaactagtggatcccccgggctgcaggaattcgcacgagaccattacctagaacatcctaatcgaaaattttttcaagctctcctcccctcttcctaccattagcagtagccacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaaggatggcgctgtacggcaagaaggaatggtacttcttctccccgcgggaccgcaagtacccgaacgggtccaggcccaaccgcgccgccggggctgggtactggaaggccaccggcgctgacaagcccgtgggcacgcccaagccgctggccatcaagaaggcgctcgtcttctacgccggcaaggcgcccaagggcgagaagaccacctggatcatgcacgagtaccgcctcgacgacgtcgaccgctcgtcgcgcaaaaaaacagcctcaggttggatgactgggccctgtgccgcatctacacaattaagggtggcgggctggataaagcggccgcccccccg

SEQ ID NO: 48042 - protein, 171 aa, Zea mays
  misc_feature: Ceres CLONE 1456425-F
  misc_feature (10)..(135): Pfam Name: NAM Pfam Description: No apical meristem (NAM) protein
MSGAGPDLQLPPGFRFHPTDEELVMHYLCRRCAGLPIAVPIIAEIDLYKFDPWQLPRMALYGKKEWYFFSPRDRKYPNGSRPNRAAGAGYWKATGADKPVGTPKPLAIKKALVFYAGKAPKGEKTTWIMHEYRLDDVDRSSRKKTASGWMTGPCAASTQLRVAGWIKRPPP

SEQ ID NO: 48043 - DNA, 683 bp, Zea mays
  misc_feature: Ceres CLONE 1456426-F
  misc_feature: Encodes the peptide sequence at SEQ ID NO. 48044
ggagctccccgcggtggcggccgctctagaactagtggatcccccgggctgcaggaattcgcacgagaccattacctagaacatcctaatcgaaaaagccctttcgccgtcgctgcggctcctgcccactgactcgtaggtttcgttgtttcgacaatgtgcggcggagccatcatcgccgacttcgtccccgccggcgcccggcgcccggcaacagacgacaccatgtccgcctccatcctctccggcgaggaccatccggagctgccgctgccgctgccggcgccggcgccggggcgcaagacggcgtaccgcgggatccggcgccgcccgtggggccggtgggcggcggagatccgcgacccgcggaagggcgcccgcgtgtggctcggcacctacgccaccccggaggacgcggcgcgcgcctacgacgtggcggcgcgcgagatccgcgggcccaaggccaagctcaacttcccgcccgccgtgggcggcggcggcggcgcgcgcgcgccggcgccggctgcggccaagaggcgccgcaagtccgcggcggccgaggagagctcggcctcgtctcctccggcggcggcggcggccgtcgtcgtggcgggcggcggggaggaggcgctgcgcgactgcatgtccgggctcgaggcgttcctggggctgcaggacgccga

SEQ ID NO: 48044 - protein, 152 aa, Zea mays
  misc_feature: Ceres CLONE 1456426-F
  misc_feature (27)..(78): Pfam Name: AP2 Pfam Description: AP2 domain
MSASILSGEDHPELPLPLPAPAPGRKTAYRGIRRRPWGRWAAEIRDPRKGARVWLGTYATPEDAARAYDVAAREIRGPKAKLNFPPAVGGGGGARAPAPAAAKRRRKSAAAEESSASSPPAAAAAVVVAGGGEEALRDCMSGLEAFLGLQDA

SEQ ID NO: 48045 - DNA, 706 bp, Zea mays
  misc_feature: Ceres CLONE 1456427-F
  misc_feature: Encodes the peptide sequence at SEQ ID NO. 48046
  misc_feature (379)..(379): n is a, c, t, g, unknown, or other
aagctggagctccccgcggtggcggccgctctattaactagtggatcccccgggctgcaggaattcgcacgagaccattacctagaacatccaaatcgaaaaaaggccagtctgagtgtgcgttccattcgcttgtgctgcaactagggtttagaggtgtttctgggcgcgtagcgggaggcggcggcggctatggctgcggcggaggaggagatcgcggtgaaggagccgctggatctgatacgcctcagcctcgacaagcgcatctacgtcaagctccgatccgaccgcgagctgcgcggcaagctccatgcgtatgatcaacatttaaacctgatacttggagatgtcgaagaggtcgtgacatctgttgagatanatgatgaaacatatgaagaaattgtgcccaccacgaaacggactatcccctttctttttgtccgaggtgatggtgtcatattgggtgctccgccccttcggactgcatgaagtttgaagttagatcatgctggttgttaattatgaaaactggagtatttggccacttgatgcgtctccatgaagagcatgtgatgggcccaaccgccactttctccgatggaacgaagacttaaattgtggatccctccctgtatacaaccgcttgtagcttgcaataacctgtcggaacctcaggtggcccaaaaaataaaccaagcaaagcttt

SEQ ID NO: 48046 - protein, 98 aa, Zea mays
  misc_feature: Ceres CLONE 1456427-F
  misc_feature (15)..(93): Pfam Name: LSM Pfam Description: LSM domain
  misc_feature (63)..(63): Xaa is any aa, unknown, or other
MAAAEEEIAVKEPLDLIRLSLDKRIYVKLRSDRELRGKLHAYDQHLNLILGDVEEVVTSVEIXDETYEEIVPTTKRTIPFLFVRGDGVILGAPPLRTA

SEQ ID NO: 48047 - DNA, 681 bp, Zea mays
  misc_feature: Ceres CLONE 1456428-F
  misc_feature: Encodes the peptide sequence at SEQ ID NO. 48048
  misc_feature (538)..(538): n is a, c, t, g, unknown, or other
  misc_feature (545)..(545): n is a, c, t, g, unknown, or other
ctggagctccccgcggtggcggccgctctagaactagtggatcccccgggctgcaggaattcgcacgagaccattacctagaacatcctaatcgaaaaacacttgtctagctggctgctcagatttgtagcttaccttttttctgttcagaaacagatgcctggaagcctttactgtgttcttgttgccaatttcagatattcgcggatatggaggaattaggtgtgcgtccggacgaggatacaacgagacggatcggaaaggcattcgtggcttccggccaagaagaaaaagagaagcatgtcctagagaaatacttgaagaagtggaagtacatccatttcaacggcgagcgcgttcgcgtgcggagggacggaccattggtgtagtgcccgttttctgaaaaatgctcgaacctatcagagtatcgtgccggtaggcggtagggcaggggcgaagctgttactgccgatgtgacagtcaggcacatggatatcggcactagtccctatcctatgtggaatggaacaaaactggnagatggntccatggctctagcctgtggaggagaccaagcggatagggggtggctggctactacgggcaaataatgatttaataagccttacctaggggtccagggaatttgaaggctttaaactggccttttggtcccccgga

SEQ ID NO: 48048 - protein, 59 aa, Zea mays
  misc_feature: Ceres CLONE 1456428-F
MEELGVRPDEDTTRRIGKAFVASGQEEKEKHVLEKYLKKWKYIHFNGERVRVRRDGPLV

SEQ ID NO: 48049 - DNA, 699 bp, Zea mays
  misc_feature: Ceres CLONE 1456435-F
  misc_feature: Encodes the peptide sequence at SEQ ID NO. 48050
aagctggagctccccgcggtggcggccgctctagaactagtggatcccccgggctgcaggaattcgcacgagaccattaactagaacatcctaatcgaaaagatccgacggccgtcgcccccgctcccgacgcatcgtagccgcccagcagccgagaaggaggacggaaggccaccgcgcaattttacgagtcgtcgcacgccccgcgccccgcgcgcggggtgtcgggcaaggtgcccccacgcgcggcggttggcgccgccgtcgtccaccgccgcccgcgtgcgcccaccgccacctgttaccgcctaaggggaacgcctccgttataacccacggcaccatccatgccgtcctccaccaccgcttcaccatccccgccaggcccaccaccaccatggcctctccttcccccgcccgcgcctccggccggcgcgtgccgcccccgtgctggacgaccgacgagaccctcgcgctcgcgcgggcctacaccgcgcgccgcctcgccgtcggccgtgagcacctgacctccgctgactgggccgccgtcgccgcggccgctccgtccaagacgggcaggcagcgccgccacatggtcgagaagctccgccgacgcctcgggtgaaaccgccgccggcccgtgcccgctcctcgaagccattgacttcctcgaagtcccttctccgcccttctttctca

SEQ ID NO: 48050 - protein, 75 aa, Zea mays
  misc_feature: Ceres CLONE 1456435-F
MASPSPARASGRRVPPPCWTTDETLALARAYTARRLAVGREHLTSADWAAVAAAAPSKTGRQRRHMVEKLRRRLG

SEQ ID NO: 48051 - DNA, 749 bp, Zea mays
  misc_feature: Ceres CLONE 1456436-F
  misc_feature: Encodes the peptide sequence at SEQ ID NO. 48052
  misc_feature (433)..(433): n is a, c, t, g, unknown, or other
caaagctggagctccccgcggtggcggccgctctagaactagtggatcccccgggctgcaggaattcgcacgagaccattacctagaacatcctaatcgaaaaaacaactccactcctccccatccctagctagccactagggtttgccagcctttgcagcgtcgcgctcgcgtctcatgcccttgcccatcgacggtagacgagagcgagcggtctgtgttcgtggagcaggggccggcgccatggagatcaacatcgtggacaagtacgagaagctggagaaggtcggggagggcacctacggcaaggtgtacaaggcgcaggacaaggcgacggggcagctggtggcgctgaagaagaccgcctcgagatggacgagggaggcatcccgcccacggcgctccgcgagatctccctcctaaacctcctctnccactcaatctaaatcgtccgcctcctcccccgtccaacaggccgcttaaaattggaaagcccgtcctcctacctccgcttcaaagtccctcaaacccaatttcaaaaagacccctcaactctacccgaggggggcccaggcccgggcggctcccccggaaacccaaaaaaaaattcccggttccctttttcccaaaagggttgccccccgccccaaaccccggggggcccctccccggggtaatttaaaacccaaaacacccctgtggggagaaaagaaaaaagggtttcctccaaaatttgccctctccgggcc

SEQ ID NO: 48052 - protein, 59 aa, Zea mays
  misc_feature: Ceres CLONE 1456436-F
  misc_feature: SWISSPROT Homolog: EC 2.7.11.22 Cyclin-dependent kinase
MEINIVDKYEKLEKVGEGTYGKVYKAQDKATGQLVALKKTASRWTREASRPRRSARSPS

SEQ ID NO: 48053 - DNA, 698 bp, Zea mays
  misc_feature: Ceres CLONE 1456438-F
  misc_feature: Encodes the peptide sequence at SEQ ID NO. 48054
ggagctccccgcggtggcggccgctctagaactagtggatcccccgggctgcaggaattcgcacgagaccattacctagaacatcctaatcgaaaaactaaaaacatcatgggcctcgaactgtccgtctcggaaagggctctcagccatgggaagcccaacgagaactcgggcctaatccgctcacgcacctttctccgtcttcacgaacgaatcacgatcacgggtgccacaactccctgccgatccagtcccccggcaaattcccaaccgccgcacagcaacaccagcggtcggatcgggggagaaacggaagggcaacagcagagcgcgaattcctcagacaaatccaaggtttcgagcacagacacaggcgaaactcgatggcggaggggtccaagccggacgtgccgctgttccagctcctcagcgatcttctccagcaggtggagtcaatgagcaatcaggaagaagtagagctgcgcgctaagattgaagcattaggattagaagtcactaaggtaccagagcagcccgctaatcatctcagcgagctagaaatagctgcagagttgggacagctgtcatcccggcttggaaacctccacacaaagaatatcctcggccgtgctctcatatccagaggagaagtctcttctgagcagcacatctgatatctggatgccggtcataacagc

SEQ ID NO: 48054 - protein, 96 aa, Zea mays
  misc_feature: Ceres CLONE 1456438-F
MAEGSKPDVPLFQLLSDLLQQVESMSNQEEVELRAKIEALGLEVTKVPEQPANHLSELEIAAELGQLSSRLGNLHTKNILGRALISRGEVSSEQHI

SEQ ID NO: 48055 - DNA, 653 bp, Zea mays
  misc_feature: Ceres CLONE 1456439-F
  misc_feature: Encodes the peptide sequence at SEQ ID NO. 48056
ccccgcggtggcggccgctctagaactagtggatcccccgggctgcaggaattcgcacgagaccattacctagaacatcctaatcgaaaaaactctactactcctcccccactgccttgccttcgtcgtcacatgcgcacaagaaagaacccgcgccgcccctgaccctggcccctcctctcctccagcgcgcagccaagacgtcgccgcgcccgcttccatgaccctcgtccccacctcgcgatgagcgacattgcgccgtggtggcgcctgccttttcgttcttgaccgcccgtcgagctgctacgagaaagggagggaggccgggcgatggccgccgcgaggaggctctcggagctgctgcaggagcagcaggagccgttcctcgtcgaggccgccagggcgaggcggccccgacgcgtccgtggcgcgagcggggcggcggcggaggaaacgggaggaggaagtgggctgggctgctgccccaccgcggcgtgccggcggctgctcaggctctgcagccacgggttcaagaaagaggagcgccgggcgccctcagggtcgccctaaccaaggtgcttggcaccaaggccatgcccccgggtgctgccccttggaacgccctccggcgaaaggtgccttctgggggcccg

SEQ ID NO: 48056 - protein, 79 aa, Zea mays
  misc_feature: Ceres CLONE 1456439-F
MAAARRLSELLQEQQEPFLVEAARARRPRRVRGASGAAAEETGGGSGLGCCPTAACRRLLRLCSHGFKKEERRAPSGSP

SEQ ID NO: 48057 - DNA, 649 bp, Zea mays
  misc_feature: Ceres CLONE 1456440-F
  misc_feature: Encodes the peptide sequence at SEQ ID NO. 48058
ggagctccccgcggtggcggccgctctagaactagtggatcccccgggctgcaggaattcgcacgagaccattacctagaacatcctaatcgaaaaactacaactcgacaccgagaaaagcgcagcaaagcaacgcaaagcccacgccgctacagtgctctcttgcctgccgctacgagtcaacgactcgaacgcatacactccaatggcagcgacggtgatggcctccatgagccccctcgcctccgccacccccggcgcgcgtcgcgctttccctgtacggctgctccaggcttctacactcgcgccgcgccggcgcgccttggccgtgagggcccagagcgacgacgccgagccaaaagaggaggtggcctcctcctcgccttctccgtccgccaccccggcgccaaagtccaaggcggcggcgacggcgagccccgggctgtgggacgcgctggcgttcagcggcccggctcccgagcgcatcaacggccggctcgccatggtgggcttcgtgtccgcgctcgccgtcgaggcgtcccgcgggcgggggccctctctcccaaggccgggaagcggggtccgggttcccccgggttccggccccgttgccgggtgtccggggccctgtggcccttcccggggaaaa

SEQ ID NO: 48058 - protein, 148 aa, Zea mays
  misc_feature: Ceres CLONE 1456440-F
MAATVMASMSPLASATPGARRAFPVRLLQASTLAPRRRALAVRAQSDDAEPKEEVASSSPSPSATPAPKSKAAATASPGLWDALAFSGPAPERINGRLAMVGFVSALAVEASRGRGPSLPRPGSGVRVPPGSGPVAGCPGPCGPSRGK

SEQ ID NO: 48059 - DNA, 723 bp, Zea mays
  misc_feature: Ceres CLONE 1456442-F
  misc_feature: Translation starting site: 217
  misc_feature (350)..(350): n is a, c, t, g, unknown, or other
  misc_feature (351)..(351): n is a, c, t, g, unknown, or other
  misc_feature (354)..(354): n is a, c, t, g, unknown, or other
  misc_feature (355)..(355): n is a, c, t, g, unknown, or other
  misc_feature (357)..(357): n is a, c, t, g, unknown, or other
  misc_feature (411)..(411): n is a, c, t, g, unknown, or other
  misc_feature (723)..(723): n is a, c, t, g, unknown, or other
ggctctttatctagtggatcccccgggctgcaggaattcgcacgagaccattacctagaacatcctaatcgaaaaatcgcccgatctcacacattttggaaggagagagagagaggcagagggagagattggagggaggcccctgcccaaggcaagagaaaccgcggcgcgcggagagggaggaagggcagacgcagacgcagacgggcgaacaagatgagggagatcatcagcatccacatcggccaggccgggatccaggtcggcaacgcctgctgggagctctactgcctcgagcacggcatcgagcacgatggcaccatgcccagtgattcctcggttggtgtcgnnaannanaccttcaacacccccacccgcgagactggttgttggttggtgtgtgtccagggncatcttcgtcgaccttgagcccactgtcatcgacgaggtttgcactggttcggaccgccgggtcttccacccagagcagctcatctccggggaaggaggatgcagctaacacctttgcccgtgggccctccacgggggtggggaaggagaaggctacccatttccttggtgcgccgtgcggcgacatctgtgaaaaaactaaccctgggcggctgtcaaccccttgggggaacaaagcccacgtgcggagggagaagtggccacgacatgtgtgtaccttggcgcgccatcgccctttcctctttagtgctn

SEQ ID NO: 48060 - DNA, 638 bp, Zea mays
  misc_feature: Ceres CLONE 1456446-F
  misc_feature: Encodes the peptide sequence at SEQ ID NO. 48061
ggagctccccgcggtggcggccgctctagaactagtggatcccccgggctgcaggaattcgcacgagaccattacctagaacatcctaatcgaaaaaagaacactaggactcatccctcctccggatcaatcatcgatcagccaagcccctacaaaaaaaccatcgccacatgttggctaatcccacgacgcactgatatttttcttccttgattgtcttgctgctatttataatcgatctccagcttacagcgacgtccaggtccaggtctgagctcgaggcacaggactccctttataatttatccatccatggcttcctccaattccaatagcagcagcaacccgctggaagccatgggcaccttcttctcgaagcaggtggaccggcggaagctggtgaccaccgagaagcgggcgctggccacgcgtctgtcctcctccggcgacacgttcccggggtcggagcaccggccggcggaccggaagcggtggatggcggagctgggcgccgacaagctgcgcgtgcaccaggtggtgtggcccggcacgcacgactcggccacaaaaagatcgggtgccctggtgaccgccccttccgaatggccatcatgtctggtacaaccactgccctggcc

SEQ ID NO: 48061 - protein, 108 aa, Zea mays
  misc_feature: Ceres CLONE 1456446-F
MASSNSNSSSNPLEAMGTFFSKQVDRRKLVTTEKRALATRLSSSGDTFPGSEHRPADRKRWMAELGADKLRVHQVVWPGTHDSATKRSGALVTAPSEWPSCLVQPLPW

SEQ ID NO: 48062 - DNA, 704 bp, Zea mays
  misc_feature: Ceres CLONE 1456447-F
  misc_feature: Encodes the peptide sequence at SEQ ID NO. 48063
aagctggagctccccgcggtggcggccgctctatactagtggatcccccgggctgcaggaattcgcacgagaccattacctagaacatcctaatcgaaaatcgcgaatctagacgcctgctcctccaccttccatcccgatcaccgccgccaccgagtttcgttccaggaggcaaaggaacgggaaaagcttccccccacgcagccccacgaaggcgtatggcggcaacgccagcaccaacgagtactggaccctagtcaacctgtgcatgctcggcgtggactacaatatcgggagatacgctctccctcgccaactgcggcctcaccgtaccaaggtactccgactcttcgaaggtaatgtacgttactgaatgcactgcaacctggagaatagccctgccacaggcaaccacgaagaaggcgtctccagagaaagatggcgaccccctcaaacaccccttcggagaggccacgtgtggggaactgggtccctgcgatccgacccaactaggagccctcttcgtccgagacccctccattggccataggccgagacaattcaccagcttcacgatgaagggcgctagcggattctacagcgggttcaccaccgagtccttgtcgcgcgcgtgggacctgccccacgtaaccgccgctgcgctcgtgtcaagctcaacggcgtaaggtaacgacaggtcctct

SEQ ID NO: 48063 - protein, 108 aa, Zea mays
  misc_feature: Ceres CLONE 1456447-F
MYVTECTATWRIALPQATTKKASPEKDGDPLKHPFGEATCGELGPCDPTQLGALFVRDPSIGHRPRQFTSFTMKGASGFYSGFTTESLSRAWDLPHVTAAALVSSSTA

SEQ ID NO: 48064 - DNA, 869 bp, Zea mays
  misc_feature: Ceres CLONE 1456452-F
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (739)..(739): n is a, c, t, g, unknown, or other
  misc_feature (775)..(775): n is a, c, t, g, unknown, or other
aaaacgtggatcccactccccacacccaacaacaaaannnnnnnnnnnnnnnnnnnnccaaactggagctccccgcggtggcggccgctctataatagtggatcccccgggctgcaggaattcgcacgagaccattacctagaacatcctaatcgaaaagatctgcggtttcttccacgcaccaatcatttcggccacactgcacacggacgaaactcgctcgtccttcgcctccagcagcagccgatccgtatccagttccccgtgccgtgcccccccaggggggaaccccgatcgatggggaaaactggtggctctccagaaggccccccctccaggggtgggggaaccgggcaaggggggggggctcccccgggggcctattttcccccccgggaaaaaaaaacccccccgtgttgggcctgtggaaaaaaacaccctcattgggaatagaaatcgcttcgtcccaaaaaggggccataaaataagggggaaataaataggggggtctttttgttgtttccattaatattacaccggccggggggtggggggccccgccccccaggggggggggagaaagaaaaacaatggaggcgccccccccttttcataaaaaaaaaaccttcctggtaaaaggaaaaatatattgcggccgcggtcccccgcgaaaaaaagaaaaccaccatccaatctttctcaccccccatgttgaggcctcagtaaaattataaaaatncccttttccccccacccaaacacaacacacctttangtaaaaatactacccgggggtggggggcgctgcgcttcccaatgtagattatcttcctccttatcgcccgggggtggaggggcatgagcaataa

SEQ ID NO: 48065 - DNA, 681 bp, Zea mays
  misc_feature: Ceres CLONE 1456453-F
  misc_feature: Pfam Name: Aminotran_3 Pfam Description: Aminotransferase class-III
aaactggagctccccgcggtggcggccgctctataactagtggatcccccgggctgcaggaattctgacgacatcttacctaaaacatcctatgtcaaaaatcgggcgtcgtttctcgcgctcttcctctcttgcctccgcctgcctccaggctccaacaacctgggtagggcaccgtccgcccccgcctccgggagcgatgatgatcgcgcgcacgcctgctccgatacaataatgcccccgcccaggcaaccatcttattgaagcatgtaactggcaccgcatgtttgcatggcaatgcggatagattgttgtatggtacaaccttacattttggatcctccccgtctacactgactaaataaaatgtcttccaaggccacgggatgctgaccccttttactgctggctgatggaacaatgatttgcacccacagatccttgacagatctgacggttcctatgtctatcacttaacgccaacaagtatcgtggactctcttgaatgattatggtagcacagctttcagtggccccaaaccacgattagtgaatgagcaactgatcaattaaacaaactacccttctaccattccttctggaatggcataacaaacacttgcatggatcttgcacaagagatccttaccttgtactcgtgcacgtatatggcgacagttt

SEQ ID NO: 48066 - DNA, 658 bp, Zea mays
  misc_feature: Ceres CLONE 1456457-F
  misc_feature: Encodes the peptide sequence at SEQ ID NO. 48067
gcggtggcggccgctctagaactagtggatcccccgggctgcaggaattcgcacgagaccattacctagaacatcctaatcgaaaaacgcgtttgtcatttgtcgcgccccacagctccccacagctcacacaggcacacagctcctcttggcggcgcctctgacttctcctttttcgtcgcccttctcctttttcgtcgccttcgatcggaggccgcctccttcctccacttccgtcccttcaccgagccgccgccgccactatgaagggacccggcctcttctccgacatcggcaagaaggccaaggatctactcagtaaggactacacttacgaccagaagctgaccatctccaccgccagcgcctctggactgggcctgacttccacagctgtgaagaaaggagggctttattctcttgatgtcagttcagtttacaagtacaagaataccactgttgatgttaaagtggacactgaatcaaatatctctactacattgacggtggtggacgcttggcatgaacaaagcctgtccacttcgggaaactgcccgcacacctttttggaaaagggggaaactccaaaaccttcccaagaaaaatgaaaccttttgcccacgggtgttgggccccaaaacccccccccccaggattg

SEQ ID NO: 48067 - protein, 114 aa, Zea mays
  misc_feature: Ceres CLONE 1456457-F
MKGPGLFSDIGKKAKDLLSKDYTYDQKLTISTASASGLGLTSTAVKKGGLYSLDVSSVYKYKNTTVDVKVDTESNISTTLTVVDAWHEQSLSTSGNCPHTFLEKGETPKPSQEK

SEQ ID NO: 48068 - DNA, 721 bp, Zea mays
  misc_feature: Ceres CLONE 1456458-F
  misc_feature: Encodes the peptide sequence at SEQ ID NO. 48069
acagctggagctccccgcggtggcggccgctctagaactagtggatcccccgggctgcaggaattcgcacgagaccattacctagaacatcctaatcgaaaagaaaggtcagatctgatccccatacttgctaggccacggctgacggctgcgccgcttccgcgtcggcggcggacagctcggagccactaggtctccgctctctgccgcattccgtggcatatcctattacaatttccccaacgccacatggccaacgccgacgctggcgacggcgacggcgacgaggtcatcctcgacgctcgcggcttcatacaagtgtacaggagcggccgcgtcgagcgctttctgccggtcgactttgccccgccctcgaatgacgccgccaccgacctccctccaaaggacgcccccctccccccagaaccctgcctattggcaaaatttggaaactgggcttaggctgtgtccctcgctttatgaccaagatgccctatggccgaagctcccccccagaatcttcctaaacttgcctcccgccacaactcgcaattttcgaaaggccctcagcgccttagttagaataagagccctcccggccctgtcccctccattacctacaaacttccgctcctcccccccttcttccaaacactcctcgtctggacctcgatttcctcccccacacccggcacatcctctcagcctcctattctcttcc

SEQ ID NO: 48069 - protein, 70 aa, Zea mays
  misc_feature: Ceres CLONE 1456458-F
MANADAGDGDGDEVILDARGFIQVYRSGRVERFLPVDFAPPSNDAATDLPPKDAPLPPEPCLLAKFGNWA

SEQ ID NO: 48070 - DNA, 620 bp, Zea mays
  misc_feature: Ceres CLONE 1456462-F
  misc_feature: Encodes the peptide sequence at SEQ ID NO. 48071
  misc_feature (281)..(281): n is a, c, t, g, unknown, or other
  misc_feature (293)..(293): n is a, c, t, g, unknown, or other
  misc_feature (320)..(320): n is a, c, t, g, unknown, or other
  misc_feature (330)..(330): n is a, c, t, g, unknown, or other
  misc_feature (331)..(331): n is a, c, t, g, unknown, or other
  misc_feature (593)..(593): n is a, c, t, g, unknown, or other
aaagctggagctccccgcggtggcggccgctctagaactagtggatcccccgggctgcaggaattcgcacgagaccattacctagaacatcctaatcgaaaaaaaacgccagttcagccacgtggagagggcagatccgagaagagccggcgcgatgagctcgccggcgaggtcgaccatctcggccgccgaagacgtcgctgattccatcgacgcgctctaccgcaaggacgaggccctggctgaactcaagtctgaggtgatggaggcgctgcagaggngaggtggaggtnctctcgacgaagacaactgggatgttncgccgcaccnngcggtcccgcatcaacctcgtctccaggcctggtgcttacctgcccaagcaaaacgggaagctctcagagttggggcaagcatccaagaaaacaaggaacttctagggtgtacatgcttgtgcttgcaagaagcctggtccatgactccatgatggtagtgaaggctgtagcatcaaggatgatttgttcatgtttcaaatcaatctgggttgcttccctgcctatttcaatttccgaacccatggataagggtatttttcngggggattggggcttccagggccggga

SEQ ID NO: 48071 - protein, 109 aa, Zea mays
  misc_feature: Ceres CLONE 1456462-F
  misc_feature (43)..(43): Xaa is any aa, unknown, or other
  misc_feature (47)..(47): Xaa is any aa, unknown, or other
  misc_feature (56)..(56): Xaa is any aa, unknown, or other
  misc_feature (59)..(59): Xaa is any aa, unknown, or other
MSSPARSTISAAEDVADSIDALYRKDEALAELKSEVMEALQRXGGGXLDEDNWDVXPHXAVPHQPRLQAWCLPAQAKREALRVGASIQENKELLGCTCLCLQEAWSMTP

SEQ ID NO: 48072 - DNA, 705 bp, Zea mays
  misc_feature: Ceres CLONE 1456467-F
  misc_feature: Encodes the peptide sequence at SEQ ID NO. 48073
tccccgcggtggcggccgctctatatctagtggatcccccgggctgcaggaattcgcacgagaccattacctagaacatcctaatcgaaaagtcgatcaatactactacacagtaggaagctaggaggaaatcaaagcaacaaagttgccggccgagagaaccaaaccatgaggcctcaggtgttactcgtcacactggctgttatcgtcgtccttgcagctctgccactcagcaaagggacggaggaggaagacggaggggcggtagtcgccgccgtggacgacgccggaacgagctcgtggccatgctgcgacaagtgcggtttctgctacctgtcttacccgccgcagtgccaatgcctggacttctcgacagtcgggtgccacccagagtgcaagcagtgcatcaggtacaccgccgacgatggcgtcgacatcccgcccgtgcacgcctaccgctgcgccgacatcctcgtcaacttctgcgagcgccgctgcactcccgccgcagctgcttcgatgtctagcgctagcaccaagtagaagaaggatgcatgcatcctcgtcgatgccattgccgggttccgcttctgagaagaagcaaataaatgttgccgctgttgatgcctgcctctccttaaataaactaatatttctcgaatatttattgtaggatcaaccattcttcttatctctcaaaaataa

SEQ ID NO: 48073 - protein, 124 aa, Zea mays
  misc_feature: Ceres CLONE 1456467-F
MRPQVLLVTLAVIVVLAALPLSKGTEEEDGGAVVAAVDDAGTSSWPCCDKCGFCYLSYPPQCQCLDFSTVGCHPECKQCIRYTADDGVDIPPVHAYRCADILVNFCERRCTPAAAASMSSASTK

SEQ ID NO: 48074 - DNA, 720 bp, Zea mays
  misc_feature: Ceres CLONE 1456468-F
  misc_feature: SWISSPROT Homolog: EC 2.7.11.1 Non-specific serine/threonine protein kinase
atagctggagctccccgcggtggcggccgctctagtactagtggatcccccgggctgcaggaattcgcacgagaccattacctagaacatcctaatcgaaaattgactgtaattcatgtgtaataataattggactctttacttgaatacggcaaatctttgatccgcatgttaatcaggttccttatgctgctttgtctgatgcctggcgaaacgaacatatcttacgtatgactctccttactataatgcccctgagctcatatttggtgggaaggagtatacaccttcaatatacatatggacagcagtttgttttctacctgacttgattcttgaaagccactatttacatcatagagcgctgttgatcagatgcaaaatatcatcatcattcttggcactccaacccgtcatgagatacagagcatgaatctcaactatactgagttcaagtttcctcagataaaggctcatccatggcacaagattttccaaaacagaatgcctcctgaaaacgtacatcattgcttctcctctccttcaataatcaccaagtcttccatgcctctgcaactaaacgcatgttctccaccccattctttgaaggaagctgcggaaacccgaacccgccggcctgacaaaaaggctcccccccgtcccttccggtacttttaaatttccaggacccaaacttaacaaaaggccttctcccggaag

SEQ ID NO: 48075 - DNA, 703 bp, Zea mays
  misc_feature: Ceres CLONE 1456471-F
  misc_feature: Encodes the peptide sequence at SEQ ID NO. 48076
tggagctccccgcggtggcggccgctctagaactagtggatcccccgggctgcaggaattcgcacgagaccattacctagaacatcctaatcgaaaaacttacctggagagaaatttgctattttgccactctcaattttggctgcctgttattataccatcccgtgtctatgactagtgggaccgtctgtgtctatgatttatgggttcgatggtatattggcgaaccccacaaatgataatggcaaaattgtcaatggcctaggccagtgactctcattgcacttggacggtaggccagtgactctcattgcacttggagggtacgctgacttaccatctccccaagggtacgctgacttaccatctccccaagtgggaaagtggacgtcataatttgtgttacaggggtcataatttgtccagtgactctcattgcacttggagggtacgctgacttaccatctccccaagtgggagagtggacgccataatttgttaccatctccccaagtgggagagtggacgtcataatttgtgttagacttaccatctctccaagtgggagagtggacgtcataatttgtgttaaaggggtcataatttgtgttagaggcccgtgcggtctctgccaaatcgaatatattaatttttttccccgggttaaaaaaagcacctttataccgaaattttacccccttac

SEQ ID NO: 48076 - protein, 58 aa, Zea mays
  misc_feature: Ceres CLONE 1456471-F
GAPRGGGRSRTSGSPGLQEFARDHYLEHPNRKTYLERNLLFCHSQFWLPVIIPSRVYD

SEQ ID NO: 48077 - DNA, 708 bp, Zea mays
  misc_feature: Ceres CLONE 1456472-F
  misc_feature: Encodes the peptide sequence at SEQ ID NO. 48078
ggagctccccgcggtggcggccgctctagaactagtggatcccccgggctgcaggaattcgcacgagaccattacctagaacatcctaatcgaaaaattttctctgcccatccacgtgaaaagcagcagcagtggtccgtaagtagatcttggattcgtctcatcaatcacactccaccaggagtaggagcttgcgggcgtggcggcggccgtgaccggcgctggagatcttggacgcgcgcgacatcctggtctccgctctgtgcctctggtctccgaaggcgccgccaccctattttttttaaaaaaaaatcctaagatagtttcttcagtccgacaccgcttctagcttcccctcggcgatctgtgaagctatgaagccacctctcgagaggaacccgactaagaagcgccactcgtggtggtgggacagtcacattagccctaagaactcgaaatggctcgcggaaaatctcgaagaaatggacaagcaagtgaaggaaatgctccagctgatcgaggaggacggcgactccttcgctaagaaagcgcaaatgtattaccagaggcgtccgatgctcgtcacccacgtcgagaacttctaccgtatgtatcgtgctctagccgagcgctacgacaatgtaaccggcgagctgcgcaagaacatccctacaaggctgcagacaaccggatcttttaccaggtcag

SEQ ID NO: 48078 - protein, 111 aa, Zea mays
  misc_feature: Ceres CLONE 1456472-F
  misc_feature (15)..(88): Pfam Name: KIP1 Pfam Description: KIP1-like protein
MKPPLERNPTKKRHSWWWDSHISPKNSKWLAENLEEMDKQVKEMLQLIEEDGDSFAKKAQMYYQRRPMLVTHVENFYRMYRALAERYDNVTGELRKNIPTRLQTTGSFTRS

SEQ ID NO: 48079 - DNA, 682 bp, Zea mays
  misc_feature: Ceres CLONE 1456476-F
  misc_feature: Translation starting site: 178
  misc_feature (486)..(486): n is a, c, t, g, unknown, or other
  misc_feature (491)..(491): n is a, c, t, g, unknown, or other
  misc_feature (513)..(513): n is a, c, t, g, unknown, or other
  misc_feature (607)..(607): n is a, c, t, g, unknown, or other
acccgcggtggcggccgctctagaactagtggatcccccgggctgcaggaattcgcacgagaccattacctagaacatcctaatcgaaaagagccgcgagtggaactgtggaagcgtcgagcttttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctctcccggaaacatccaagcaggtactgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgatattttgggcacacttgtggactgattcagatcgncggcnagcggggtggtgagatgcgtangatttgaagctgggaacaaactccagaaagactgtgccctgtcgtgatgtcataaatttgtggtgaacatcatatcatgaggaataaacttgtngcttttttgggatgcattggaaaaactttcgatttggactgtttccacattttttgttaaaaaaaaaaaaaaact

SEQ ID NO: 48080 - DNA, 691 bp, Zea mays
  misc_feature: Ceres CLONE 1456477-F
  misc_feature (89)..(89): n is a, c, t, g, unknown, or other
  misc_feature (409)..(409): n is a, c, t, g, unknown, or other
  misc_feature (638)..(638): n is a, c, t, g, unknown, or other
tggagctccccgcggtggcggccgctctagaactagtggatcccccgggctgcaggaattcgcacgagaccattacctagaacatcctnaatcgaaaaacgagacaaagggcctcacgctttccacatcgacacaaaaccaaccgccgccacctccatccgctcgcgctagctgtgtgcgtgccttgtctgccacaactccagcacttggagtcttcgaccacgacgacgacggcaggggaggagaaacaggcaggcgggtcatccatggagacggaggaagagacgacgcccaaggcgaagagcggccgcagtcgctgctcgggagcctgcgggaagcgatcacaaaggtcgggttcttgctctcctcagcgcgaaccggtggaagctgctcaagtccctggcccccngccgcttgtggggggggggccccggggcgggccccttaattttaaacggggggcggggctggttaaaaacaattgccgggggccgctggggaggagatccccccccccgccaccccggggggaaacaccccctctcgtccggcgcgcgcttttggggcgcgaaacaacacccttcccggggtggggggtaaaacatgttgcccaacaaacaccccactccttttttttnttaaaaacccttggggggggaaaaaaaaacccccccttcccccagaaaaaaca

SEQ ID NO: 48081 - DNA, 745 bp, Zea mays
  misc_feature: Ceres CLONE 1456486-F
  misc_feature: Encodes the peptide sequence at SEQ ID NO. 48082
  misc_feature (428)..(428): n is a, c, t, g, unknown, or other
  misc_feature (745)..(745): n is a, c, t, g, unknown, or other
aacgattgggtaccgggccccccctcgagccactgcagtggtaaaggctcactagccgtcggttcacttctccaggtaaggaaagggttcgtactcatggcgccgccgcagccaaagtcgggcctcttcgttggcatcaacaagggtcatgtcgtcaccaagcgcgagctgcctccccgcccgtgccaccgtaaggggaaatcaacgaagagggtgtctatggtcaggggcctgatcagagaggttgctgggtttgctccttatgagaagcgtatcactagacttcttaaggttgccaaggacaagcgtgccctgaaacttgctaagagaaagcttgcaactcacaagagggcaaagaaaaatatataggacatcccccacatcctcaggaaatatgacgtctgttggtaaacaaactggttcaacancccccaaacagaatttcaaggttcatggacacgggctcgcaaaacaattaatgttcccgagatcaaaattttcccgaccatgcaaaccccaagaaacatcttgcgccaaataaatccctaatccgaacccgaccttacagacaaatattcgctccataccacatggactccagagtctaataccccaacgctaccacggtttaaccggaccaaactggatcctcaaatccttaccgccccactcaagggtgttttctgccactaacacaccatggcctccataaaccactcaatccctctaacaaccctcctctccn

SEQ ID NO: 48082 - protein, 90 aa, Zea mays
  misc_feature: Ceres CLONE 1456486-F
  misc_feature (5)..(89): Pfam Name: Ribosomal_L36e Pfam Description: Ribosomal protein L36e
MAPPQPKSGLFVGINKGHVVTKRELPPRPCHRKGKSTKRVSMVRGLIREVAGFAPYEKRITRLLKVAKDKRALKLAKRKLATHKRAKKNI

SEQ ID NO: 48083 - DNA, 683 bp, Zea mays
  misc_feature: Ceres CLONE 1456490-F
  misc_feature: Encodes the peptide sequence at SEQ ID NO. 48084
tcgagccactgagtggtaaaggagcgaggtgattgcaatggtggcctccactgcttcccgcctctcgcccccgcgcttcagcaccccttccccgtctcttcatcctacaaaccgccgctcgcgcttctcccctgttcgcgcagccaagttggaagctgtgctgtctattggtgctcatctaatcccacacccaaaaaaggctgcaagtggtggagaagatgctttctttgccaatagtgatgctggcggagtatttgccattgtatacgccgtctcgggatgggaagaacacaatgttatctcagctctattctctcgaaagctcaacaaaaaacagcttttacccccccaccgaagaggggggggggaaaagaattttaatatccccactccccacgctttttggttcaaacatccctaataaaggaaaattattgccaaggcggccactctgcgaagaaagagattcggaacttttatcaactagcattcaacgcaaaaatgggaggatcaacaaactttttattaatatggccctataatgttcttttataaccccatcttcaaacattaatttcgacagcccaccgccccacaagatcaccccaaaagttaattgcccccagaatatcatactatccctcagagaattcacaataacaaaccaccccacaaaatgaccg

SEQ ID NO: 48084 - protein, 127 aa, Zea mays
  misc_feature: Ceres CLONE 1456490-F
MVASTASRLSPPRFSTPSPSLHPTNRRSRFSPVRAAKLEAVLSIGAHLIPHPKKAASGGEDAFFANSDAGGVFAIVYAVSGWEEHNVISALFSRKLNKKQLLPPHRRGGGEKNFNIPTPHAFWFKHP

SEQ ID NO: 48085 - DNA, 670 bp, Zea mays
  misc_feature: Ceres CLONE 1456492-F
  misc_feature: Encodes the peptide sequence at SEQ ID NO. 48086
cgattgggtaccgggccccccctcgagccactgcagtggtaaaggagtcgacgcgacgctcgacggcacggcagcagagaaagccaacagcatggctccaccaccatggccggtcgtagcgctgctgctctgcgccgcgctagcgttcgcggcgcggccgagctcggccgtggacccggtgggcacgtactgcgccaagaacttcacgggcgcgcagacgcaggcgagcatcgcccaggtcctggccgcgctggtcccgcgcgcctccgcggcctactacgccacggcgactgccgccggcggcggcggctcggccaccatctggtgcctggcgcagtgccgcggcgacgtcccggcgtccgactgcgcactctgcatggcggcggctgcgcggcaggcggcggcgtcgtgccagggccaggaggacgcgcgggtctggtacgactactgcttcctccgctacgacgacgccgacttcctgggcctagcggacaccgggtacgcgctcatcctcatcaacaccatgaacgccaccgacccggccgcgttcgaccgcgccgagcgcatgatcatggcacgcgtcgctgccgacgccgccagagccgggctggccagagagacggtcaggttcggctacgacgggaccaccgtctacggcctcggctggagg

SEQ ID NO: 48086 - protein, 193 aa, Zea mays
  misc_feature: Ceres CLONE 1456492-F
  misc_feature (77)..(131): Pfam Name: DUF26 Pfam Description: Domain of unknown function DUF26
MAPPPWPVVALLLCAALAFAARPSSAVDPVGTYCAKNFTGAQTQASIAQVLAALVPRASAAYYATATAAGGGGSATIWCLAQCRGDVPASDCALCMAAAARQAAASCQGQEDARVWYDYCFLRYDDADFLGLADTGYALILINTMNATDPAAFDRAERMIMARVAADAARAGLARETVRFGYDGTTVYGLGWR

SEQ ID NO: 48087 - DNA, 669 bp, Zea mays
  misc_feature: Ceres CLONE 1456520-F
cgattgggtacgggccccccctcgagccactgcagtggtaaagggagttcggagctttagagagtgcacggggatcctgcgccaaggctagagaaaatacaacccgccttctgctcctagttgcaggccaaggtcaggctccgctctcctctccgcgggatcttcgccgccggtgatcttcctcggtgacaatgggggaggccatgtctgctcatggactctgcgtggcagcgtgctgatccccaacttccgcgagatgcagttcgccatcggcgcccagcttcatgctccacgtacaacgcctagttcctctccggcctcccctcccacatcttctagggctacgaatgctacgaccagtacaggattgagaagattaccaaacctctgcttaccaaaacagatgtgacatgggcatcaatgtctataatgtatagtgtaaatctgcctgtgagcatattgcgtatgcggccatctgaccaggggtgtcaggagatactcatctgatccagatctggatggtgatgattatcaagctcttttctacgacgtgcttgaagattatagcttcaattgtgagcagccggcattgctcacaaagtggctatatacacaggtgcacggcgtgatcatgagtacgctgcactgtttgatctgacgaggtaatct

SEQ ID NO: 48088 - DNA, 675 bp, Zea mays
  misc_feature: Ceres CLONE 1456528-F
  misc_feature: Translation starting site: 194
cgattgggtccgggccccccctcgagccctgcagtggtaaagggctggaccggtcactcggcacgcaggctagtagcacagcagcagccagagccatcccctctcctcgctacgcttcgcttcctcggcgccgattcctcctcctcctcctccaccctcgtccgtccccttccggcgcgcgagctcgcccgagatggcgtacgcgagatcgggtgtcgctgtgaacgatgagtgcatgctgaagtttggtgagctgcagtcgaagaggctgcaccgcttcatatctttcaagatggacgacaagttcaaggagatagttgtggaccagggtcggggatcgcgctacccgctacgatgacttcacaaacagcctccctgagagtgactgccgatacgcgatctatgatttcgactttgtcactgcagaggatgtccagaagagcatgatcttctatatcctatggtccccatcctccgccatggtgaagagcaagatgctttatgcaagctcacaccagatattcaagagtggcctcaatggcattcacgttgaactccaggccacagatgcgagtggaatcagcctcgatgagatcaaggatcgggctcgctaggcgcaccgccatcgcgagtttcatgggcccgcatcatggactcgcctactactgtggattg

SEQ ID NO: 48089 - DNA, 665 bp, Zea mays
  misc_feature: Ceres CLONE 1456529-F
  misc_feature: Encodes the peptide sequence at SEQ ID NO. 48090
  misc_feature (1)..(1): n is a, c, t, g, unknown, or other
  misc_feature (649)..(649): n is a, c, t, g, unknown, or other
  misc_feature (665)..(665): n is a, c, t, g, unknown, or other
ncgattgggtaccgggccccccctcgagccactgcagtggtaaaggctcctttcggaggaggcggaccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacacaagccatatgtgcgctccaagggaaggaagtcgagaaggctcgtggcaagangaaacagcgtgggtcn

SEQ ID NO: 48090 - protein, 184 aa, Zea mays
  misc_feature: Ceres CLONE 1456529-F
  misc_feature (12)..(183): Pfam Name: Ribosomal_L18e Pfam Description: Eukaryotic ribosomal protein L18
  misc_feature (179)..(179): Xaa is any aa, unknown, or other
MGIDLVAGGRNKKTKRTAPKSDDVYLKLLVKLYRFLVRRTKSNFNAVILKRLFMSKTNRPPISMRRLVKFMEGKEKNIAVIVGTVTDDKRIQEVPAMKVTALRFTETARARIVNAGGECLTFDQLALRAPLGENTVLLRGPKNAREAVRHFGKAPGVPHSHTSHMCAPREGSREGSWQXETAWV

SEQ ID NO: 48091 - DNA, 1128 bp, Zea mays
  misc_feature: Ceres CLONE 1456530
  misc_feature: Encodes the peptide sequence at SEQ ID NO. 48092
gcacaggaaagagcaagatgaagacaacgacgacggcgatgcgctccttgtccgtcgccgtcctcctcctcgtcgccgccgccgcttcagcatccgccgccaaggatcgctgccactcgggcgacaaggcggcgctgctggccatcaaggcggcgctcggcaacccgtaccacttcgcgtcgtggacgcccgacaacccctgctgcgactggtacgacgtggactgcgacgccaccactggccgcgtcgtcggcctcgccgtgttccaggacgccaacctgacgggcaccatccccgacgccgtctcgggcctcgtccacctccagaacctcatgctgcaccacctcccgggcatctccgggcccatcccgccggccatcggcaggctctctaacctctccttcctcaccatctcctggacgggcgtctccggccccgtgccgtcgttcctgggcgcgctcaccaggctcaaccagctggacctctccttcaacgccctcaccggcgccgtcccggcctcgctcgccgcgctccccagcctttacagcatcgacatcagccgcaaccgcctcacgggctccctgccgccgctgctcttcagcaggctcgataaggcgcagcaggaggcgtacctccggctgtcgcacaacaacctcaccggcagcgttccgcctgagttctctgcggtggccttcgcgcaggtcgacctgtcccgcaacgccttcgccggcgacgcgtcgggcctgttcggcagggcgaagccggtgcagcagatggacctctcgcgcaacgccttcagcttcaacctgtccgccgtggagctgccggagcagctcaactcgctggaccttagccacaacgccatctacggcggcatccccgggcaggtggtgaacctgaccaacctgcagttgttcaaagttagctacaaccggctgtggggggcggtgccccccgggggcaacatggggagctttgatgcctacagcttccagcacaacaggtgcttgtgtggacctccgcttgctgatccctgcaaatgaagtgacagtcgtgtaacttttgtaatcaaactattgttttaataaaggaataaaatcgtttattgccaaaaaaaaaaaaaaaaaa

SEQ ID NO: 48092 - protein, 341 aa, Zea mays
  misc_feature: Ceres CLONE 1456530
  misc_feature (33)..(71): Pfam Name: LRRNT_2 Pfam Description: Leucine rich repeat N-terminal domain
  misc_feature: SWISSPROT Homolog: EC 2.7.11.1 Non-specific serine/threonine protein kinase
MKTTTTAMRSLSVAVLLLVAAAASASAAKDRCHSGDKAALLAIKAALGNPYHFASWTPDNPCCDWYDVDCDATTGRVVGLAVFQDANLTGTIPDAVSGLVHLQNLMLHHLPGISGPIPPAIGRLSNLSFLTISWTGVSGPVPSFLGALTRLNQLDLSFNALTGAVPASLAALPSLYSIDISRNRLTGSLPPLLFSRLDKAQQEAYLRLSHNNLTGSVPPEFSAVAFAQVDLSRNAFAGDASGLFGRAKPVQQMDLSRNAFSFNLSAVELPEQLNSLDLSHNAIYGGIPGQVVNLTNLQLFKVSYNRLWGAVPPGGNMGSFDAYSFQHNRCLCGPPLADPCK

SEQ ID NO: 48093 - DNA, 708 bp, Zea mays
  misc_feature: Ceres CLONE 1456531-F
  misc_feature: Encodes the peptide sequence at SEQ ID NO. 48094
aagctggagctccccgcggtggcggccgctctagaactagtggatcccccgggctgcaggaattcgcacgagaccattacctagaacatcctaatcgaaaaacaaacacgtgacacctccgcccaccctcgccccctccctaccggcaccgcccagatggcctgctcccacatcgtcgccgccgcgggggtctcctcccccgccgcagcggcggctcgttccccggcgcattctcccgctgccgccttcgcgcgcctccggtcgacgcctcgtttcgcgagcgctggcttgtcggttaagggaaacggagcggcgttcccgttggtcgccgccgcggggccggccgcggcggcaccggtggccgacctggacggccgcccggccacggagaagcagcccatcatcgtcatcgacaactacgacagcttcacatacaacctctgccagtatatgggggagcttggattgaacttcgaagtataccgcaatgatgaactgaccatagaagatgtgagaaggaagaacccaaggggaatacttatttctccaggaccctggtgaacccacagaatcgggaatatcattgccgactgttcttgaattaggccccacccatccccaattttttggaaattggcttggggcccccaatggcttggaaaaggctttggaaggaaaaatatccccggccccttcgggagggaggca

SEQ ID NO: 48094 - protein, 134 aa, Zea mays
  misc_feature: Ceres CLONE 1456531-F
  misc_feature: SWISSPROT Homolog: EC 4.1.3.27 Anthranilate synthase
MACSHIVAAAGVSSPAAAAARSPAHSPAAAFARLRSTPRFASAGLSVKGNGAAFPLVAAAGPAAAAPVADLDGRPATEKQPIIVIDNYDSFTYNLCQYMGELGLNFEVYRNDELTIEDVRRKNPRGILISPGPW

SEQ ID NO: 48095 - DNA, 802 bp, Zea mays
  misc_feature: Ceres CLONE 1456534-F
  misc_feature: Encodes the peptide sequence at SEQ ID NO. 48096
  misc_feature (35)..(35): n is a, c, t, g, unknown, or other
  misc_feature (38)..(38): n is a, c, t, g, unknown, or other
  misc_feature (426)..(426): n is a, c, t, g, unknown, or other
  misc_feature (685)..(685): n is a, c, t, g, unknown, or other
  misc_feature (799)..(799): n is a, c, t, g, unknown, or other
atttttcccttgcgccaccggcacgctaattatanttntttcttttctttccatacttggactccccgcggtggcggccgctctattctagtggatcccccgggctgcaggaattttcacgagaccattacctagaacatcctaatcgaaaaggttctttaattgcccgccaatctgttctatatatacggacagagcactcttgttttgtggcacattctcttactagctgccaaagggcgtgtttgacactagcggaccgaccttgaccttgaagttcaaaagggcggcctgcgcggcgatggatgtcaagtgcccgcatctgaaggggaaggtggccatcgtgaccctctcccctatggggatcggcctctccatcgccaagcgcctcggtctggagagcgccgtcttcatttttttctccancaaacagaataacgttgaactagcccgtgggagggcgcctcaccgccccaaagtgtatcacccactggttgtgtgtttgtcttgcccctgtcctccccaccctaccaggatccccagtagttcttcagcccaaaaccggctcccttcataaagcttcttgtaaagccctaatccaatattttttctatgccccttcccacagaattccggccattcaactacatcctctgcttccgaaaacagacacttgccatcctcntccaaagactaaccaaaaaacactgcgccctttcctgtccatccctttagtaattattaactcgtccgccatcatcttaataaacaaaaatccctccattcccgtctttttccnttg

SEQ ID NO: 48096 - protein, 91 aa, Zea mays
  misc_feature: Ceres CLONE 1456534-F
  misc_feature: SWISSPROT Homolog: EC 1.1.1.184 Carbonyl reductase (NADPH)
  misc_feature (42)..(42): Xaa is any aa, unknown, or other
MDVKCPHLKGKVAIVTLSPMGIGLSIAKRLGLESAVFIFFSXKQNNVELARGRAPHRPKVYHPLVVCLSCPCPPHPTRIPSSSSAQNRLPS

SEQ ID NO: 48097 - DNA, 760 bp, Zea mays
  misc_feature: Ceres CLONE 1456537-F
  misc_feature: Encodes the peptide sequence at SEQ ID NO. 48098
ggagctccccgcggtggcggccgctctagaactagtggatcccccgggcttcaggaattcgcacgagaccattacctagaacatcctaatcgaaaaaactaggcagcgtggaaaggctacggagagcggagaggcgctccattgaagcggacggcaacgagctctgcatgctgcgctgcgcccttctcaccgccgccagcccgccagaaggtctcctcccgtctctagagtggctctttctctctccgtcaaatggctctcgcgtgcgcctctcacgcgtgccgctttctcctcgccggccaggcgagatctttccacgcccagccctaccatggtacgccctccccgacctccatcacaaatcccgtgctgcttctgcttgctttttgtgactggagtcggatccctccttccggggtgcagccaaggtcggcgtggtggagttcctgaacggcgtcgggaaaggggtggaggcgcacgccgcgaagctggaggaggctgtgggcggcgacctccagaggctccttgagtcccgcacgctgcggctcaagaagctcggcatcccctgcaagcatagaaaattgattttgagttttgcacacaagtaccgtcttggtctctggaagcccaagcagaacccaggaaagttgaataaagttgggtccgtcttgaaagatagtctactgttggactgaggcatgtttgggacattgaatatttgctttgtaatttagaacctcaaacctttgtctctgtctca

SEQ ID NO: 48098 - protein, 65 aa, Zea mays
  misc_feature: Ceres CLONE 1456537-F
MALACASHACRFLLAGQARSFHAQPYHGTPSPTSITNPVLLLLAFCDWSRIPPSGVQPRSAWWSS

SEQ ID NO: 48099 - DNA, 781 bp, Zea mays
  misc_feature: Ceres CLONE 1456547-F
  misc_feature: Encodes the peptide sequence at SEQ ID NO. 48100
tggagctccccgcggtggcggccgctctagaactagtggatcccccgggctgcaggaattcgcacgagaccattacctagaacatcctaatcgaaaaatccgcttctgtcagttccttttctaaaagaaaaaaatacagtcgcatctcgcctccagcagggtgagttcgcctcggcagggtgtggcataccatggagagctcgtcgccgtcagtgccgttcccgctgctgcaggcgccggtcgagagcacctaccgcgcctgcaccatcccctaccgtttcccctccgacaacccgcgcaaggccacccctgtcgagatccaatggattgacctctttctcaactctgtcccgtccttcaaacagcgggttaaaaacgaccccaccgtacccgatgcgcccgcgaaagcggagaagttcgcgcagaggtacacgtcaatgcttgaagagttgaagaagaatccggagagccatggaggaccaccagattgcatacttctttgtaggcttcgtgagctagtactcagagagctgggatttagggatatcttcaagaaggtcaaggatgaagagaatgccaaggctatgtcacttttttgggggagttattaagccgaaatgaccaaaattgaagatgacgggcaaaaagatttgaagaacttggtcccgtggaaattttaacctggaaaacattttttgatcctaggatcctgcacaagcttgccagaaggtttttgcgcaaaaaatggaatggccattttttggcaaaggtgcgccaaaat

SEQ ID NO: 48100 - protein, 139 aa, Zea mays
  misc_feature: Ceres CLONE 1456547-F
  misc_feature: SWISSPROT Homolog: EC 2.7.1.33 Pantothenate kinase
MESSSPSVPFPLLQAPVESTYRACTIPYRFPSDNPRKATPVEIQWIDLFLNSVPSFKQRVKNDPTVPDAPAKAEKFAQRYTSMLEELKKNPESHGGPPDCILLCRLRELVLRELGFRDIFKKVKDEENAKAMSLFWGSY

SEQ ID NO: 48101 - DNA, 832 bp, Zea mays
  misc_feature: Ceres CLONE 1456550-F
  misc_feature: Encodes the peptide sequence at SEQ ID NO. 48102
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (38)..(38): n is a, c, t, g, unknown, or other
  misc_feature (39)..(39): n is a, c, t, g, unknown, or other
  misc_feature (422)..(422): n is a, c, t, g, unknown, or other
  misc_feature (423)..(423): n is a, c, t, g, unknown, or other
  misc_feature (456)..(456): n is a, c, t, g, unknown, or other
  misc_feature (480)..(480): n is a, c, t, g, unknown, or other
  misc_feature (832)..(832): n is a, c, t, g, unknown, or other
aacagtgcacaacaacacaaacacaaannnnaaaaaannaaaaaaaaaactggaactccccgcggtggcggccgctctataactagtggatcccccgggctgcaggaattcgcacgagaccattacctagaacatcctaatcaaaaaatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccagcggcggccgcgcgcgcccacgacaaccaaggcagcggggccggcatacggcagccgagcggcgagtaccgcgggaggaaggtgggggccaggacggatgtgtttttannaaagggcgacggccaggtgaggagcttgaccgncctgtatcaccaaacacaaccggnagctccgaaaaagaggcggcggcggcagccggctcaactactgcagggtgctggcggctcatctgcaggaggagcccgggctcaagaacaaacctccgcttcacggccatgaaagaggagcggccggggtaaaggcggcaaagcgcgtgttctaagccttctgtctcctttaaaccctagaatcgacttgtgccacccggtttaagattccagccggagggacggccagataaacagcgggctctttactccgggagggagaaccacccgaggtgaagtatatgataggcatagtccctttcttctgaaaaccaagcgaactgctcgaatataagacctttgtcgttgggtn

SEQ ID NO: 48102 - protein, 112 aa, Zea mays
  misc_feature: Ceres CLONE 1456550-F
  misc_feature (57)..(57): Xaa is any aa, unknown, or other
  misc_feature (68)..(68): Xaa is any aa, unknown, or other
  misc_feature (76)..(76): Xaa is any aa, unknown, or other
MARALGACVLLAVLLGALAPAAAARAHDNQGSGAGIRQPSGEYRGRKVGARTDVFLXKGDGQVRSLTXLYHQTQPXAPKKRRRRQPAQLLQGAGGSSAGGARAQEQTSASRP

SEQ ID NO: 48103 - DNA, 802 bp, Zea mays
  misc_feature: Ceres CLONE 1456551-F
  misc_feature: Encodes the peptide sequence at SEQ ID NO. 48104
  misc_feature (385)..(385): n is a, c, t, g, unknown, or other
  misc_feature (742)..(742): n is a, c, t, g, unknown, or other
gggctgcaggaattcgcacgagaccattacctagaacatcctaatcgaaaaaaactcacaattcatatcgaggtctcagcttcaggaaagggaaggaagcatgttcgggcaccaccaccaccacggccacggcgggcaccaccaggccccgccgccgcacgagcagacgctgttcaggatcttctgccgcgccgacgaggcgtactgcctcaccgtgcgccacgacgccgtcgtcctcgcgcccaccaacccccgcgacgagtaccagcactggtacaaggacatgaggcacagcaccaaggtgaaggacgtgtaggacccaacaatttttctcactcacccatagtggtttgttgtgtttccccacccaaccacaacgatcggnccatgtcctattcccgttgaaggctggggacccatcacaccccgaaactaccacgtcaccagttccctagcctggcgctcctgtatacccaacttatcttgggcgcatggggccctccctcctcccactccctgtttgtggttaggtccaagtccctctctctaactttttgcatcacattctcactgggctttctatggatctcacgggtgtgggtgacacgaacggtcccccctcttggtgattttctcagtcattgcgtggttatgctccctcattctcgacacctgataatgtgctatcccctcgcctggttataaactcccaaatcacgacaagctcccgagcgtctctctncttccgtgctgacatatgtgggaactagtgcttaggggcggttaccctttctcccggttg

SEQ ID NO: 48104 - protein, 71 aa, Zea mays
  misc_feature: Ceres CLONE 1456551-F
MFGHHHHHGHGGHHQAPPPHEQTLFRIFCRADEAYCLTVRHDAVVLAPTNPRDEYQHWYKDMRHSTKVKDV

SEQ ID NO: 48105 - DNA, 762 bp, Zea mays
  misc_feature: Ceres CLONE 1456555-F
  misc_feature: Encodes the peptide sequence at SEQ ID NO. 48106
ctggagctccccgcggtggcggccgctctagaactagtggatcccccgggctgcaggaattcgcacgagaccatacctagaacatcctaatcgaaaaacggaaccccaccaggcagaggcagtaagccaccagctgcagccgccagcacagcgcagggcagagggagagggagggcacaccatggccgtggggggccttctgcggggcctcgtttcgccccccgcctggctgccctgccatgagctcttcgcctcctggcaccactggcttccctccctcccgcgcctccgcccgcccgcatccgacggcttcaagcttctcttggtgctgctgctcttctccgccgctctagccgaggtccgctacatcgcctcctcctccatggcgcccacgcttcgtccaggcgaccgaccccccgccgataaggttacatacttgttccggaggccatctattggggatatagtgtttttcaaagtaccgactgctgtgcagaattatggtgtcaataaggatgttgtctttattaagagagtattggcaacaccaggagacttcattgaggtccgacaagggcagcttattgtaaatggtgtcgcactaaaggagcattacgcagcagcaacgtcattgtacacaatggaagcaatggtccagagatctttaaaggtcacaagaaagaagatgatcaaaaactggactggctgctccatgttgttgacttcttgagtgccccgttgtaatcaatcgatcaatgggcc

SEQ ID NO: 48106 - protein, 182 aa, Zea mays
  misc_feature: Ceres CLONE 1456555-F
  misc_feature (62)..(139): Pfam Name: Peptidase_S24 Pfam Description: Peptidase S24-like
  misc_feature: SWISSPROT Homolog: EC 3.4.21.89 Signal peptidase I
MAVGGLLRGLVSPPAWLPCHELFASWHHWLPSLPRLRPPASDGFKLLLVLLLFSAALAEVRYIASSSMAPTLRPGDRPPADKVTYLFRRPSIGDIVFFKVPTAVQNYGVNKDVVFIKRVLATPGDFIEVRQGQLIVNGVALKEHYAAATSLYTMEAMVQRSLKVTRKKMIKNWTGCSMLLTS

SEQ ID NO: 48107 - DNA, 759 bp, Zea mays
  misc_feature: Ceres CLONE 1456558-F
  misc_feature: Encodes the peptide sequence at SEQ ID NO. 48108
ctggagctccccgcggtggcggccgctctagaactagtggatcccccgggctgcaggaattcgcacgagaccattacctagaacatcctaatcgaaaatttgaaaacatgctagatacaggccacaatgctaatcctgttgtttatacatccttgataaggaatttcttcatgcatgggaggaaggaagatggacacaaaatcttcaaagagatgaatcgtcgaggatgccagcctgatcttactctactgaatacatacatggattgtgttttcaaagctggtgacgttgaaaagggaagggcaatatttgaggatatcaaaggttatggtttccttccggatgtacgaagttattccattttgattcatggtctcacaaaagctggccaagctagggaaacttccagcattttccatgccatgaagcagcgaggttttgctcttgatgctcgggcttataatgctgttgttgatgggttctgcaaatctggaaaggtggacaaggcctatgaagctcttgaagagatgaaggtgaaacatgtacctcctacggttgctacatatggatcaattattgatggtttagctaagattgataggttagatgaagcttacatgctttttgaggaagcaaaatcaaaaggaatagaattgaatgttattgtgtatagctctctcatcgatgggtttggaaaggttggtaggatagatgaagcttatcgataccgtcgacctcgagggggggcccggtacccaa

SEQ ID NO: 48108 - protein, 252 aa, Zea mays
  misc_feature: Ceres CLONE 1456558-F
  misc_feature (151)..(185): Pfam Name: PPR Pfam Description: PPR repeat
  misc_feature (186)..(220): Pfam Name: PPR Pfam Description: PPR repeat
  misc_feature (46)..(80): Pfam Name: PPR Pfam Description: PPR repeat
  misc_feature (116)..(150): Pfam Name: PPR Pfam Description: PPR repeat
GAPRGGGRSRTSGSPGLQEFARDHYLEHPNRKFENMLDTGHNANPVVYTSLIRNFFMHGRKEDGHKIFKEMNRRGCQPDLTLLNTYMDCVFKAGDVEKGRAIFEDIKGYGFLPDVRSYSILIHGLTKAGQARETSSIFHAMKQRGFALDARAYNAVVDGFCKSGKVDKAYEALEEMKVKHVPPTVATYGSIIDGLAKIDRLDEAYMLFEEAKSKGIELNVIVYSSLIDGFGKVGRIDEAYRYRRPRGGARYP

SEQ ID NO: 48109 - DNA, 765 bp, Zea mays
  misc_feature: Ceres CLONE 1456562-F
  misc_feature: Encodes the peptide sequence at SEQ ID NO. 48110
ctggagctccccgcggtggcggccgctctagaactagtggatcccccgggctgcaggaattcgcacgagaccattacctagaacatcctaatcgaaaaccaagaagaaaggagcatagaacataagaggagagaccgcactacacacctcacgcctgaagttcagatctaagccttctcgtcctcgcccaaggacaacgataaacatctaagaaccaaacaaaaacagagcacgaccatcggtctctaagcaaaacgcgcagcacgccgggcgctccacgcacgtaggctagcagagcgcgcatggggcttctggaccagctgtgggacgacacggtggccgggccgcgcccggactccggcctcggcaagctccgcaagcacgcgtccttctccccctcgtcggccgcgccgtcgccgaccgcggagggcgcggcgccgcccgccgtgacgcggagcatcaccatgctgcggccggcggcgctgtccgtcgccacgtcgccgcgcagcgagtccagctccgcgccgtcgtcgccgtcgcccgcaagcggcgctccggactcgcccttcggcgcagcgacgacgcccaggggagagggctggaagaagctgcgccggaaaggcaggatggccgacggcgccgacgcccccggcacgccgaggagccccactgtgtacgactggggtggtgatcagttcgctggaccgctgaagcagccggccgggccaagacgaggacacagcacagggatggaggaagccagcc

SEQ ID NO: 48110 - protein, 154 aa, Zea mays
  misc_feature: Ceres CLONE 1456562-F
  misc_feature (7)..(140): Pfam Name: Auxin_repressed Pfam Description: Dormancy/auxin associated protein
MGLLDQLWDDTVAGPRPDSGLGKLRKHASFSPSSAAPSPTAEGAAPPAVTRSITMLRPAALSVATSPRSESSSAPSSPSPASGAPDSPFGAATTPRGEGWKKLRRKGRMADGADAPGTPRSPTVYDWGGDQFAGPLKQPAGPRRGHSTGMEEAS

SEQ ID NO: 48111 - DNA, 696 bp, Zea mays
  misc_feature: Ceres CLONE 1456565-F
  misc_feature: SWISSPROT Homolog: EC 3.6.3.14 H(+)-transporting two-sector ATPase
ggagctccccgcggtggcggccgctctataactagtggatcccccgggctgcaggaattcgcacgagaccattacctagaacatcctaatcgaaaaagttctggactgcctcctgtctcttccctttggttagacggcgcggacgcgacgtggcctaccgtaaagggtgcaaggctcctccacgctgacagggactcacatggagagctactccggacaccaacatgtgggcggcgttcccggcttatgacacctcccgtttattcgagtttatacggcgcgggcgctcctctctctttttcatgcatggcctcaaggtatcggaccgggaagattcggcccggcacggtttcgatgggagtgaagcagccggagctcgtcatgaagtccatcgcgctccgtgggcagccaagtgatggtccatatgtgggggatcatcatggtagcagtcatcaggacataaatccccccacgaggcccaggaactctgccattgtataggggtacatttccatgttttgacggcccttggcatgggggccttggtgggtgttggctcttggatgtccatctccaaataggtcgaaggaaggttcttgcctggaaccaatggaaaaaaaccaaaaaccttgttgggaggaaggaaaaaaaggccctccttttggggaagaaaaccctttgttttggtcaggaagg

SEQ ID NO: 48112 - DNA, 737 bp, Zea mays
  misc_feature: Ceres CLONE 1456569-F
  misc_feature: Encodes the peptide sequence at SEQ ID NO. 48113
  misc_feature (241)..(241): n is a, c, t, g, unknown, or other
  misc_feature (389)..(389): n is a, c, t, g, unknown, or other
  misc_feature (393)..(393): n is a, c, t, g, unknown, or other
  misc_feature (398)..(398): n is a, c, t, g, unknown, or other
  misc_feature (566)..(566): n is a, c, t, g, unknown, or other
  misc_feature (685)..(685): n is a, c, t, g, unknown, or other
gctctagaactagtggatcccccgggctgcaggaattcgcacgagaccattacctagaacatcctaatcgaaaatcacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctancacgcgatggcgaggtcttccaagatgatggtggcggcagctctgctggccttggccctggccgtgtcgaccgccgaggcgaggaacatcaagaccacgacgatggagaagaaggacgacgcggtggtgcagccgcagacctgttgtncctncaccncctcggcggcggcgcgtccccggcgttcggcggcctccccggcggcagcattcctggcagcagcattcccgggttcagcatgcccggcagcggcagcagcctacccgggttcagcttgcccggcagcggcagcatgcccctcttcggcggcggctccccgggcttcancggcttcggcggcatgcccgggttgcccaacgcggctccgtccccgagcaccccaacaagcccttgaacgccaacaagcctggaagaaaagtggggccactgttactggaaaacgtccncccccttcttccatgctgggttcggggtttcccctagctccatacagagcgg

SEQ ID NO: 48113 - protein, 51 aa, Zea mays
  misc_feature: Ceres CLONE 1456569-F
  misc_feature (30)..(30): Xaa is any aa, unknown, or other
MPGSGSSLPGFSLPGSGSMPLFGGGSPGFXGFGGMPGLPNAAPSPSTPTSP

SEQ ID NO: 48114 - DNA, 730 bp, Zea mays
  misc_feature: Ceres CLONE 1456570-F
  misc_feature: Encodes the peptide sequence at SEQ ID NO. 48115
aagctggagctccccgcggtggcggccgctctagaactagtggatcccccgggctgcaggaattcgcacgagaccattacctagaacatcctaatcgaaaaagcacaccggtccagtgcccagcctccgtccctctccttcccttacctcgcctcgtctcctctccttgagatctccagggtacgagcgcattcgcgattttggccgcctccgccgccgtccgggaagatggcgggtctgggaaaggcgatgtacgcagtggggttctggatccgggagactggccaggccctcgaccgcctgggctgccgcctgcagggcaagtacttcttccacgagcagatttcaaggcatcgcaccatcatgaatatctttgacaaaacccctcatgtgcataaagacgcatttgttgctccaagtgcatcccttattggtgatgttcaagtcgggtcaggagcttccatttggtatgggtgcgtcttaagaggggatgcaaacatcatacaaattggatctgggaccaatatacaagacaattctcttatacatggtggctaaatctaatcttaagtggggaaggtctttccaaacaaccattggtaataacgccccagtagggccatatgggcttgggttaccaaggaatgccccgggttgaaaaaaaaaaggttttttgtgggccttggggcccccccccatataaaggggggtgttttttgaaaaaaccacg

SEQ ID NO: 48115 - protein, 109 aa, Zea mays
  misc_feature: Ceres CLONE 1456570-F
  misc_feature: SWISSPROT Homolog: EC 2.3.1.129 Acyl-[acyl-carrier-protein]--UDP-N-acetylglucosamine O-acyltransferase
MAGLGKAMYAVGFWIRETGQALDRLGCRLQGKYFFHEQISRHRTIMNIFDKTPHVHKDAFVAPSASLIGDVQVGSGASIWYGCVLRGDANIIQIGSGTNIQDNSLIHGG

SEQ ID NO: 48116 - DNA, 682 bp, Zea mays
  misc_feature: Ceres CLONE 1456571-F
  misc_feature: Encodes the peptide sequence at SEQ ID NO. 48117
tggagctccccgcggtggcggccgctctagaactagtggatcccccgggctgcaggaattcgcacgagaccattacctagaacatcctaatcgaaaaaccaccgctctgcctcgcctcgcctcacctcacctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttgcaagctggcatgattggtgggagatgggacagttccagggaggcaatttttctcaatccctccccgggggaaacaaccttgaaaacaaccttttgcatttgagggttcgggtccactttcccaaaggcccctcttgaacaaaaa

SEQ ID NO: 48117 - protein, 150 aa, Zea mays
  misc_feature: Ceres CLONE 1456571-F
  misc_feature (20)..(147): Pfam Name: Proteasome Pfam Description: Proteasome A-type and B-type
  misc_feature: SWISSPROT Homolog: EC 3.4.25.1 Proteasome endopeptidase complex
MDVSHAGSSVAGEAPTTGEHRMGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIGGRWDSSREAIFLNPSPGETTLKTTFCI

SEQ ID NO: 48118 - DNA, 840 bp, Zea mays
  misc_feature: Ceres CLONE 1456574-F
  misc_feature (1)..(1): n is a, c, t, g, unknown, or other
  misc_feature (42)..(42): n is a, c, t, g, unknown, or other
  misc_feature (840)..(840): n is a, c, t, g, unknown, or other
nggtccgccctctcctcccccgtcctcagagtgtgtcttggntgtggtttaaactggcactccccgcggtggcggccgctctatttctagtggatcccccgggctgcaggaattcgcacgagaccattacctagaacatcctaatcgaaaaaaagctagagacaaccgctgcgtaaacgaatccatcgccatggcgtctcgtctcgttgcggcggcggactcctcctcctccctctcctcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaacgcggggggttattttttatggtggctacaagcttttttagggaaaagaaggaagccaagactgatgtgggcatcaccacaccccataggtggtgggatatggaatttataccccgtatcttgtgggcctgacaccccatgtttaaaataaaaaggaaaatgcttttatagttggcgccctttcaaggttgaataaaatttgttggccaaccacgaagattttttgcctttcacgctagcgccaaattttattttgaatataagctatttctttaacttcctcccccccagtggaaacaaaccccctctggctggccagatgggaaacctttctcctgccccggttgaaaatatttgccccacccattttgtttaatcccctcctccctcgcctaattgggagaagattctcgaattttatattactcttcctgacctgtgtcgttccttcttn

SEQ ID NO: 48119 - DNA, 751 bp, Zea mays
  misc_feature: Ceres CLONE 1456578-F
  misc_feature: Encodes the peptide sequence at SEQ ID NO. 48120
  misc_feature (751)..(751): n is a, c, t, g, unknown, or other
tggagctccccgcggtggcggccgctctataactagtggatcccccgggctgcaggaattcgcacgagaccattacctagaacatcctaatcgaaaaacttcctcgccctccaacctctcctgatctcctcctctggtccgcatagaggagcagcttgccagccaaggacaccggagcacgggcacgggcgcacggccagcgcgaacctcctcccctcccctcttcttccgtttccaacagcgaggcatagtggagaaggcgaggagcatggcgcgcaaactagagatcccccagtggaagcacgacggccttccgtcgccgacgagcccgctggaccgcgcgtcgccccgtgggtggcgccaccgcgacgccgtcggaggcgtcgggctcgggatcctggcggcgctggaggccgagggcccgctgcccggcgccggcgccgccgccgcgccgcgggtgtccatcccgcggcgcgcggcgcggctggaggtatcggagctcgcgtgcagcgggcggtgcgccaccagtctgtgcggcggcccggtgtccggccgggccggcggcggcggtggagcggcgttccgcgtggcggagttcctctcgtgctgcgacatgtgccgccgggcgctggacgggaaggacgtcttcatgtaccggggggagcgcgccctctgcagcatggagtgcccgttacacgccatcgtggagcgaccagttccaggaagccgaaggagaaaaaagagcggaccn

SEQ ID NO: 48120 - protein, 161 aa, Zea mays
  misc_feature: Ceres CLONE 1456578-F
  misc_feature (95)..(150): Pfam Name: DUF581 Pfam Description: Protein of unknown function (DUF581)
MARKLEIPQWKHDGLPSPTSPLDRASPRGWRHRDAVGGVGLGILAALEAEGPLPGAGAAAAPRVSIPRRAARLEVSELACSGRCATSLCGGPVSGRAGGGGGAAFRVAEFLSCCDMCRRALDGKDVFMYRGERALCSMECPLHAIVERPVPGSRRRKKSGP

SEQ ID NO: 48121 - DNA, 674 bp, Zea mays
  misc_feature: Ceres CLONE 1456579-F
  misc_feature: Encodes the peptide sequence at SEQ ID NO. 48122
  misc_feature (412)..(412): n is a, c, t, g, unknown, or other
  misc_feature (478)..(478): n is a, c, t, g, unknown, or other
ggagctccccgcggtggcggccgctctagaactagtggatcccccgggctgcaggaattcgcacgagaccattacctagaacatcctaatcgaaaagacgatacatttcacctccccggatctatctcgccgcgtcggcgcgctggtcacccgacgaagctaggaggcagtcaaggcggacgaagcgctgcaccaaatttgacgggggatcgagcacaggaggcgtagtggaaaatgtttaagtttctcaaggaggtggtcgcgggatccggatcggggctcaaggacttcccctacaccattggtgagacatacgcatccgcctggggttcatggacacaccaccgcggtacctccaaggatgatgggtcacctgtgtcaattttttctctgtcagggagcaacccctcangacagacacatggttgctggccgtaatggtgttaagagattacgaacggtgcggcatccaaatatnctatcctttttacacagtactgaaagcagaagttgcggatggacctgccatcaaccacacgatttataatggtaacagagcctgttatgccactttctgaaaacctcaagaactgaatctggggggacccaaagaatgaaaactttgctgggggcttaccaaattccaaaggcgggagcttcccaaaaaggatgcg

SEQ ID NO: 48122 - protein, 67 aa, Zea mays
  misc_feature: Ceres CLONE 1456579-F
  misc_feature (60)..(60): Xaa is any aa, unknown, or other
MFKFLKEVVAGSGSGLKDFPYTIGETYASAWGSWTHHRGTSKDDGSPVSIFSLSGSNPSXQTHGCWP

SEQ ID NO: 48123 - DNA, 701 bp, Zea mays
  misc_feature: Ceres CLONE 1456582-F
  misc_feature: Encodes the peptide sequence at SEQ ID NO. 48124
  misc_feature (480)..(480): n is a, c, t, g, unknown, or other
  misc_feature (481)..(481): n is a, c, t, g, unknown, or other
  misc_feature (580)..(580): n is a, c, t, g, unknown, or other
  misc_feature (583)..(583): n is a, c, t, g, unknown, or other
  misc_feature (625)..(625): n is a, c, t, g, unknown, or other
  misc_feature (631)..(631): n is a, c, t, g, unknown, or other
tccccgcggtggcggccgctctagaactagtggatcccccgggctgcaggaattcgcacgagaccattacctagaacatcctaatcgaaaaatcagaaccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctggggagggccccggcagcgtcgtcgaggaccagctcgacccggcgccgcccgccatcgaccccaacgaccccnnacctacgaaggagggaggggcggcggacgaggacgacgaggcggccagggaggtggtcgtcgggggaggtggaggtcgctaaggtcgccgagagcaggnacngcgtcgccaggtcgacgtcccgccgggcctgctcccggaccngaagcngttaaaaggactggcttttctggatacgcctaaacctataaaacgtgtggcacggggtcccagtttgtcc

SEQ ID NO: 48124 - protein, 159 aa, Zea mays
  misc_feature: Ceres CLONE 1456582-F
  misc_feature (99)..(99): Xaa is any aa, unknown, or other
MAAYMRVTHRDEEGKKVTEKMPVPETRRPDTAKHFERKLEEQGLHRFERHPANAPRGVGIGAPPPKSGRGGKYTWGGPRQRRRGPARPGAARHRPQRPXTYEGGRGGGRGRRGGQGGGRRGRWRSLRSPRAGTASPGRRPAGPAPGPEAVKRTGFSGYA

SEQ ID NO: 48125 - DNA, 682 bp, Zea mays
  misc_feature: Ceres CLONE 1456588-F
  misc_feature: Encodes the peptide sequence at SEQ ID NO. 48126
ggagctccccgcggtggcggccgctctataactagtggatcccccgggctgcaggaattcgcacgagaccattacctagaacatcctaatcgaaaaaaattgtaaccgtgttgcaacttgcaaccggcctatctccttgcccgcgaagccatggcggatgcccccgcgatggcctcatcaccaccggcgtccgctgacgacggcggtccatcctcgccttccgtagccgtccctcgtgtacttccctccagattgctcctagacaccccgcctccttccagcggtagggcgcggggcccgcggggcggcagtgcggctgcggcgtctgggcgcggcggcagtgcggctgcggcgtctaggcgcggcgggcgaggcggacgcacgaggagggagtccactttgccggctgcggcttagaacggtacaggagggaggaggccggagcgggactggctcgccgaggcggttatgatgatcgggcggccagtcaaggacgcgggactggcatccgccgacattcttcagctggcgatggcgaagggccctatgttcgagtggctgaactactggccggaggagggggtcctcaagggaagaacattcccctatggacgccacggggctttttccccccgttccgggcacggcaaaaaccgtgtgaagtgcttcttgggggcattgc

SEQ ID NO: 48126 - protein, 71 aa, Zea mays
  misc_feature: Ceres CLONE 1456588-F
MMIGRPVKDAGLASADILQLAMAKGPMFEWLNYWPEEGVLKGRTFPYGRHGAFSPRSGHGKNRVKCFLGAL

SEQ ID NO: 48127 - DNA, 626 bp, Zea mays
  misc_feature: Ceres CLONE 1456595-F
  misc_feature: Encodes the peptide sequence at SEQ ID NO. 48128
  misc_feature (432)..(432): n is a, c, t, g, unknown, or other
  misc_feature (564)..(564): n is a, c, t, g, unknown, or other
  misc_feature (565)..(565): n is a, c, t, g, unknown, or other
ggagctccccgcggtggcggccgctctagaactagtggatcccccgggctgcaggaattcgcacgagaccattacctagaacatcctaatcgaaaactacctgcaccagcctcgcccgcccttcgctcgccgccgccatggggaggggaaagttcaagggaaagcccaccggccgccgcaacttctccacaccggaggagatcgctgctggtacttcaggtcgccctcgcacctttaagaagaaggaggaagaggaagaggaggaagaagaaagagaagagtcagaggaggaagaatctgaagacgagtctgatgacaaacctaaacataaaggtactgagggtattattcagattgaaaatccgaacttagtaaaagtgaagaatataaaggccaaggaagttgatcttggaaagacaactgaactctcanggcgtgaaagggaggagcttgagaaacaaaaagctcatgaaacgtatttgaaaacctcccggaccagggaaaaaccgaaccagcccccgaaaaaaattttggaacccccctttctttttttaaaaaaaaaanncaaaggggtggttttgcccccaaaaaaaaaaccccccgtggagaaaaaaaaaaaaacaccc

SEQ ID NO: 48128 - protein, 163 aa, Zea mays
  misc_feature: Ceres CLONE 1456595-F
  misc_feature (99)..(99): Xaa is any aa, unknown, or other
  misc_feature (143)..(143): Xaa is any aa, unknown, or other
MGRGKFKGKPTGRRNFSTPEEIAAGTSGRPRTFKKKEEEEEEEEEREESEEEESEDESDDKPKHKGTEGIIQIENPNLVKVKNIKAKEVDLGKTTELSXREREELEKQKAHETYLKTSRTREKPNQPPKKILEPPFLFLKKKXKGVVLPPKKKPPVEKKKKTP

SEQ ID NO: 48129 - DNA, 731 bp, Zea mays
  misc_feature: Ceres CLONE 1456599-F
  misc_feature: Encodes the peptide sequence at SEQ ID NO. 48130
ggagctccccgcggtggcggccgctctagaactagtggatcccccgggctgcaggaattcgcacgagaccattacctagaacatcctaatcgaaaaaggatgtctttcagccgcagattagcaggccgcctgcgctccttgcccctaagcctcgtttccggtgtacgactccaacgacgacgagatggcctccccgctccgtcggagcttcccctccctcggccgcgcgcttctcacgccggcgccggcgcggatgctctccgcggaggcctccgatgccctcgttgagatcaagcctggggagattgggatggtctccggcatccccgaggagcacctccgccgtaaggttgtaatttattcaccagctaggactgcatctcagcaaggttcaggcaaagttgggagatggaaaattaactttttgtcaacccaaaagtgggagaacccattgatgggatggacatctactggggatccatatgctaatgtcggtgaagcaggacttacattcaacagtgcggagtcagcaaaagcatttgctgaaaaacatggatgggatttttgtgggtacgggaaacggatacacctctttttgaagcctaaagccctacgcttgaaaaactttctagggggaaaaaggccccccccaaagggcggaaccaagattttaaaccctccccccagctttggggacccctgtaccctggggaagggaggttttttttccc

SEQ ID NO: 48130 - protein, 182 aa, Zea mays
  misc_feature: Ceres CLONE 1456599-F
  misc_feature (54)..(158): Pfam Name: ETC_C1_NDUFA4 Pfam Description: ETC complex I subunit conserved region
MASPLRRSFPSLGRALLTPAPARMLSAEASDALVEIKPGEIGMVSGIPEEHLRRKVVIYSPARTASQQGSGKVGRWKINFLSTQKWENPLMGWTSTGDPYANVGEAGLTFNSAESAKAFAEKHGWDFCGYGKRIHLFLKPKALRLKNFLGGKRPPPKGGTKILNPPPSFGDPCTLGKGGFFS

SEQ ID NO: 48131 - DNA, 684 bp, Zea mays
  misc_feature: Ceres CLONE 1456601-F
  misc_feature: Encodes the peptide sequence at SEQ ID NO. 48132
gcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggctcctgctccaaaatatgattcgtctggtctggcgcgcgtgagtccagctcgtgtgtcgtgcgtgtctctgtgtgaggtgtcggcggccgtgtgtgtatgtatggagtcggccgccgcggcggccgaggaggaggtgtgcccgtggtgggaggtacgtgcttcgacgcgccactggttgtcgcggcgatcatgtactacccccgctggggttttctgggccccaatggagatggatttatctgatttcctaaaaaacacaaattatagacttaccggtataataaaca

SEQ ID NO: 48132 - protein, 57 aa, Zea mays; identical to SEQ ID NO: 43282
  misc_feature: Ceres CLONE 1456601-F

SEQ ID NO: 48133 - DNA, 808 bp, Zea mays
  misc_feature: Ceres CLONE 1456604-F
  misc_feature: Encodes the peptide sequence at SEQ ID NO. 48134
  misc_feature (20)..(20): n is a, c, t, g, unknown, or other
  misc_feature (29)..(29): n is a, c, t, g, unknown, or other
  misc_feature (44)..(44): n is a, c, t, g, unknown, or other
gtgcgcctcgcgctcccgcnccccccttntttcttttataaaancctcaaactggaactccaccgcgggggcggccgctcttttctagaggagcccccgggctgcaggaattttcccgaaaccattacctagaacatcctaatcgaaaaaaactctcgccctccccacggccagaaccctagcctcgtcgccatggcctcctccttgttccgctccggccaccgcctctttctccgacgcctccgtctacccgcggcattctccaccgctacggccgaggagctaatcgacgtatgcacgcttcccaccaactacgacccctccaccttcgacccgtcctccccgtcccgcccgctgccgtccgaccgcgtgtggcgccgcctcaaggatgtctcctccctcaacctcgaggagacggcggggtgggaaatcacacatcccccgccgcctagacatactttttgttactcttattcccccttctcatctccgccgcccggtctggctggttccccccctccccgtacggtgtggctgaaaatgcagccctcggtcgttagcggctcatatcccgaatatcaccctcctcctagctgcatcctcccaggttttcccaccctttccccgcttaccccaaggtagctcacactgcacccccggcccccccgtccgaacctggggttccaacacgtctcccaacacttccgttgcgaaataaaggcttcccgggcggtcgattattgtggcttgctctttccccttttgatccctataccttattcttgtactcccgctcacttggctgtaa

SEQ ID NO: 48134 - protein, 33 aa, Zea mays
  misc_feature: Ceres CLONE 1456604-F
MQPSVVSGSYPEYHPPPSCILPGFPTLSPLTPR

SEQ ID NO: 48135 - DNA, 628 bp, Zea mays
  misc_feature: Ceres CLONE 1456607-F
  misc_feature: Encodes the peptide sequence at SEQ ID NO. 48136
  misc_feature (447)..(447): n is a, c, t, g, unknown, or other
ggagctccccgcggtggcggccgctctagaactagtggatcccccgggctgcaggaattcgcacgagaccattacctagaacatcctaatcgaaaaaaaacccaacggccgaagctaagctcgagccgccgccgcgatgatcctccgtatccgcagccgcgacggcacggaccgcatcacggtcccagactcggcctcagtcaccgtcgccgacctgcagcgcctcatcgagtcgcacctcaccgtgcccgtcccgctccagcgcctctccctcgacccggccctcctgctccctaacccctccgccgttgtcccactcctcaccgactcggcggcgccgcttgcctcgctccgcctcgccaacggcggcttcgtctactcgcataccgcccgacgcgcgctcggcccgcccgcgccgccaaggcactttccgcgctgggctcttcngcaaaagatgaccatggatgacctatcgcgcggcagatcgcgtccacgccaggagaacggctctgcgccgcgcctctttgacgggatgccgcaacgcgttcagctctagtcgccaattcctcgtttcgggtcaaggggggggtttccttagggccgtttacccaaaccaggatgcttcccc

SEQ ID NO: 48136 - protein, 139 aa, Zea mays
  misc_feature: Ceres CLONE 1456607-F
  misc_feature (104)..(104): Xaa is any aa, unknown, or other
MILRIRSRDGTDRITVPDSASVTVADLQRLIESHLTVPVPLQRLSLDPALLLPNPSAVVPLLTDSAAPLASLRLANGGFVYSHTARRALGPPAPPRHFPRWALXQKMTMDDLSRGRSRPRQENGSAPRLFDGMPQRVQL

SEQ ID NO: 48137 - DNA, 770 bp, Zea mays
  misc_feature: Ceres CLONE 1456608-F
  misc_feature: Encodes the peptide sequence at SEQ ID NO. 48138
  misc_feature (420)..(420): n is a, c, t, g, unknown, or other
  misc_feature (425)..(425): n is a, c, t, g, unknown, or other
  misc_feature (454)..(454): n is a, c, t, g, unknown, or other
ggagctccccgcggtggcggccgctctataactagtggatcccccgggctgcaggaattcgcacgagaccattacctagaacatcctaatcgaaaagcatctcgcattctcgccggtgctgctgcaattaacgccacccccggccaaccgcctgaaaactacctctgccgccggcgccgccatccccaacatggcgagccaaggggagccctcggcctctgcttccgatccgaaggagaagaaggactactcgacggcgatactagagaggaaaaagtcaccgaaccgccttgtcgtcgacgaggccaccaacgacgataactccgtcgtcgcactgcaccctgacaccatggagaggctgcagctcttccgcggcgatactgtgctcctcaaggtctgatatggctaatctgagcttgntgcancagcttggggaatgtgagctaatctagcngattggatatccacgtgaccgatctgggggggtcaaactgaattccgggaatcaaagggccaaactgtaaaaaaaaccctaacttttgcccaaagccctggcaaaagggtaaaggtgaaaattggtgaattgtttaaaaacttgatttctagaggcaggagggatttgggcccccccgcttttccccggggggggggaatttaaaaattccccttcccttcccccccccgggttctttgggggaaaaaaacaccaaattttctatggggggccaaaaaaaaaaaaaaaaacaggggggtgtgggtcaaaaaaaaaa

SEQ ID NO: 48138 - protein, 69 aa, Zea mays
  misc_feature: Ceres CLONE 1456608-F
MASQGEPSASASDPKEKKDYSTAILERKKSPNRLVVDEATNDDNSVVALHPDTMERLQLFRGDTVLLKV

SEQ ID NO: 48139 - DNA, 721 bp, Zea mays
  misc_feature: Ceres CLONE 1456612-F
  misc_feature: Encodes the peptide sequence at SEQ ID NO. 48140
  misc_feature (549)..(549): n is a, c, t, g, unknown, or other
ggagctccccgcggtggcggccgctctagaactagtggatcccccgggctgcaggaattcgcacgagaccattacctagaacatcctaatcgaaaacccgatgccctaacccatggttacgactccgacgacgcgaccccggcggcctgctgcccagctccctctgccttcgcgccgtgcctcctaccctcctgaatccgcgccgtgccacccgagtccaggcccccagggtgcgagggcggcaccggcgcaggcgaaccgcagtccgcgcctccgcactccgccccatccgaagctccgagcacagcaggagcagcaaagcaagcgagcgtcagtggcagactggctgaatcgagaggtggaggcagcaaccaacaaggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcnttatcatctttcaccgcatacgtgaagggggccaattctcaaacttccccccccccttttgcccccctttgtcccttaaataaggggggaatttttaaggggtctaagggccccctggggcccttcagaaaatggcccccctagggatcttctccttttctccaaaaaaaag

SEQ ID NO: 48140 - protein, 101 aa, Zea mays
  misc_feature: Ceres CLONE 1456612-F
MKVKILQWHAVASWTWDAQDETCGICRMAFDGCCPDCKFPGDDCPLIWGVCNHALSSFTAYVKGANSQTSPPPFAPLCPLNKGGIFKGSKGPLGPFRKWPP

SEQ ID NO: 48141 - DNA, 775 bp, Zea mays
  misc_feature: Ceres CLONE 1456615-F
  misc_feature: Encodes the peptide sequence at SEQ ID NO. 48142
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
atagcccaacccgttgtggtccgcgcattttattnnnacttaataaaataaaattggaactccccgcggtggcggccgctctagtactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacatggttcctgctccaaaatatgattcgtccggagtggtgcgcgtgaatccagctcgtgtgtcatgtgtgtctctgtgtaaagggccgccgagcgtgtgtgtattttatggaatcggcacacacctgcgcctccgaaagaagtgtggcccctagtgggtggggacattcctttcaaccccccccttggttggtgcgggcgaatcctgaactaacccttgttgggtgctttcttgcgttttcccctgtgaagtagatttctttctcgaaaaaacaataaaaaacaaataaccttctttcactttacccgctt

SEQ ID NO: 48142 - protein, 57 aa, Zea mays; identical to SEQ ID NO: 43282
  misc_feature: Ceres CLONE 1456615-F

SEQ ID NO: 48143 - DNA, 689 bp, Zea mays
  misc_feature: Ceres CLONE 1456622-F
  misc_feature: Encodes the peptide sequence at SEQ ID NO. 48144
tggagctccccgcggtggcggccgctctagaactagtggatcccccgggctgcaggaattcgcacgagaccattacctagaacatcctaatcgaaaaaactgcctcttcgcggcggcgcaaaacaccaacacgtcttctctccggttgcgaggagggtataggatttcgccgcggcgagatgtcggcgtacgacgaggtggagatcgaggacatggagtggaacgcggagctgaaggcgtacacgtacccgtgcccctgcggcgacctcttccagatcacgctcgacgacctccgcatcggggaggagattgcgcgctgcccgtcgtgttctctcttcctcaccgtcgtttacaacgccgaggactttgctgacgccaaggagccgacccacaagccgtccccgagcccagtcgccgtcgcctgatgtggcccgtgcccggcgagatggacgcatggaaatggatctcagagcaggataacgaatgagtttttgtttggcacacaccactacgggagcatttgtactactcttagatgagtcaacccactgcatattttcagagctcaggttgttgaactatcttttttttgtgcttgacattgtaaggtgacatggacagaacatgctatgaaaaaaattgtttagtcactacttatcgttaaaaaaaaaaaaaaaaaagcttatcga

SEQ ID NO: 48144 - protein, 81 aa, Zea mays
  misc_feature: Ceres CLONE 1456622-F
  misc_feature (5)..(59): Pfam Name: zf-CSL Pfam Description: CSL zinc finger
MSAYDEVEIEDMEWNAELKAYTYPCPCGDLFQITLDDLRIGEEIARCPSCSLFLTVVYNAEDFADAKEPTHKPSPSPVAVA

SEQ ID NO: 48145 - DNA, 750 bp, Zea mays
  misc_feature: Ceres CLONE 1456626-F
  misc_feature: Encodes the peptide sequence at SEQ ID NO. 48146
  misc_feature (446)..(446): n is a, c, t, g, unknown, or other
  misc_feature (447)..(447): n is a, c, t, g, unknown, or other
ggagctccccgcggtggcggccgctctagaactagtggatcccccgggctgcaggaattcgcacgagaccattacctagaacatcctaatcgaaaaatatttccatcctccattcacgcatcacaagctggaaggcactgtgggcaataatggctctgctcacgctccagcagccagcgatacccttcctcctgctcctcctcctgctccccgccgcgtccgctaggctgcccggtggccggacactggtcttcatcctggctgggcagtccaacatgagcggccgcggcggcgccaccaacggcacctgggacggcatcgtcccgccggagtgcgcgccctcggaccgcatcgtccgtctctcccccgcgcttcgctgggagcaggcgcgcgagccgctgcacgccggcgtcgacgtgggcaacgttctcggcgtcgggcccggnnatgccttcgcgcacgccgtgcttcacagcaaaggggcaaccgaaaaacccccccctcttcttcggggttcggccggggcaaaaggggggaacccccaattcccaactggtccccggggaaacgaactttacaaaaggaagggaaccccccccaggggggcccgggcccaaatgaaaaaaaaattccacctgccccctttttttttgaccccgggggaggggaaccccaggggccccagagtgtaaatctccccccgggggaaaaaaaccccgggggaaaaacccggaaaaacccgggggggac

SEQ ID NO: 48146 - protein, 180 aa, Zea mays
  misc_feature: Ceres CLONE 1456626-F
  misc_feature (100)..(100): Xaa is any aa, unknown, or other
MALLTLQQPAIPFLLLLLLLPAASARLPGGRTLVFILAGQSNMSGRGGATNGTWDGIVPPECAPSDRIVRLSPALRWEQAREPLHAGVDVGNVLGVGPGXAFAHAVLHSKGATEKPPPLLRGSAGAKGGNPQFPTGPRGNELYKRKGTPPRGARAQMKKKFHLPPFFLTPGEGNPRGPRV

SEQ ID NO: 48147 - DNA, 724 bp, Zea mays
  misc_feature: Ceres CLONE 1456640-F
  misc_feature: Encodes the peptide sequence at SEQ ID NO. 48148
  misc_feature (407)..(407): n is a, c, t, g, unknown, or other
tggagctccccgcggtggcggccgctctagaactagtggatcccccgggctgcaggaattcgcacgagaccattacctagaacatcctaatcgaaaaagagtccagaccatagcctgcagccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacaaggacgccaagctcttcaactgcgtgcagagggggcaccagaactctctagagtggatgcccgttttcttcgtcatactgctgctgggcggtctgcancacccgaccatcgccgccggtctgggcggcatctacatcgtcgcgaggttcttctacttcaagggatacgccaccggcgttccggaacaacctctcaagattggggggctcacctacttggcgtttccttggcctgaatcattgcacagcattctttcggcatccaccctggtcatcagggaagagcccctaaacctttgggtttaaatttggaaaccccccggctgggtataacccgcccaagtttatctcctggggctgaaacaaaaaaaacttgtgggaaaccaagcccgtttgggggtttttaaaaggagaag

SEQ ID NO: 48148 - protein, 154 aa, Zea mays
  misc_feature: Ceres CLONE 1456640-F
  misc_feature (9)..(144): Pfam Name: MAPEG Pfam Description: MAPEG family
  misc_feature: SWISSPROT Homolog: EC 2.5.1.18 Glutathione transferase
  misc_feature (86)..(86): Xaa is any aa, unknown, or other
MAVSIELTKEYGYVVLVLVAYVFLNLWMGFQVGKARRNYKVFYPTMYAIESENKDAKLFNCVQRGHQNSLEWMPVFFVILLLGGLXHPTIAAGLGGIYIVARFFYFKGYATGVPEQPLKIGGLTYLAFPWPESLHSILSASTLVIREEPLNLWV

SEQ ID NO: 48149 - DNA, 847 bp, Zea mays
  misc_feature: Ceres CLONE 1456641-F
  misc_feature: Encodes the peptide sequence at SEQ ID NO. 48150
  misc_feature (13)..(13): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (138)..(138): n is a, c, t, g, unknown, or other
ttggccgcccgtnttttgtnnnnnatcttccgttttnaaccttnnnnnnnnaaaaactggagctccccgcggtggcggccggctctataactagtggatcccccgggctgcaggaattcgcacgagaccattacctanaacatcctaatcgaaaagaggagttcaggggggagccacccaaaacaagacaagccaggccagcggcggagagggagagagagagagagagagcacgcgacagtatgcaggagggcgaggacgagcttgtagagggttaagggaggcgaccgccatgggggactccaggggctccgtgtcgggccacgtcgaacggatcttcttcgggggcaagggagctccagtaagagcgaggcatggttctctttcggtttctgcccatggggaggatgaccggcctcgggttcgtatcccccccccaacgtaacctcgaaccccctgggctgggggttcccacaattgttctctctgttcccaagactgccttccctgccctctccccaaagtacccgctctggaggcgcttcgcgtcctccagtcgacccgagctcggggagcaatttcctaattcccgcgctgatctgccctgggagccccgcgggcacggggtctggggggccctgggtccggtcgggggtgggcttgagttttcgccccatgcgatccggcggggggcaggtgcttgaagtcatacgcccggccgggcgggggtcctgtttcgggcgccggccctcttcctctccggggcgtgacggcggttggtgctctgtgcgcgcctcctggggtggtgtgtccgcctctggggggggtgaggtacggccgtccgggg

SEQ ID NO: 48150 - protein, 91 aa, Zea mays
  misc_feature: Ceres CLONE 1456641-F
  misc_feature (4)..(4): Xaa is any aa, unknown, or other
  misc_feature (7)..(7): Xaa is any aa, unknown, or other
  misc_feature (8)..(8): Xaa is any aa, unknown, or other
  misc_feature (12)..(12): Xaa is any aa, unknown, or other
  misc_feature (14)..(14): Xaa is any aa, unknown, or other
  misc_feature (15)..(15): Xaa is any aa, unknown, or other
  misc_feature (16)..(16): Xaa is any aa, unknown, or other
  misc_feature (17)..(17): Xaa is any aa, unknown, or other
  misc_feature (46)..(46): Xaa is any aa, unknown, or other
GRPXFVXXLPFXTXXXXKLELPAVAAGSITSGSPGLQEFARDHYLXHPNRKEEFRGEPPKTRQARPAAERERERERARDSMQEGEDELVEG

SEQ ID NO: 48151 - DNA, 868 bp, Zea mays
  misc_feature: Ceres CLONE 1456650-F
  misc_feature: Encodes the peptide sequence at SEQ ID NO. 48152
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (44)..(44): n is a, c, t, g, unknown, or other
gggtgccggctcttccttctctccgttccgccgnnnttngattntttttcaaactggagctccccgcggtggcggccgctctagaactagtggatcccccgggctgcaggaattcgcacgagaccattacctagaacatcctaatcgaaaaccaatcgcgccgccgctcgagcccctctcgcccttcgcgccgccgccgctgcaggcaaccgtcgccgccgtcgccgccgtcgccggagctaaacccctcgcctgacgccatggggcgcatgcacagccgcggaaagggtatctcgtcgtcggcgctgccgtacaataggactcccccgagctgggtcaagaccgccgtcgctgatgtctacgagttgatcaccagagctgcaaagaaggggcagatgccctcgcagatcggtgttgctgttccgtgaacagaacggtattccccctttgtgaaaaagcgttacccccaaccaagtattctcccgaatcctcctaggctcatgggccctgggctccccgaaaaacccccagaaggaaatctgccaccctctttaaatcaaaacaaaggggttggggtcccaattacgggatagccactcctttgatagagggaacagaggatacggacaaagggaactccccaaaatttcccgggctccccttccttgggttgggaagaccggggtatccaccggtctctggggccggtatattctaaaacgcccttcttaaaaaaatactccctccctccccaggggaaagtccccaaagtctacacccctgcccctcgcccacgttgggggggtctaagacggggcccctgcccagctgagtgtggggtttaaacccgggttctccgaggagcctt

SEQ ID NO: 48152 - protein, 55 aa, Zea mays
  misc_feature: Ceres CLONE 1456650-F
  misc_feature (1)..(54): Pfam Name: Ribosomal_S13_N Pfam Description: Ribosomal S13/S15 N-terminal domain
MGRMHSRGKGISSSALPYNRTPPSWVKTAVADVYELITRAAKKGQMPSQIGVAVP

SEQ ID NO: 48153 - DNA, 690 bp, Zea mays
  misc_feature: Ceres CLONE 1456653-F
  misc_feature: Encodes the peptide sequence at SEQ ID NO. 48154
ggagctccccgcggtggcggccgctctagaactagtggatcccccgggctgcaggaattcgcacgagaccattacctagaacatcctaatcgaaaactctaccttctatgagcttctatgagccaagtaaagagagaagccgagaaactgtgtttcacgtcccggcgatgagcccccgtgtggtcctcctcttcctcgccgccctccgcccctgcgccgccctcgtccgctttcactccaccactttttccttcactttcctcgacgccccagcgcgctttggcccccgagtgagcggcgatgggatctgcggctccctgcgtgccgctgacccggccgaggcgtgtgagaccatcaaagaccgcggcggccgccgcggcgcgggccggaaggctttcgtgctgatcgcgaggggcaactgcagctttgaggagaaggtgcgggcggcgcagcaagcggggttcgacgcctccatcgtgtacgacgatgaggagaaggccagcctttactccaaatttcacaagatctgtattgattcttggctcacaaaatggggcatcttctgccctatatgcaagctagaagtaacgttgggcgggtaggcacacttcattactgcatccaagtgctggcagttctattgaagattgttgatcttttgatccacattgcgaggttcaatattcattt

SEQ ID NO: 48154 - protein, 164 aa, Zea mays
  misc_feature: Ceres CLONE 1456653-F
MSFYEPSKERSRETVFHVPAMSPRVVLLFLAALRPCAALVRFHSTTFSFTFLDAPARFGPRVSGDGICGSLRAADPAEACETIKDRGGRRGAGRKAFVLIARGNCSFEEKVRAAQQAGFDASIVYDDEEKASLYSKFHKICIDSWLTKWGIFCPICKLEVTLGG

SEQ ID NO: 48155 - DNA, 683 bp, Zea mays
  misc_feature: Ceres CLONE 1456654-F
  misc_feature: Encodes the peptide sequence at SEQ ID NO. 48156
ggagctccccgcggtggcggccgctctagaactagtggatcccccgggctgcaggaattcgcgcgagaccattacctagaacatcctaatcgaaaaagcaagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcagcagcagcagtctcttcccctcgttcccgcggaccagctcggagaccgcggccttcgctggcgcgcggatcgactggaaggagactccagaggcgcacgtgttcaaggcagacgtaccggggctgaagaaggaggaggtcaaggtggaggtcgaggacggcaacgtccttcagatcagcggcgagcgcaacaaggagcaggaggagaagacggacacctggcaccgcgtggagcggagcagcgggagattcctgcgcaggttccgactgcccgagaacgccaagacggagcagatcagggccgccatggagaacggcgtgcttacagtcactgtgccccagggagacgccaagaagcctgaaagtgaagtcaattcagattcccggttaaacccgggccg

SEQ ID NO: 48156 - protein, 162 aa, Zea mays
  misc_feature: Ceres CLONE 1456654-F
  misc_feature (54)..(154): Pfam Name: HSP20 Pfam Description: Hsp20/alpha crystallin family
MSLIRRSNVFDPFSLDLWDPFEGFPFGSGSSSSLFPSFPRTSSETAAFAGARIDWKETPEAHVFKADVPGLKKEEVKVEVEDGNVLQISGERNKEQEEKTDTWHRVERSSGRFLRRFRLPENAKTEQIRAAMENGVLTVTVPQGDAKKPESEVNSDSRLNPG

SEQ ID NO: 48157 - DNA, 713 bp, Zea mays
  misc_feature: Ceres CLONE 1456656-F
  misc_feature: Encodes the peptide sequence at SEQ ID NO. 48158
atagctggagctcaccgcggtggcggccgctctagaactagtggatcccccgggctgcaggaattcgcacgagaccattacctagaacatcctaatcgaaaaatagcttttccttcgtttggtatctttgccgaggctgtgcgattggccatctccccctcgcgctctcgtgccctcacacgaccttctgctccccgcactgttcgattctgtgtcctcgtgcccttctgtgtgctattccgctcccgcttctgctgccgtgcacaatcgttgccatcacggccgtcttcaccatgttcaggccgccgcgtgctcgtccaacgacgctcgtggaaaccagcgttctagagagtactctcgcttcacagatgcccccagacaggatccgaagccaggtcgttgggtgggggagatggaagactgcggtttggagccctacactgactgctacaggaggcttcggctttgggatgaaggtatgcgtgatatggagatataacccgaaggcaggatgaacggacgctgaacctgtggctgaaggaccttcctcttagtataatgatgaaggtggaatattaaaccaacctaaggggaaaaactccttagcccttgatagcccgccctatgatttatcgcaaaattcggggacatgaatgtaaatttttcccgaccggcccccctggttttaaaataaatgaaccgtaaccccctcc

SEQ ID NO: 48158 - protein, 73 aa, Zea mays
  misc_feature: Ceres CLONE 1456656-F
MFRPPRARPTTLVETSVLESTLASQMPPDRIRSQVVGWGRWKTAVWSPTLTATGGFGFGMKVCVIWRYNPKAG

SEQ ID NO: 48159 - DNA, 764 bp, Zea mays
  misc_feature: Ceres CLONE 1456658-F
  misc_feature: Encodes the peptide sequence at SEQ ID NO. 48160
  misc_feature (764)..(764): n is a, c, t, g, unknown, or other
caagctggagctcaccgcggtggcggccgctctagaactagtggatcccccgggctgcaggaattcgcacgagaccattacctagaacatcctaatcgaaaaacgaaattttaacttgttgcttctctccctcttctgttctgtctcgtccccttcacgaatcacgacagtattgaagcaattcctgattgctgatcctccacaatttctcccgtggattggagcgatctgaattggagccgtttactgctgacatggcgggaactgatcgcctctaccctgaaattgggacgtatgacctgaagcccccgcaggtcccagcctccgccgggggcatcgacgaggaggaggccggggtttgctactcattggtgatgtgggacaacaaatcccacccctgtccctcccatgaagcggaaatcaatacctccctcctcaactcatctgacactcaattcgcctcccggaagaataaaaatacccactaaatgatctaattcgtaaaccgggcgaagcgttctcgctggcttacattggctagtatcccccgacggtctgatcccaatctcacgccacggttgccgaccctgcacccctttaggacctcaaggtgcactatcccccttgctcgaacaaaggacgtaacctccaccggctttacgcattgctctaacccctgcaccatccacttccccgtcctcattcccgtccccccccccgttatacccatactagataacggtgtgccccaagttcctgtcttn

SEQ ID NO: 48160 - protein, 77 aa, Zea mays
  misc_feature: Ceres CLONE 1456658-F
MAGTDRLYPEIGTYDLKPPQVPASAGGIDEEEAGVCYSLVMWDNKSHPCPSHEAEINTSLLNSSDTQFASRKNKNTH

SEQ ID NO: 48161 - DNA, 697 bp, Zea mays
  misc_feature: Ceres CLONE 1456659-F
  misc_feature: Encodes the peptide sequence at SEQ ID NO. 48162
ggagctccccgcggtggcggccgctctagaactagtggatcccccgggctgcaggaattcgcacgagaccattacctagaacatcctaatcgaaattttgtcgcgcaatcattgcctgttttagtgtctggtatttacgcactccaactcaagatgacattactcgcatcatgcataatagtgagtcgcggggttttcctggcatgttgggatccatcgattgcatgcactgggagtggaggaactgtccaacggcatggcgaggtcaattttgtggtcgaaatggtagggcatcgatgatacttgaagcagttgcatcgtatgatctatggatttggcatgcattttttggcatgcctgggacaaacaatgacgttaacgtgctccaccgatcccccgtatttgacccaatcactactggtcgaatgccacctgtcaattacacagttaatggtcatgcgtacaacttcggttattacctcgctgatggtatttaccccaactggcctacttttgtgaaagcaatccgacacccttacgaggaaaagaaagtctacttcacttagatgcaggaaagttgccgaaaggatattgagcgtgcatttggagttcttcaagcccggtgggcggtgctccgtggaccagcttatggttgggatcgtaatcgtttgacagagataatgacggcttgcatcat

SEQ ID NO: 48162 - protein, 131 aa, Zea mays
  misc_feature: Ceres CLONE 1456659-F
  misc_feature (79)..(132): Pfam Name: Plant_tran Pfam Description: Plant transposon protein
MHNSESRGFPGMLGSIDCMHWEWRNCPTAWRGQFCGRNGRASMILEAVASYDLWIWHAFFGMPGTNNDVNVLHRSPVFDPITTGRMPPVNYTVNGHAYNFGYYLADGIYPNWPTFVKAIRHPYEEKKVYFT

SEQ ID NO: 48163 - DNA, 799 bp, Zea mays
  misc_feature: Ceres CLONE 1456662-F
  misc_feature: Encodes the peptide sequence at SEQ ID NO. 48164
  misc_feature (799)..(799): n is a, c, t, g, unknown, or other
atagctggagctcaccgcggtggcggccgctctagaactagtggatcccccgggctgcaggaattcgcacgagaccattacctagaacatcctaatcgaaaaagagtccagaccatagcctgcagccacgaactcccgttctccatttccagccatggcggtgtcgatcgagctcaccaaggagtacggctacgtcgtgctggtgctggtggcctatgtcttcctcaacctttggatgggcttccaggtcggcaaggcccgcagaaactacaaggtgttctaccccaccatgtacgccatcgagtcggagaacagggaccctaatctcttcaactgcgtgcagagggggcaccagaatttttttataccggatgcccggggggcggggggaaacctcccccctcccccctcctccccccatctggatcttcccccgccgggtctggggttttttcccccccccgggcggcgggggttccttcccccttttcgggggaaacccccctccgggcgctttcacggaccaacccctacccttgcgacccgggcgggctctccccccttcctccaccctctcccctgggtcctggatcactcgtgtccgcgcgctgtttttgcggggatccaccctcccccctgcccgggatatcggctcctttcactccttggggtcgatagctcggcgcccccccctgccgtgggcgtcatcgcgttgtcggtccccttccgtgtgctagccttttacatcacctcacccctatttcctctcccgcgtcccgctccccccttttgcttcacn

SEQ ID NO: 48164 - protein, 215 aa, Zea mays
  misc_feature: Ceres CLONE 1456662-F
  misc_feature (9)..(145): Pfam Name: MAPEG Pfam Description: MAPEG family
  misc_feature: SWISSPROT Homolog: EC 2.5.1.18 Glutathione transferase
MAVSIELTKEYGYVVLVLVAYVFLNLWMGFQVGKARRNYKVFYPTMYAIESENRDPNLFNCVQRGHQNFFIPDARGAGGNLPPPPSSPHLDLPPPGLGFFPPPGRRGFLPPFRGKPPSGRFHGPTPTLATRAGSPPFLHPLPWVLDHSCPRAVFAGIHPPPCPGYRLLSLLGVDSSAPPPAVGVIALSVPFRVLAFYITSPLFPLPRPAPPFCFT

SEQ ID NO: 48165 - DNA, 692 bp, Zea mays
  misc_feature: Ceres CLONE 1456663-F
  misc_feature: Encodes the peptide sequence at SEQ ID NO. 48166
tggagctccccgcggtggcggccgctctagaactagtggatcccccgggctgcaggaattcgcacgagaccattacctagaacatcctaatcgaaaactcttggccgccaccccctttttctcccccttggctggacgccccctcctcctatggcagccatcctccattgcttcctcccccaagatctccccctacgcagcaaggatcgagaaaaggaggggcacgttgaattgaagaggaagagaggatcaaggagatgttcttccccatctcctcttgaagatttcttggggaaaccctaggtggctacactccagatcatgtctagtacatttcttcttcttcgatgaaggtgcttgttgctcatcaaggggagtgggaagtagcagcacatccaccttcattctcataataatgctgcccagacgcagccatgatttaattagaaacttcttgtcaaaggatgtttgtttttaactagtcgtgcgcactgattaattcagttcttgttgttatggttgtcttcccattgctagcagattattaatgtcttatatgttttcttatcaaaaaaaaaaaaaaaaaagcttatcgataccgtcgacctcgagggggggcccggtacccaattcgccctatagtgagtcgtattacgcgcgctcactggccgtcgttttacaacgtcgtgact

SEQ ID NO: 48166 - protein, 50 aa, Zea mays; identical to SEQ ID NO: 15603
  misc_feature: Ceres CLONE 1456663-F

SEQ ID NO: 48167 - DNA, 683 bp, Zea mays
  misc_feature: Ceres CLONE 1456666-F
  misc_feature: Encodes the peptide sequence at SEQ ID NO. 48168
gctctagaactagtggatcccccgggctgcaggaattcgcacgagaccattacctagaacatcctaatcgaaaagcatcaaaccaactctttcccaaatccaccgccggctcggctcgcccatcttcgcgccaagcaccgaatctccgatggcccgcacgaagcagacggcgcgcaagtcgacgggcggcaaggcgccccgcaagcagctggccaccaaggcggcgcgcaagtcggcgccggcaaccggtggcgtgaagaagcctcaccgcttccgccccggcaccgtcgcgctccgggagattcgcaagtaccagaagagcacggagctgctcatccggaaggtgcccttccagcgcctcgtccgtgagatcgcgcaggatttcaagaccgacctccgcttccagtcctccgctgtcgccgcgctgcaggaggccgccgaggcctacctcgtggggttcttccaggacccaacctctgcgccatccacgccaagcgcgtcaccttccttcccaaggacatccatctccgcgcgccccatcagggggcgaaagggcttggatcccccgttgccgcccccccctttggtggggcccttccctcggtggcccccggcatggagaaaccctcgcttttgttcgactccctttcgtgcccccagaggggggatgctgtagggttgtg

SEQ ID NO: 48168 - protein, 175 aa, Zea mays
  misc_feature: Ceres CLONE 1456666-F
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKVPFQRLVREIAQDFKTDLRFQSSAVAALQEAAEAYLVGFFQDPTSAPSTPSASPSFPRTSISARPIRGRKGLDPPLPPPPLVGPFPRWPPAWRNPRFCSTPFRAPRGGML

SEQ ID NO: 48169 - DNA, 676 bp, Zea mays
  misc_feature: Ceres CLONE 1456671-F
  misc_feature: Encodes the peptide sequence at SEQ ID NO. 48170
ctggagctcaccgcggtggcggccgctctagaactagtggatcccccgggctgcaggaattcgcacgagaccattacctagaacatcctaatcgaaaactaccgctgacagacgattcaaccgtccgccaaatccaaacgcaccgatccattccagaccatggcgacgaccaaggaccccgcgaccaccggcggcgagcccgccatcggcattccctaccacccggcggcggaggcccaggggcactattactacgcgccgccgccgaacccctacgcggcggggatgccgccgcccaacgcgatctacgccggcgcgcccaagggggtgccgctccagcagaccatgttccgcgacacgcccgcgcccttccactgccaggcctgcggtgaagccgccgtctcctccgtccggtcaaagccaagccttgcatccgtcgtggcttgcatgatgcccttcatgctgggggtctgcttcctatgcccttcgatggactgcctctggcacaagtaccattattgccccagctgtggggaaaaggtgggtgagttcaggaagtcggacccgtgcctcgtcgtggatgcgacccggtggtccgagccgagcttcgccgtgcctgcgtagcgcacatatgtacatgtaccacttgctatactgccttaaaaaatgagtgtgg

SEQ ID NO: 48170 - protein, 154 aa, Zea mays
  misc_feature: Ceres CLONE 1456671-F
MATTKDPATTGGEPAIGIPYHPAAEAQGHYYYAPPPNPYAAGMPPPNAIYAGAPKGVPLQQTMFRDTPAPFHCQACGEAAVSSVRSKPSLASVVACMMPFMLGVCFLCPSMDCLWHKYHYCPSCGEKVGEFRKSDPCLVVDATRWSEPSFAVPA

SEQ ID NO: 48171 - DNA, 684 bp, Zea mays
  misc_feature: Ceres CLONE 1456674-F
  misc_feature: Encodes the peptide sequence at SEQ ID NO. 48172
  misc_feature (572)..(572): n is a, c, t, g, unknown, or other
aaagctggagctccccgcggtggcggccgctctagaactagtggatcccccgggctgcaggaattcgcacgagaccattacctagaacatcctaatcgaaaattcgaccttcgcaacgcctccccagcaacctctgctccgccgcctccggcgaccgccggaacccgtggtggaggaggacgtggagagggaagatctcgccagatccaaggaggtggggacaagatggtgagctcctcgtcgtcggtggttaacgtgtacccgctcgccaactacacgttcggcaccaaggagcccaagatggagaaggacacctccgtcgccgaccgcctcgctcgcatggaagtcaactacatgaaagaaagaatgcgtacaagtgttgaagccatcctattggtgcaagagcacacccaccctcacatactgctcctgcaaatcggaaatacattctggaaacttcctggtggacggttgaaacctgggaaaaaatgaaatccaaggtttgaaaaagaaagttggggcccccaaacctcccggggaacccccccttccttttcccccctaaatgggcnaggttgaaaaaagtgggttccttttgttggggggaagccccaatttttggaaacggggggatggattccctttaggggccccctccactttttcccccaggcgcccaagggg

SEQ ID NO: 48172 - protein, 88 aa, Zea mays
  misc_feature: Ceres CLONE 1456674-F
MVSSSSSVVNVYPLANYTFGTKEPKMEKDTSVADRLARMEVNYMKERMRTSVEAILLVQEHTHPHILLLQIGNTFWKLPGGRLKPGKK

SEQ ID NO: 48173 - DNA, 695 bp, Zea mays
  misc_feature: Ceres CLONE 1456678-F
  misc_feature: Encodes the peptide sequence at SEQ ID NO. 48174
aagctggagctccccgcggtggcggccgctctagaactagtggatcccccgggctgcaggaattcgcacgagaccattacctagaacatcctaatcgaaaaacctccccactcgagccagccagccagccagccagccgcttgggcgccatctctctagagcttcgtaccctcgaagagagatccggcgcggcccaataaacacccggctcactacagactcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcgccgcggcctccctcgccgccgccgccttcggctacctcttctgctagatccgcgctggatacgtggtccctgctccaaaatatgattcgtctggtctggcgcgcgtgatcccagctcgtgtgtcgggtgtgtctctgtgtaaagtgtcggcgggccttgtgtgattgtatggagccgcccccgccgccagcgccgaaagaagtttgccccctgggggggtggaactggctttcaaccccccccttggttgtggggggggaatctgggaccccccccggtggcgttttttggggttacccaagggaagtggatgtttttttatttcacaaaaaaaaaaaaaaa

SEQ ID NO: 48174 - protein, 57 aa, Zea mays; identical to SEQ ID NO: 43282
  misc_feature: Ceres CLONE 1456678-F

SEQ ID NO: 48175 - DNA, 709 bp, Zea mays
  misc_feature: Ceres CLONE 1456691-F
  misc_feature: Encodes the peptide sequence at SEQ ID NO. 48176
  misc_feature (415)..(415): n is a, c, t, g, unknown, or other
  misc_feature (709)..(709): n is a, c, t, g, unknown, or other
aaagctggagctccccgcggtggcggccgctctagaactagtggatcccccgggctgcaggaattcgcacgagaccattacctagaacatcctaatcgaaaaaaaaaaaatcgaccgtcttcctcccaacccaagtggatgtgcaggaccgcgaacacgaggaggcaggggagcagcatccacaaccacaagccatggcggggaggactaacatccccactaacaactccgccctcatcgcaatcatcgccgacgaggacaccgtcactggcttcttgatggccggcgttggcaatgttgatctgcgcaagaaaaccaattacctcctcgtcgacaacaagacgacagttaaacaaatcgaggacgcgttcaaagaatttactgcaagggaggatattgctattgtgctcatcantcagtatattgccaacatgataagatttctggtggatagctacaacaagccagtccctgctattctggagatcccatccaaggaacatccatatgatccagcgcacgactcggtgctgtctcgagtgaagtatctcttctctgcggaatcggggggcctgaaaagcaatgaaagcatccttgtggagaagaaccctttggggaatctgtttggttaaggattgaaaaaaagtggcatggcgtccaaccgaaaccgccaaaaattattatgggtggtgaacccaaaccaaccctn

SEQ ID NO: 48176 - protein, 145 aa, Zea mays
  misc_feature: Ceres CLONE 1456691-F
  misc_feature (15)..(115): Pfam Name: ATP-synt_F Pfam Description: ATP synthase (F/14-kDa) subunit
  misc_feature: SWISSPROT Homolog: EC 3.6.3.14 H(+)-transporting two-sector ATPase
  misc_feature (74)..(74): Xaa is any aa, unknown, or other
MAGRTNIPTNNSALIAIIADEDTVTGFLMAGVGNVDLRKKTNYLLVDNKTTVKQIEDAFKEFTAREDIAIVLIXQYIANMIRFLVDSYNKPVPAILEIPSKEHPYDPAHDSVLSRVKYLFSAESGGLKSNESILVEKNPLGNLFG

SEQ ID NO: 48177 - DNA, 702 bp, Zea mays
  misc_feature: Ceres CLONE 1456692-F
  misc_feature: Encodes the peptide sequence at SEQ ID NO. 48178
ggagctccccgcggtggcggccgctctagaactagtggatcccccgggctgcaggaattcgcacgagaccattacctagaacatcctaatcgaaaaatcgaacccccgccaccaccagtccagcagcaccaggccagacaggcacacctcgaagaacaagagctggtcctcctggtaataagcgagagagagagagaggccaatggcagccaagtggtggctcgtcgcctccctgctgctctgcctcgccgtcgcatcggcggcggcaagagcaacgccccgcgactgcgacactactgccgccttcgcggcgggcgacggcagtgccggcgccgtggacgaggacgacgagcaggccaagaccgccgacgtgttcggtgggcggaccggcggcggcggcctcttcggcggcgtccacggcccgctgggcggcggcgtcgctgggttcggcccgttcggcggggccgtcgccggcgcgggcccgttcggcgggttcggaggcggcggcggcctcggtggcggaggaggaggatgaggaggacctggtggcgccggcctcccgtgagtcttggacaacgctgttgatggccatggatgcctgcctgcgtgcgcgtgtaataaggggtggctgaactcctgtactgtacgtacctgccgtgtgcctgtcccctcttgggaagaaagagtggggctcccttattg

SEQ ID NO: 48178 - protein, 110 aa, Zea mays
  misc_feature: Ceres CLONE 1456692-F
  misc_feature (1)..(108): Pfam Name: GRP Pfam Description: Glycine rich protein family
MAAKWWLVASLLLCLAVASAAARATPRDCDTTAAFAAGDGSAGAVDEDDEQAKTADVFGGRTGGGGLFGGVHGPLGGGVAGFGPFGGAVAGAGPFGGFGGGGGLGGGGGG

SEQ ID NO: 48179 - DNA, 751 bp, Zea mays
  misc_feature: Ceres CLONE 1456693-F
  misc_feature: Encodes the peptide sequence at SEQ ID NO. 48180
  misc_feature (646)..(646): n is a, c, t, g, unknown, or other
ctggagctccccgcggtggcggccgctctagaactagtggatcccccgggctgcaggaattcgcacgagaccattacctagaacatcctaatcgaaaaaaccatgatttgcctcaaagccatctcatcccctctccacctcccgaccttccgccgcctcacccccacctcctccctccgcgccgccgccgccatgtcctcctcctcgtccgcggtcgccgccccgatcgagcacttcgtgctcttcaaggcccgcccggaggcggtggcctcgggcgccgcggcggcgatggtctcctcgctgcaggcgctggccacgctcgtcccgggcctggcctacatccacgcaggaccggtgctccgcctccgatccccggccgcggaggcgctgggccccacgcacctcctccacacccgctacgccaccaaggaggacctggcgtcctacgcggcgcacccggcgcacgtggccgccgtgcaggggcacgtcctccccaacgcgctcgacatcaccgccgtcgactgggtcaacgccgcgccgctcccgtcccccgtggcccccggcagcgccgtgcgcctcacgctggcaaaggtgaaggaaggggtggaagtcgcgcagctcgtggagaaggtgccgcggcgaccangccgccggggacgaccagtgagctttcgggagacttttcccccggcgcggccaggggtacagttcgggatggtgcggtgttcacagcgtggagaactggacgcgt

SEQ ID NO: 48180 - protein, 216 aa, Zea mays
  misc_feature: Ceres CLONE 1456693-F
  misc_feature (42)..(143): Pfam Name: Dabb Pfam Description: Stress responsive A/B Barrel Domain
  misc_feature (182)..(182): Xaa is any aa, unknown, or other
MICLKAISSPLHLPTFRRLTPTSSLRAAAAMSSSSSAVAAPIEHFVLFKARPEAVASGAAAAMVSSLQALATLVPGLAYIHAGPVLRLRSPAAEALGPTHLLHTRYATKEDLASYAAHPAHVAAVQGHVLPNALDITAVDWVNAAPLPSPVAPGSAVRLTLAKVKEGVEVAQLVEKVPRRPXRRGRPVSFRETFPPARPGVQFGMVRCSQRGELDA

SEQ ID NO: 48181 - DNA, 770 bp, Zea mays
  misc_feature: Ceres CLONE 1456698-F
  misc_feature (476)..(476): n is a, c, t, g, unknown, or other
  misc_feature (478)..(478): n is a, c, t, g, unknown, or other
tggagctccccgcggtggcggccgctctagaactagtggatcccccgggctgcaggaattcgcacgagaccattacctagaacatcctaatcgaaaattgttccaaatggagaaaacttccaatagatgccctgttgccctccaaatggacctgctttgacaataaatgggattcagaaaggtcttcttgcgaacctgcacaggaaataagtttggaggagcttgcagaactcattcctataaaacctggaaaaaagcccagattgaagatagaatctgatgctattgatgcttcagatgggctggacacgcttgcaaaccttgcaattcttggtgaaggtgaagcgctcccttcgcagccaacaacaaaacatccccgccaccgtcccggctgctcatgcatcgtctgcatccaaccaccaagtgggaaaggtcaaaagcacaagcagacatgcacctgtaacgtttgtatgacngntcgccgcccgttttagaaactcatgcctcaacccaaaaaaaaggaacaaaaaatccttccccaagaaaaaacgggccatccagtgaaaaggtccaaaaaaagccgggtccggcccccaggaaccaattggatgggcacccaatccccccaaaacaaaatgaaattttaacccccccaaaaattggcctccaaaaaaagggaaaccccccccccccaagaaccccctgtgcccgaaatttcacgcggagggggaaaaagagaccccccaaaattgggggggggggtttttaaa

SEQ ID NO: 48182 - DNA, 803 bp, Zea mays
  misc_feature: Ceres CLONE 1456707-F
  misc_feature: Encodes the peptide sequence at SEQ ID NO. 48183
ctccccgcggtggcggccgctcttttctagtggatcccccgggctgcaggaattcgcacgagaccattacctagaacatcctaatcgaaacttttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaaagagcagttcccgtggacctactccgccaaggagacgtgctacctgctgcaggggagggtgaggtgtaccccgaaggccacgggaggagttcgtggagatccgcgcggggaaactggtcgccttccccagggcctgaacttgacttggaccccccccaaggccgtcaaaaagcaataaaatttcaatgtaccgccgccccccaaaaagccttgggggcttaaagggaaaattgggggggcctttggccccaaacactaggaggccccctcccaaatataaccacccgtgataaaaaccccccggattgggggacaaagggggtttattttttgtttaaaccccctcttggggtgttgggaaaaacaccccaaattttttccccaaaaaaaaaaaaaaaaaactttttttctcccccccccgcggggggggggcgggccccccccctcccccccaatgggggggttaattcccgcccccccgccgggcctttttatacacgcccgggggggaaaaaacccgggcccccccacataatttttgggcgcccccccc

SEQ ID NO: 48183 - protein, 92 aa, Zea mays
  misc_feature: Ceres CLONE 1456707-F
  misc_feature (19)..(93): Pfam Name: Cupin_3 Pfam Description: Protein of unknown function (DUF861)
MATEKLGIKVERNPPESRLSELGVRQWPKWGCEKEQFPWTYSAKETCYLLQGRVRCTPKATGGVRGDPRGETGRLPQGLNLTWTPPKAVKKQ

SEQ ID NO: 48184 - DNA, 760 bp, Zea mays
  misc_feature: Ceres CLONE 1456712-F
  misc_feature: Encodes the peptide sequence at SEQ ID NO. 48185
atagctggagctccccgcggtggcggccgctctagaactagtggatcccccgggctgcaggaattcgcacgagaccattacctagaacatcctaatcgaaaactagttctttctttcctggcagcgacaactgcgcagcggcgccgccaccggacgtcagatctccgttgggtgtttgatggcgatgagcacctgtcaggtactctaaggccactttctctcattaaggtagtactgagttcattgcatgactatgacttctgaagatggagacattttggctcttctgtctgagccaagcctaaaggaagagcaacttgaggcttctgaatctgatgctatgttttctgcaattatgaaagccattgaatcaaataagaatggagttgaagtttcccctgaggaagctgcccccccacattcatgcttcgtgcagacttctgaactgtcatatgatgactggggagcgatgaggagtatgctgcttgatgcccctcaaaagcccacagaaagttctcatgatacttccaaaggggccttaatgcaatctcagagggcaaaactcactccccttcctggttgaaactttttcgagcatggccacctccacttgaagcaaataaccatccccatgatgacagggatgggctctaactttttaaattgctgatgaacccaaacttgaagccaaaatggtaagcaattgttattttgtttccaaaccttgtggagacttggcccttagcaaacctctcctcgg

SEQ ID NO: 48185 - protein, 111 aa, Zea mays
  misc_feature: Ceres CLONE 1456712-F
MTMTSEDGDILALLSEPSLKEEQLEASESDAMFSAIMKAIESNKNGVEVSPEEAAPPHSCFVQTSELSYDDWGAMRSMLLDAPQKPTESSHDTSKGALMQSQRAKLTPLPG

SEQ ID NO: 48186 - DNA, 764 bp, Zea mays
  misc_feature: Ceres CLONE 1456713-F
  misc_feature: Encodes the peptide sequence at SEQ ID NO. 48187
  misc_feature (614)..(614): n is a, c, t, g, unknown, or other
tggagctccccgcggtggcggccgctctagaactagtggatcccccgggctgcaggaattcgcacgagaccattacctagaacatcctaatcgaaaaaaacaaggagcgctacatccaggccagcagtttccatttgcaatccgaccccatcttcatcccgttgtcgcagcagcagccatccaagcagcgatggacggcggcaagaagagccggaacccgcacaaggcctccgcggactaccgcagcgaccgcaagtcagcctccgggatgagcggcgaccccaagaagggcggccgcggcggcaagttcacctgggagggcgccgacgactacggctacggctacgccgacgaggacctcggcctcatctccaagaaaggcaacatcaacagcggacgcgctagccacccccatggaggcgccgccggctagaaggacgacgacgagtaggccctcgcgcctcggctcgcccgccccggccccgtcgatcgccaggaagaaccacaagcccttctggctggttaattcaggatcagttccattctcagggtgaaaaaccggaacaggggggttaggggcccggccccccaaaatgaaggggacccccggcttncccaaagcaacccacaaacccctggggtaaaaacgggcccgggagggccggaaaaacccttctaattgtccccccgggcacttttgccggggggggggcccccccggaaagggggccggggaaaaaaaaaaaaaaaaaaacttttctccc

SEQ ID NO: 48187 - protein, 80 aa, Zea mays
  misc_feature: Ceres CLONE 1456713-F
MDGGKKSRNPHKASADYRSDRKSASGMSGDPKKGGRGGKFTWEGADDYGYGYADEDLGLISKKGNINSGRASHPHGGAAG

SEQ ID NO: 48188 - DNA, 812 bp, Zea mays
  misc_feature: Ceres CLONE 1456717-F
  misc_feature: Encodes the peptide sequence at SEQ ID NO. 48189
  misc_feature (426)..(426): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (565)..(565): n is a, c, t, g, unknown, or other
  misc_feature (674)..(674): n is a, c, t, g, unknown, or other
  misc_feature (676)..(676): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (690)..(690): n is a, c, t, g, unknown, or other
  misc_feature (692)..(692): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (717)..(717): n is a, c, t, g, unknown, or other
  misc_feature (781)..(781): n is a, c, t, g, unknown, or other
aaagctggagctccccgcggtggcggccgctcttccaatagtggatcccccgggctgcaggatttcgcacgagaccattacctagaacatcctaatcgaaaagtttttccccttcgcgtatcttcgtccgccgcaacccttcacgtatcgtctctctctcacaagggaataccctgacctcccccctccccctcccagaaaagacccctcgaaaaacagcggcgctgctacatggcggaggtcgaggctccagctactgcgggccaggctccaactgctgcggtcgcgacgacgacccctgaagtggcggccccccaggccggaaccgctacggaggcaaaaggtccgaattatttttattgggtgggtcccccccggttggggggggggggggggaggggggggtggggccccccccacaaaccncccctcaaaaaaggcccaccccttcccacccccnnnaaagaatttctgcaccgtgggtgaaacaaaatttttttctcccacccacttttcctgggaaatgactaatttttcacctatttcaaaggtgggtattattggnaaaaatgggaaaaaacccccaatgtgggttttattttcccgctaaatcattaagggcagggccccggtaaccaaatatcaccccatttttagaggtataaaatataagntntttcnnnnnnnnanangatggcgatgcgttnnnnnnnnngnaaaaaacctgtgccctatccccaaattaaactttttttgaaacatatcacactttttctcgctntgtggttataccccaaaagacacccccctct

SEQ ID NO: 48189 - protein, 84 aa, Zea mays
  misc_feature: Ceres CLONE 1456717-F
  misc_feature (77)..(77): Xaa is any aa, unknown, or other
MAEVEAPATAGQAPTAAVATTTPEVAAPQAGTATEAKGPNYFYWVGPPRLGGGGGRGGWGPPHKPPLKKGPPLPTPXKEFLHRG

SEQ ID NO: 48190 - DNA, 799 bp, Zea mays
  misc_feature: Ceres CLONE 1456722-F
  misc_feature (20)..(20): n is a, c, t, g, unknown, or other
  misc_feature (36)..(36): n is a, c, t, g, unknown, or other
  misc_feature (37)..(37): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (310)..(310): n is a, c, t, g, unknown, or other
  misc_feature (422)..(422): n is a, c, t, g, unknown, or other
ttggtctccccacccccccntactcaaatatccaannaaannncnnncaaaactggaactccccgcggtggcggccgctctagactagtggatcccccgggctgcaggaattcgcacgagaccattacctagaacatcctaatcgaaaaagcctggaacatgttattgtcgagtcggcaagaaaggaatagataccagagaaattcctggcgtgaaccacgggtgttgttcacatttggtaccagagccaatactggatcctccacacgggtactggacgagatcgcaatcgaagttgggcggcgtggcnccagcgaagacggacgatcctttgtcccagcttctggcgaagatcgaggagggaaacaaggagactcaccgacgcatggaggcgattcagggggcggtgggaaatatggagncggcggtcaaggtggtgatgacggattaaggacacccctatgccccccaaaccggaagtggaagcgaaagtgacggagatttctgatgctctaaaggcgatccaaatcctcatgggaaagatggagaagaagccgctcggtttcgggtcgggacaggaagaatagggaaaagacggatttctgaagccgccaccatctgattcttcgaaatttggactttccgtctcggaagaaggggggaacccaattcccgcatgtagttattggggcatgaagtgggatcccagcagtacaatcccaagtcaagggggatttgggccaacaatcggggcggtcatttccaaaataaaggaaaccgcccgcgttactttgggggg

SEQ ID NO: 48191 - DNA, 774 bp, Zea mays
  misc_feature: Ceres CLONE 1456727-F
  misc_feature: Encodes the peptide sequence at SEQ ID NO. 48192
  misc_feature (376)..(376): n is a, c, t, g, unknown, or other
gagctccccgcggtggcggccgctctagaactagtggatcccccgggctgcaggaattcgcacgagaccattacctagaacatcctaatcgaaaaggcgaaattcgcaatattcattcatcagtaaccaaaatttcgagtttttttaaatacactataaccgagagcctgaaaatgggaacaaactagcaactgaagcgtaccaacaaaaaacgcccgattcgcctcgcaaaatcgccgccgccatcgcctactccaccagacgccgatagttccgccttcctttcctgctgcgcgcctgtcgccatggtgaagcggtggcttcccctcgaggccaaccccgacgtcatgaaccagttcatgtggggagtgggggnccccgaggacgtggggttctgcgacgtgtacggccccccccaccagttgctcgccatggtgccccacccggtgctcgcggtcctacttctctacccccaggaccggagcaaggagccccaagcttcagctacctcgtcggtggagaccaaggagcccagcaagaacgtatatttcacaaagcaaactgttgggaatgcctgtggcacaggtggtattattcatgccctgggggaaggctacttccagaatcaaggttaggtgagggggccatattttgatagattttaaaaaccaacctgctggacatgggatcctaatcacgcgtggttgtcttttcttggaggaggaccaaggaaaatggaacaatgctccattccaattgccccctacttggtgg

SEQ ID NO: 48192 - protein, 109 aa, Zea mays
  misc_feature: Ceres CLONE 1456727-F
  misc_feature (4)..(110): Pfam Name: Peptidase_C12 Pfam Description: Ubiquitin carboxyl-terminal hydrolase, family 1
  misc_feature: SWISSPROT Homolog: EC 3.4.19.12 Ubiquitinyl hydrolase 1
  misc_feature (24)..(24): Xaa is any aa, unknown, or other
MVKRWLPLEANPDVMNQFMWGVGXPEDVGFCDVYGPPHQLLAMVPHPVLAVLLLYPQDRSKEPQASATSSVETKEPSKNVYFTKQTVGNACGTGGIIHALGEGYFQNQG

SEQ ID NO: 48193 - DNA, 905 bp, Zea mays
  misc_feature: Ceres CLONE 1456732-F
  misc_feature: Encodes the peptide sequence at SEQ ID NO. 48194
  misc_feature (19)..(19): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (421)..(421): n is a, c, t, g, unknown, or other
  misc_feature (423)..(423): n is a, c, t, g, unknown, or other
  misc_feature (425)..(425): n is a, c, t, g, unknown, or other
  misc_feature (459)..(459): n is a, c, t, g, unknown, or other
  misc_feature (465)..(465): n is a, c, t, g, unknown, or other
  misc_feature (466)..(466): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (483)..(483): n is a, c, t, g, unknown, or other
  misc_feature (484)..(484): n is a, c, t, g, unknown, or other
  misc_feature (584)..(584): n is a, c, t, g, unknown, or other
gatgggggaaaaaaaccancccacnnnnnnncaanannnnaaaaactgggactccccgcggtggcggccgctctataactagtggatcccccgggctgcaggaattcgcacgagaccattacctacaacatcctaatcgaaaaatccaatccaaatcaccaaagcggcagtgcgtacagaggatcgtcgaacagaacaccatgaagatggtcatcgttctcgtcatgtgcctggctctgtcagctgccagcgcctctgcaatgcagatgcgctgcccctgcgcggggctgcagggcttgtatggctctagccccggcctgacaactatgatgggcgccggcaggctgtgcccctacgcggagtacctgaagcagccgcaaagcaacccgttggggttggcttccttattattgtgtttttntnancagtcgagtgttatgattaagttgttagaaagcnaccccnncccacccnnnaaaaaannaatgaaggaacatgcaatcccttctcccgcaccacccccaccacgaagaatgcacctttgaaccatgcccgttgcccccccgacatccagccttggtccnaacccagcttttagatgtaattatacatcatacaaactgttacgccgacccaaggagagtaccacccccaatggcgcttcaatcaatggtgacaaaaaaattgaccaggcccagggggtagggagatcagagacaattacctaattaggcccaatatacccgctacaccagtccctcggttgactgtcccccagctcgccaatttcccgccccgaaccaccgggatactcgtggatattgtacgaggtaatttggccctctatcccgatccatgtctttgattccactgttgcgtcgcttattgccgtgtatgggatcaac

SEQ ID NO: 48194 - protein, 114 aa, Zea mays
  misc_feature: Ceres CLONE 1456732-F
  misc_feature (74)..(74): Xaa is any aa, unknown, or other
  misc_feature (75)..(75): Xaa is any aa, unknown, or other
  misc_feature (87)..(87): Xaa is any aa, unknown, or other
  misc_feature (89)..(89): Xaa is any aa, unknown, or other
  misc_feature (92)..(92): Xaa is any aa, unknown, or other
  misc_feature (95)..(95): Xaa is any aa, unknown, or other
MKMVIVLVMCLALSAASASAMQMRCPCAGLQGLYGSSPGLTTMMGAGRLCPYAEYLKQPQSNPLGLASLLLCFXXQSSVMIKLLESXPXPPXKKXMKEHAIPSPAPPPPRRMHL

SEQ ID NO: 48195 - DNA, 841 bp, Zea mays
  misc_feature: Ceres CLONE 1456733-F
  misc_feature (377)..(377): n is a, c, t, g, unknown, or other
  misc_feature (380)..(380): n is a, c, t, g, unknown, or other
  misc_feature (443)..(443): n is a, c, t, g, unknown, or other
  misc_feature (444)..(444): n is a, c, t, g, unknown, or other
atagctggagctccccgcggtggcggccgctctagaactagtggatcccccgggctgcaggaattcgcacgagaccattacctagaacatcctaatcgaaaacttctggttctgcgtgttctatctgcaatcaacgacggcgcgtctcgacggtactgctaattagcctcctagccagcctccgcctggaggtccatccccgacctcgacgcttcccggccaaacgccgacgcccctcaccctcggcgcagcgccgcagcgtcgcggtgctccatacccatccccctccatggccggcgactgcatcccccggcatcgcggggctggatcccctccctctctcgcgttacgcttgaattcgagaaggggaaaaaccnacntaggggttcggcaaccaacccttttgtgtcccccccccccccttttgaaatggtttttctttnnttttggtgtgtaattcaaaatggcaaccctttcaaaaccttatttgttgaaggggtttgggaaaaagggttctttaaaaaaaggctccctctaaagcgcgggaaagccccccggcggcggggttgttactggttccccagggggccaccaattttataactctctgtggacggaggggcgcgtcttctaatttttctcccggtgtagatgcgcgcccgaccacaatcttgtcatatctcgcgcaacccgagggggaccactttccccgtgtactctctcctctgttggggggtcgatctctctgcgatctagaaatatggtgggtgtcgctccccccctggtgtctctgtcataggtgggcgccactcgtctaaatctgcgtattcgctcgcgccct

SEQ ID NO: 48196 - DNA, 800 bp, Zea mays
  misc_feature: Ceres CLONE 1456734-F
  misc_feature: Encodes the peptide sequence at SEQ ID NO. 48197
  misc_feature (380)..(380): n is a, c, t, g, unknown, or other
  misc_feature (438)..(438): n is a, c, t, g, unknown, or other
acccgcggtggcggccgctctagaactagtggatcccccgggctgcaggaattcgcacgagaccattacctagaacatcctaatcgaaaagacttgcgcgtcttctgcaaggccggcggaaaggactacagcctcgcggtgcgcaacgggacggcgtgcctggcgcccaccagcccgcgggacgagtaccagcactggggcaaggacatgcgccacaccacccgggtgagggacgaggagggctacccgcccttcgcgctcgccaacaaggtcaccggtgaggagctcaagccctccccggggcaggacccccccgatcagctcatgccctaaaaccaggaattccgggaagaggtggtggcacaggaacaaaaaacccnacactcggaaattcacccccctcctggtgtttgttttgtttggccccccccccccccncaaaaccaaccaaagaaaaaaaagtcccccgagaggccccattggccttacccaaatctcggcatcttaaaatgttctgaaaggctacaccaccccctcttaaaatacccacctcgggtcaaccattcaactaacgaaataaaactgggcgcgccctcatttataattgccgtggtctggtgcccacccccgggagcccacaagcgcgcgcgcgaagatcactctcggtaacccctcctaggtggtgtagtagccaaaaacaaccccaaaactcttgtgcggtaggtgtatccacagaatatgtaccctactttttcacaccccccacaagagtgtcgcggggttgtaggccccccacacag

SEQ ID NO: 48197 - protein, 110 aa, Zea mays
  misc_feature: Ceres CLONE 1456734-F
TRGGGRSRTSGSPGLQEFARDHYLEHPNRKDLRVFCKAGGKDYSLAVRNGTACLAPTSPRDEYQHWGKDMRHTTRVRDEEGYPPFALANKVTGEELKPSPGQDPPDQLMP

SEQ ID NO: 48198 - DNA, 844 bp, Zea mays
  misc_feature: Ceres CLONE 1456736-F
  misc_feature (16)..(16): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (421)..(421): n is a, c, t, g, unknown, or other
attacttcccaccccnccacccacaacaanaaannnnnnnnnncnaaaaactggaactccccgcggtggcggccgctctataactagtgcatcccccgggctgcaggagtacgttgtacaactttgcataaagcatcctatattaaaaaacgtggactccaatgtcgaagggcgaaaaaccgtctatcagggcgatggcccattatgtgaaccaactccctaatcaagttttgtggcctggaggtgccgtaaagcactaaatcggaaccctaaagggagcccccgagttagagcttgacggggaaagcccccaaactcggcgagaaaagaagggaaaaaagcgaaaggagcgggtcctaaggcgctggcaagtgtaacgagcactctgaacgtatgcaccaaactcgtcgcgtttaatttnaacactacagggagaggcaggtggccatttttcagatgccacccaccaccacaaacactattggtttatattttctaagtacgttcaaatatgtatcccggtcttgagacaatacacctctataaattgcttctcttaattttgtaaaaatggatgagtatgaagtattgtaaagtttacttggttcggcccttattccctttttttgggggcatttttggcttgccgtgttattagatgcccctcccaatgggttgggagtaaattaaattgaatgctggaaaaataattttttggtgccatgatgtgcttttataatactaatatgtggttctctaaccattggctctagattcccttgaatgggtttttctcgctccgaaagaattggttttttcccttggtatgatagtttttttttta

SEQ ID NO: 48199 - DNA, 792 bp, Zea mays
  misc_feature: Ceres CLONE 1456749-F
  misc_feature: Encodes the peptide sequence at SEQ ID NO. 48200
  misc_feature (358)..(358): n is a, c, t, g, unknown, or other
  misc_feature (402)..(402): n is a, c, t, g, unknown, or other
  misc_feature (478)..(478): n is a, c, t, g, unknown, or other
  misc_feature (479)..(479): n is a, c, t, g, unknown, or other
  misc_feature (482)..(482): n is a, c, t, g, unknown, or other
ctggagctccccgcggtggcggccgctctagaactagtggatcccccgggctgcaggaattcgcacgagaccattacctagaacatcctaatcgaaaaactgaacgagcactcgcctgcgctcttctctctctcgtggcgacgactgggtgaccgccggcgccccaggcctgaggcctccatcttcgggcccttcactggctacgagcaccaccagaggattatggattggctggggcagaagcgcgcggagatgctgatgcaggtgctgctggtggcgtctgctgtggcggcgttcctggtgggctacgtgcgcgcggacttccagctcatgctgctcgtctacgccggcggcgtcntgctcacagcgctcgtcaccgtccccaattgggccttttctcancgtaccccgctcaagtggctcgacgctgccgaggccgaagcgcaccccgggcccccagggtcaaccccgtgcgggnnccngggggaaagaaaaaatcgggaaaaaaaagttatcaatctttcggagcgaattgggctcctttgccattggccccaaccctttttagtgtttttttcccaaactttcccttgtaaaaaaggttgggggttccaaaaaaaaaaaaaaaaaatttttttttccccgccccctcggggggggggccgggcccccattcccccccaaaggggggctaataacccccccccccgcggcgcgtttttttacacggggggaggagaaaccccgggggtcaccaaaatattgcgggggggaccccccccttttgggggc

SEQ ID NO: 48200 - protein, 190 aa, Zea mays
  misc_feature: Ceres CLONE 1456749-F
  misc_feature (1)..(80): Pfam Name: SPC12 Pfam Description: Microsomal signal peptidase 12 kDa subunit (SPC12)
  misc_feature (46)..(46): Xaa is any aa, unknown, or other
  misc_feature (60)..(60): Xaa is any aa, unknown, or other
  misc_feature (86)..(86): Xaa is any aa, unknown, or other
  misc_feature (87)..(87): Xaa is any aa, unknown, or other
MDWLGQKRAEMLMQVLLVASAVAAFLVGYVRADFQLMLLVYAGGVXLTALVTVPNWAFSXRTPLKWLDAAEAEAHPGPPGSTPCGXXGERKNREKKVINLSERIGLLCHWPQPFLVFFSQTFPCKKGWGFQKKKKKIFFSPPPRGGGRAPIPPQRGANNPPPRGAFFYTGGGETPGVTKILRGGPPPFGG

SEQ ID NO: 48201 - DNA, 748 bp, Zea mays
  misc_feature: Ceres CLONE 1456752-F
  misc_feature: Encodes the peptide sequence at SEQ ID NO. 48202
  misc_feature (744)..(744): n is a, c, t, g, unknown, or other
aagctggagctccccgcggtggcggccgctctagaactagtggatcccccgggctgcaggaattcgcacgagaccattacctagaacatcctaatcgaaaaaagtcaacccgctctcgtctcccgggccctcgcctctctctgccgtctgcactgccgcctgccgcgcgcaaggacgcccatggctcgccacggccaagcgctgctcgccgcgctcctcgtgtccgcggtcggcgcagccagcgcgcagccgagctacgatgacggcggccagggccaggtcagcacggccatgatcgcgctcctggtcgccgtcatcgcggtgttcgtgttcatcgcctcattcaccgtctacctccgccactgcaccggctccgcggccacgtcggacgactacgaccgcgccagagccgtgcccaatttcgacgccttcatctcgcggtcgcggaggcagcggcggccgcgcgggctggacgccgaggtggtcgaggctttccccaccatgaagtacgccgaggccaaggcgctccgggtgggcaagggcggcgcgctcgagtgcgcagtgtgcctcagcgagttcgaggacgaggagcggctcaggctcttgcccaagtgcagccacgccttccacccggaatgcatcggcgagtggctcgccagccacgtgacctgccccgtctgccgctgcaacctcgaccctaacaagataccagcagcgatgaacagcggcccgacagtttcctgncgat

SEQ ID NO: 48202 - protein, 189 aa, Zea mays
  misc_feature: Ceres CLONE 1456752-F
  misc_feature (126)..(167): Pfam Name: zf-C3HC4 Pfam Description: Zinc finger, C3HC4 type (RING finger)
  misc_feature: SWISSPROT Homolog: EC 6.3.2.19 Ubiquitin--protein ligase
  misc_feature (188)..(188): Xaa is any aa, unknown, or other
MARHGQALLAALLVSAVGAASAQPSYDDGGQGQVSTAMIALLVAVIAVFVFIASFTVYLRHCTGSAATSDDYDRARAVPNFDAFISRSRRQRRPRGLDAEVVEAFPTMKYAEAKALRVGKGGALECAVCLSEFEDEERLRLLPKCSHAFHPECIGEWLASHVTCPVCRCNLDPNKIPAAMNSGPTVSXR

SEQ ID NO: 48203 - DNA, 756 bp, Zea mays
  misc_feature: Ceres CLONE 1456772-F
  misc_feature: Encodes the peptide sequence at SEQ ID NO. 48204
  misc_feature (415)..(415): n is a, c, t, g, unknown, or other
  misc_feature (432)..(432): n is a, c, t, g, unknown, or other
  misc_feature (433)..(433): n is a, c, t, g, unknown, or other
aagctggagctccccgcggtggcggccgctctagaactagtggatcccccgggctgcaggaattcgcacgagaccattacctagaacatcctaatcgaaaaagccgtcatcgcttcacgtccgctacataccggcgaggagacgaaaggagggagttttgagaagcataaatggctcctaaagccgctcctgtcaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacctcagaatcagcactactggaagaaacaagcttgatcagtacccaatcctcaagtaccccctcaccacagaatctgncatgaagaagatttganngatacacactctggtcttttatgttgacctccaggcagaacagaaaaagatcaaggctgccgccaagagatgtttgactccaagcaaagaaagtcaccccctgatcaggcttgatggaaaaaaaaagctttattgaaattgaacccgaaataaatgcccttgaaggggccaacaaattggctcctctcagttaaagggcacgggagtccaacctttgtgcccaagttttgggaaaaccccaaaaaattttcttgtgtaaaaaaaattttgtgtgccaaataggggggtttttttgaaaaaaattttgggccgcaccaaaaaaa

SEQ ID NO: 48204 - protein, 86 aa, Zea mays
  misc_feature: Ceres CLONE 1456772-F
  misc_feature (11)..(64): Pfam Name: Ribosomal_L23eN Pfam Description: Ribosomal protein L23, N-terminal domain
  misc_feature (82)..(82): Xaa is any aa, unknown, or other
MAPKAAPVKKGDAKAQALKVAKAVKSGAGKKKTKKIRTSVTFHQPKTLKKARDPKYLRISTTGRNKLDQYPILKYPLTTESXMKKI

SEQ ID NO: 48205 - DNA, 798 bp, Zea mays
  misc_feature: Ceres CLONE 1456773-F
  misc_feature (372)..(372): n is a, c, t, g, unknown, or other
  misc_feature (374)..(374): n is a, c, t, g, unknown, or other
aagctggagctccccgcggtggcggccgctctataactagtggatcccccgggctgcaggaattcgcacgagaccattacctagaacatcctaatcgaaaaaggagaccttgcagaggagcgaagcaagcaaggtgggaaagaggcagcagcaagggcggcgggctgccggaaggggaacatgctccctcctcatctcacagtacgaactgaaaaacaagagtaaagaatttccgtgagatgagacagaatggcgcggtgatgattcagtttggccatcagatgcctgattacgactccgcggctacccagtcaaccagtgagacgagccatcaagaagcgtctggaatgagcgagaggagcctcaatgagnanaaaaatgaccattcaggcaaccttgatgggtactcgaaccacgacgaaaacaagatgatgtcagccgttatccctgggcaaatcgggaaacagtttacgccatttatcccaagccctgaccggactcagccccttccccatatcataccctttggccgaatcctactacccgggcgccgggggaaagagtttatggcccgtatgctattctggcccccccagggggtgggagggggcccccctcccagaaggcccgggccaataagaccccccgttgaaaaacccctttttgtgcaccgagagacggcccccccttttctcccgaaaaaaaaccccccccgtaaaactataggggcgaaaacaacccccgaaaaaaccccagccgcccctccccaaaaatttcggtctccgcccacaaaaaaaa

SEQ ID NO: 48206 - DNA, 770 bp, Zea mays
  misc_feature: Ceres CLONE 1456776-F
  misc_feature: SWISSPROT Homolog: EC 2.4.2.10 Orotate phosphoribosyltransferase
  misc_feature (169)..(169): n is a, c, t, g, unknown, or other
  misc_feature (172)..(172): n is a, c, t, g, unknown, or other
  misc_feature (357)..(357): n is a, c, t, g, unknown, or other
  misc_feature (358)..(358): n is a, c, t, g, unknown, or other
  misc_feature (366)..(366): n is a, c, t, g, unknown, or other
  misc_feature (367)..(367): n is a, c, t, g, unknown, or other
gctcttgaactagtggatcccccgggctgcaggaattcgcacgagaccattacctagaacatcctaatcgaaaacatcgaggacctcgtcaccagcggcgcctccgtgctcgagaccgccgcgcccctccgcgccgaggggctcgtcgtggcggacgccttcttcgtcntcnaccgcgagcagggcgggagggagaacctcgcggccaacggggccccgctgcactcgctcatgacgctcaccgaggtgctcgccgggttgctccgggacgggagggccaccgagggaaaaggccgcccaggggaagcgtttttaaaatgcccaccggaaggcctccggtgtcgggtgccccccaannaagggggnncaaaaaaaaattttttttgtatgttcccccccctggccacccaccccccggggggaaaaaagtggttcagcgcgcatggggcccctgctccaccccccctaggtatcccggtggagggtggtggtcgtcctagtgcggtctctcgggcttgttgtatagtctgggcctttggtgcttgcctctgcccatccgccccgctcgttctctttcccccattcctcccttcttgttgggcgtcttggtctccccttctccgcccgacaccatccctcccttttgtctatgttgcgtgctccctcgttccttgggcactctggttctgctccatctacgctcgctgctatcccgctgcgctgtgtgtgcgctgccgttctacgctctgttcgctctcctttcttctctc

SEQ ID NO: 48207 - DNA, 722 bp, Zea mays
  misc_feature: Ceres CLONE 1456780-F
  misc_feature: Encodes the peptide sequence at SEQ ID NO. 48208
  misc_feature (410)..(410): n is a, c, t, g, unknown, or other
  misc_feature (645)..(645): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (702)..(702): n is a, c, t, g, unknown, or other
  misc_feature (703)..(703): n is a, c, t, g, unknown, or other
ggagctccccgcggtggcggccgctctagaactagtggatcccccgggctgcaggaattcgcacgagaccattacctagaacatcctaatcgaaaactgagcagccttccaagtttgatttttatgatccaaaaacacctttcttcactgcaccccgatgcttgcctccgacgcaattggacaagtgcaagatgaaagatgcatttatctcagatggttgcttactgagagaatgcaacatcgagcattctgtgattggagtctgctcacgtgtcagctctggatgtgaactcaaggactccgtgatgatgggagcggacacctatgaaactgaagaagaagcttcaaagctactgttagctgggaaggtcccagttggaataggaaggaacacacacatcaggaactgnatcattgacatgaatgctaggattgggaagaacgtggtgatcacaaacagtaagggcatccaagaggctgatcacccggaagaaggggactacataagggctgcggaacccggggggatcttgagaatgccacccttcacgatgggtctgtcctaaaaaaaagccggctgcgttggctcaacaaacagaacaccccaaatgggatttggcccccacgatgatcgtgtaacttggnatggatgaaaaacccttgannnngagaagcannnnactcgcgcgccaatacttgtgnntttgtggtttcctgacctt

SEQ ID NO: 48208 - protein, 124 aa, Zea mays
  misc_feature: Ceres CLONE 1456780-F
  misc_feature: SWISSPROT Homolog: EC 2.7.7.27 Glucose-1-phosphate adenylyltransferase
  misc_feature: The sequence is a functional homolog of SEQ ID NO 37 in US patent 7312378
  misc_feature: The sequence is a functional homolog of SEQ ID NO 38 in US patent 7312378
  misc_feature: The sequence is a functional homolog of SEQ ID NO 39 in US patent 7312378
  misc_feature (73)..(73): Xaa is any aa, unknown, or other
MKDAFISDGCLLRECNIEHSVIGVCSRVSSGCELKDSVMMGADTYETEEEASKLLLAGKVPVGIGRNTHIRNXIIDMNARIGKNVVITNSKGIQEADHPEEGDYIRAAEPGGILRMPPFTMGLS

SEQ ID NO: 48209 - DNA, 748 bp, Zea mays
  misc_feature: Ceres CLONE 1456785-F
  misc_feature: Encodes the peptide sequence at SEQ ID NO. 48210
aagctggagctccccgcggtggcggccgctctagaactagtggatcccccgggctgcaggaattcgcacgagaccattacctagaacatcctaatcgaaaactctagcttcccactccgctcggccaccagctttgaccgcctcccctcccctccgctccgctcctgttcctccataccccactcccccgcaggagcggcgcggcggcggcaaaggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggtggtggtggatcccatgctgatccatttgacattttctcatcattctttggaccctcttttggaggaggtggtggaagcagcaggggaagaaggcaaaggaggggagaagatgtagtccactcacttaaagtttctctggaagaatctttacatggaatctcaaagaagctctctctttcgcgcatgtcatctgctcaagtgcaagggcaggggctcgaagtctggtgcttcatgaggtgccctggggtgcaggctcaggtataaagtcacatt

SEQ ID NO: 48210 - protein, 170 aa, Zea mays
  misc_feature: Ceres CLONE 1456785-F
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGGGGSHADPFDIFSSFFGPSFGGGGGSSRGRRQRRGEDVVHSLKVSLEESLHGISKKLSLSRMSSAQVQGQGLEVWCFMRCPGVQAQV

SEQ ID NO: 48211 - DNA, 740 bp, Zea mays
  misc_feature: Ceres CLONE 1456786-F
  misc_feature: Encodes the peptide sequence at SEQ ID NO. 48212
  misc_feature (562)..(562): n is a, c, t, g, unknown, or other
acagctggagctccccgcggtggcggccgctctagaactagtggatcccccgggctgcaggaattcgcacgagaccattacctagaacatcctaatcgaaaaaaaaaattccacaaccgaaacctgcagtcgggtcatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgaaccatcaccggcatttctgggagcacttgaaaactggaccaagcattactgatgcagncatgagcaggatcctccaggtccacaaagtcattgcagaaggtggatatgaaaaaattttccttcaaattttgagaggccccctggggaaaagctcagaacccattgcttgttacctgcaacctcgctgggccggtagggggggcttaacccggccagggaaaacggcattttgaaaa

SEQ ID NO: 48212 - protein, 113 aa, Zea mays
  misc_feature: Ceres CLONE 1456786-F
MNPPAAAASTGAGGHAAAPAAAREYVHYPRLSPEEVAPPPPPPYHAATAAPSAYGGNPYIYSPAGGAATSPKNTMDSVKDVLGKMGKRFGEAARKTEPSPAFLGALENWTKHY

SEQ ID NO: 48213 - DNA, 738 bp, Zea mays
  misc_feature: Ceres CLONE 1456787-F
  misc_feature: Encodes the peptide sequence at SEQ ID NO. 48214
  misc_feature (511)..(511): n is a, c, t, g, unknown, or other
  misc_feature (570)..(570): n is a, c, t, g, unknown, or other
  misc_feature (597)..(597): n is a, c, t, g, unknown, or other
  misc_feature (617)..(617): n is a, c, t, g, unknown, or other
  misc_feature (618)..(618): n is a, c, t, g, unknown, or other
  misc_feature (664)..(664): n is a, c, t, g, unknown, or other
  misc_feature (665)..(665): n is a, c, t, g, unknown, or other
  misc_feature (738)..(738): n is a, c, t, g, unknown, or other
aagctggagctccccgcggtggcggccgctctagaactagtggatcccccgggctgcaggaattcgcacgagaccattacctagaacatcctaatcgaaaagaaaccagctggattttcttcccacttcggtgtgctggtcgacgtggtcgtcctgtcccttctctcctctcgtctccacagtccacacacaccgtgtgcggcggtagctgctgctgcccgtgcctaccgaagaagacaagtccaacactgttgttctgttccgtgattgcggaatttgcttcaccacaccttcatcagagagccgagacgacacgctcgggacccagcaaggcaagaagaacacgagagagatagcaggcaccaggcagggatcaatcatccgtccatggagaacctaaaggagcggggccacgacgcggcgggcgccaacgcctggatgacggtgccggcgttcggggactgggacacgaagaacggcgcgctgccggactactccatggacttctccnagatccgcgagatgcgcaagcagaacaagaaggagctctcccgcgccagcctcggcggngagacgacctcctcgcctcacgccagncccaggccctgaagccgcanngcagtaacgccccgcccaagctcggccgccccccgccccggcccgnncgcgaacactccccaacgggagggaagaaagtcctgagctaccttccgttgtgtatcaaggcctgaagagtgn

SEQ ID NO: 48214 - protein, 73 aa, Zea mays
  misc_feature: Ceres CLONE 1456787-F
  misc_feature (42)..(42): Xaa is any aa, unknown, or other
  misc_feature (70)..(70): Xaa is any aa, unknown, or other
MENLKERGHDAAGANAWMTVPAFGDWDTKNGALPDYSMDFSXIREMRKQNKKELSRASLGGETTSSPHAXPRP

SEQ ID NO: 48215 - DNA, 692 bp, Zea mays
  misc_feature: Ceres CLONE 1456788-F
  misc_feature: Encodes the peptide sequence at SEQ ID NO. 48216
  misc_feature (373)..(373): n is a, c, t, g, unknown, or other
  misc_feature (374)..(374): n is a, c, t, g, unknown, or other
  misc_feature (584)..(584): n is a, c, t, g, unknown, or other
  misc_feature (591)..(591): n is a, c, t, g, unknown, or other
  misc_feature (611)..(611): n is a, c, t, g, unknown, or other
  misc_feature (645)..(645): n is a, c, t, g, unknown, or other
ggagctcaccgcggtggcggccgctctagaactagtggatcccccgggctgcaggaattcgcacgagaccattacctagaacatcctaatcgaaaagggagggatcatggtggcgccggacgtgaaggcggagacgatgaagctgatggatcagcggggtgccctagaggcggagatggacgccatcatcgcccgcctcactgcggcaggcggaccgggcatcaccggaggcctcgtcgacgccgagggtttcccaaggtccgacatcgacatcccgaacgtcctcgccccagcgccggaagcttgctgaattgcgaaatgacaccaggatgttacaaccaaaattggaaaaatcttgaaggttttaatttcnncaagttatcagggagtgaacactcacctcaaggaaatttggatcaacaaattcttccccctttggattattctcaaaggaacccttggaaaaggacccggggacggggctccctttgcgccggatggaaaaaaccccctgaaggggcccccgggtttcggggaagggttgcccttgggaaaaaaatttaaaagtttggaaaggggaaccnggataantttgaaggaagcgcccggtntaaaccttttccagggagaacgccaccttttttntctccctccccggggggcggggggaattattattttacggggggggg

SEQ ID NO: 48216 - protein, 67 aa, Zea mays
  misc_feature: Ceres CLONE 1456788-F
MVAPDVKAETMKLMDQRGALEAEMDAIIARLTAAGGPGITGGLVDAEGFPRSDIDIPNVLAPAPEAC

SEQ ID NO: 48217 - DNA, 847 bp, Zea mays
  misc_feature: Ceres CLONE 1456789-F
  misc_feature (674)..(674): n is a, c, t, g, unknown, or other
aacgctggagctccccgcggtggcggccgctctagaactagtggatcccccgggctgcaggaattcgcacgagaccattacctagaacatcctaatcgaaaaaatctctccgggtcctctctccgcattctccgtcatggctgagccgacgccgtcgcagtcgccagcgcagacgccgcccccgccgccgacgcagcagactcccgcggcgggtgggctcgaggacatgctggcgtgtgtggcggcgctggaagccgcgctgctgccgtgcctccccgcgcgcgaggtccaggccgtcggacggttcccttcagttcttcccaccaaaatggttgttgaagaggcccgcaagggaatttcgtgggaggttgcaaaggaaacccctaaccttaggtccaccacccctcccaacgcaaggaaaaaaccccccccccagaaaaagatcgctctcccaacgacaaatatcacaaatggggcggaaggagttcaaaaaagaagctctcttacgctctttgtccacgaccccaataagttctgtggtgggggggggcaaagggcgcctgtcggcgcccccgccgctgcgcccccgatcgccccccctctgccatggctgcggcggccggccccacccgcgggttcgtccctccgcgccgccgcctcccccccgcggccgnacggacgcgccgcactcgcccccccgccggccgacccacgccgccccaccgtccggcccgcccgcccgcgcgcgcgccgcgcggcgacgagccgccccgcgccggcccgcgcacgcgcgcccgccccgcgcgggcgagcggccccgcgcgaccccccctcgcccatcgccccg

SEQ ID NO: 48218 - DNA, 738 bp, Zea mays
  misc_feature: Ceres CLONE 1456795-F
  misc_feature: Encodes the peptide sequence at SEQ ID NO. 48219
  misc_feature (444)..(444): n is a, c, t, g, unknown, or other
  misc_feature (715)..(715): n is a, c, t, g, unknown, or other
  misc_feature (718)..(718): n is a, c, t, g, unknown, or other
ctggagctccccgcggtggcggccgctctagaactagtggatcccccgggctgcaggaattcgcacgagaccattacctagaacatcctaatcgaaaagaccgcatcttttctccgcgccgccgctcgcctgcacttctacgtgtgaaccgcgtccgcgcctatggcctgcccgtgcccagctgccccctctccacacgagcctctctaggcgtcaagcgtgccattaagcaaccgtggcccccaccccccccctcggttctctgcgtgagcacaagcacgtctctgtagcccatgttcaacggaagcgaaagtgccgctggaccacatacgattgtggagggtaaagaaggttgtgactttgcatcagcaaactacctcggtttaattggcaacgaaaagaatatttgattcttgcatcagttcattggaagaatatggtggntggttcttgtggtccacgtggcttttatggaacaattgatgtcccatcttgactgtgagtcaaagatagctaaattttttggggactcccgacctccattctttaattcatatgggatttctacaatattcagtgtgaacctgccttctgaagaaagaagtatcatagtcgctaactgtacatggtagtttgatgtgattgcggggacaaggtgttgactgtttggtgaatgcttgggacaatggcccacaagaaggagcctggaccctcnacnggaggtgcgcacaacaacga

SEQ ID NO: 48219 - protein, 38 aa, Zea mays
  misc_feature: Ceres CLONE 1456795-F
MFNGSESAAGPHTIVEGKEGCDFASANYLGLIGNEKNI

SEQ ID NO: 48220 - DNA, 674 bp, Zea mays
  misc_feature: Ceres CLONE 1456873-F
  misc_feature (419)..(419): n is a, c, t, g, unknown, or other
  misc_feature (420)..(420): n is a, c, t, g, unknown, or other
aagctggagctccccgcggtggcggccgctctagaactagtggatcccccgggctgcaggaattcgcacgagaccattacctagaacatcctaatcgaaaaatcaacccaacacggccgtccccgtcccgagtcaccaactcaccaccgaccctagcaaaaccgcacgcaccctgccagcggccccccaactcccaacccaacccctactccagctagcgcggcggctgcggccatggcgttccggctgagcacaacctgatcggggtcctcaacttcgtcaccttcctgctctccgtcccgatcctgggcgcgggcatctggctgggccaccgcgccgacggcaccgagtgcgagcgctacctctcggcgcccgtcatcgcgctggggggccttcctcctcgccgtctccctgggggnnctcgtcggggcatgctgccgcgtcacctggctgctcctggcctacctcctcggcagggtcgtcctcatcctcgtctctctttgggttaccggctttcccttttgtcgtcccaaaaaggggcccgggcaagccctttttcggccccgaaatcaaaggaaacccgccccggggaactaatccaaattgggtgcaaaaacccccttcaaaacacccggaacttgggaccggtacagggaattcccccccagaaaccc

SEQ ID NO: 48221 - DNA, 664 bp, Zea mays
  misc_feature: Ceres CLONE 1456895-F
  misc_feature: Encodes the peptide sequence at SEQ ID NO. 48222
aagctggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagaagcgcaaggagatcgtggagcgtgctgcacagctcgacattgtggtcaccaacaagcttgctaggctccgcagccaggaggacgagtagtctggtttcttgtcttaacgacgaactggatgttgccattcctttctgtagggaactactttgcttgtgtct

SEQ ID NO: 48222 - protein, 133 aa, Zea mays; identical to SEQ ID NO: 13146
  misc_feature: Ceres CLONE 1456895-F
  misc_feature (14)..(123): Pfam Name: Ribosomal_L32e Pfam Description: Ribosomal protein L32

SEQ ID NO: 48223 - DNA, 655 bp, Zea mays
  misc_feature: Ceres CLONE 1456898-F
  misc_feature: Encodes the peptide sequence at SEQ ID NO. 48224
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaccaaaaccatcctattcctcccaaggcaagaaaccaagaccatggctggcacggccaagacccccgtcctcggcttcctccttgctcttgctcttgtggccacctcgacgccggctgcggccaccacgctgacgctccacaacctgtgtccgtaccccgtgtggccgctggtgagcccgaacaccgggttccccgccatctccgagaacacgggccgcctcgacggcggcgggcgcgggctggtctccttccgcttcccggacagcttctgggcgggccgcgtagtggcgcgcacgggatgcagctccgggcattcccggtgcgagacggggagcgcagcgccggcgacggtggtgcagctggtggtgcacgcggaggggcaggacctggcgtcgtacagcgtgagcctggtggacgggttcaacgtgcccgccgtggtgagcccgcaggcggtgggcggcgggcagtgcccggccctggggtgcgcggcggacctcaacgccgggtgcccgccctcgcagcgcgtgccgggccgggggcccccccntttttt

SEQ ID NO: 48224 - protein, 170 aa, Zea mays
  misc_feature: Ceres CLONE 1456898-F
  misc_feature (34)..(168): Pfam Name: Thaumatin Pfam Description: Thaumatin family
  misc_feature (169)..(169): Xaa is any aa, unknown, or other
MAGTAKTPVLGFLLALALVATSTPAAATTLTLHNLCPYPVWPLVSPNTGFPAISENTGRLDGGGRGLVSFRFPDSFWAGRVVARTGCSSGHSRCETGSAAPATVVQLVVHAEGQDLASYSVSLVDGFNVPAVVSPQAVGGGQCPALGCAADLNAGCPPSQRVPGRGPPXF

SEQ ID NO: 48225 - DNA, 674 bp, Zea mays
  misc_feature: Ceres CLONE 1456909-F
  misc_feature: Encodes the peptide sequence at SEQ ID NO. 48226
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaagctggagctccccgcggtggcggccgctctagaactagtggatcccccgggctgcaggaattcgcacgagaccattacctagaacatcctaatcgaaaaacgcaacaaagcatcttgagtgttcgacagcgagccatggagaagacgtccgagaacgccatcccgccggcggcatccccgctgatgctgttcggttcgtgggcgagctcgtacacgcaccgcgtgcagctggcgctgcggctcaggggcctggagtacgactacgtggaaggaggacctggggaaacagagcgacgagctgctgcgccacaccccccgtccaccagaaagtgccccgtggctccgtccacgggcgcccgcgcggctccccgaagtccggtcattaaccctcccaggtaccttggacaaccccctggccccggaaaaacccgcccgcctggttcccccccgccgaaaacccttttaaaacgggggggggtc

SEQ ID NO: 48226 - protein, 115 aa, Zea mays
  misc_feature: Ceres CLONE 1456909-F
  misc_feature: SWISSPROT Homolog: EC 2.5.1.18 Glutathione transferase
MEKTSENAIPPAASPLMLFGSWASSYTHRVQLALRLRGLEYDYVEGGPGETERRAAAPHPPSTRKCPVAPSTGARAAPRSPVINPPRYLGQPPGPGKTRPPGSPPPKTLLKRGGV

SEQ ID NO: 48227 - DNA, 662 bp, Zea mays
  misc_feature: Ceres CLONE 1456918-F
  misc_feature: Encodes the peptide sequence at SEQ ID NO. 48228
atagctggagctccccgcggtggcggccgctctagaactagtggatcccccgggctgcaggaattcgcacgagaccattacctagaacatcctaatcgaaaaataagactatactcccgtgttcttctaccggcggcggtggtgccaagcgaggcggtaagggagacgagatgagggggacgaagcggccgctcggcgtggtgacgtcgtgggtgcggcggcggccgcccaaggtgaaggccttccttgccgttgtcaccggcttggccgcgctcgtcttcatccacttcatcgtccacgaccacgactacctcttcgtccttgccgaggctgcgcacgcgctcggcataggcgtcctcatctacaagctaaggaaggagaagacctgccccggactatccctcaagtctcaggatctcactgcattatttctagctgttagactgtactgcagctttgtcatggagtatgacatccatacaattctggacactgctacacttgtagccacactgtttgttatttatatgatacggttcacactgacgtcaacttatatggcggatgaggataactctgcgttgtattatgtggtgttaccgtgtgctggactggcactacttattcatccgtcaacatctcataccattgtgaaccggatc

SEQ ID NO: 48228 - protein, 164 aa, Zea mays
  misc_feature: Ceres CLONE 1456918-F
  misc_feature (48)..(164): Pfam Name: ER_lumen_recept Pfam Description: ER lumen protein retaining receptor
MRGTKRPLGVVTSWVRRRPPKVKAFLAVVTGLAALVFIHFIVHDHDYLFVLAEAAHALGIGVLIYKLRKEKTCPGLSLKSQDLTALFLAVRLYCSFVMEYDIHTILDTATLVATLFVIYMIRFTLTSTYMADEDNSALYYVVLPCAGLALLIHPSTSHTIVNRI

SEQ ID NO: 48229 - DNA, 737 bp, Zea mays
  misc_feature: Ceres CLONE 1456920-F
  misc_feature: Encodes the peptide sequence at SEQ ID NO. 48230
  misc_feature (20)..(20): n is a, c, t, g, unknown, or other
  misc_feature (21)..(21): n is a, c, t, g, unknown, or other
  misc_feature (41)..(41): n is a, c, t, g, unknown, or other
  misc_feature (51)..(51): n is a, c, t, g, unknown, or other
ttttgtgtctttttttttgnngtgggctgttgtcttttttntgacgagaancccaaaactggagctccccgcggtggcggccgctctttaactagtggatcccccgggctgcaggaattcgcacgagaccattacctagaacatcctaatcgaaaactatttttctcctcttaatggttcgcgtgtgggccactcacgcgtgcctttttctcctggccggccagcctatatctttcaacgtccagccctaccatgccaaggtcggctgggtgcacttcctgaacggcgtccggaaaggggtggaggcgcacgccgcgaaactggatgagggtgtgggcggcgacctccagaggctccttgaggcccgcacgctgctgctcaagatcctcggcatcccctgcaagcatagaaaattgattttgagttttgcacaaaagtaccgacttggtctctggaagccccaaccacaaccccccccactttagagttggttcgttcttgaaagatagtctactgtaggactgaggcatgtttgggactttggatgatttgctttgtaatttagaaacctcaaacgtttggtccctgtctctggccatacttatttgcgaccattacgggtaagacacaacattctagaaagattccaaccttattgggtcgtggcgtagggttccttctggaacaaccaaatccatatgggcttttgcttgagcttcctccccctaaaccccgcc

SEQ ID NO: 48230 - protein, 103 aa, Zea mays
  misc_feature: Ceres CLONE 1456920-F
MVRVWATHACLFLLAGQPISFNVQPYHAKVGWVHFLNGVRKGVEAHAAKLDEGVGGDLQRLLEARTLLLKILGIPCKHRKLILSFAQKYRLGLWKPQPQPPPL

SEQ ID NO: 48231 - DNA, 643 bp, Zea mays
  misc_feature: Ceres CLONE 1456928-F
  misc_feature: Encodes the peptide sequence at SEQ ID NO. 48232
ctggagctccccgcggtggcggccgctctagaactagtggatcccccgggctgcaggaattcgcacgagaccattacctagaacatcctaatcgaaaaagaccaaagcagagctgcttgcttctccacgccttgtgcttccacagagcaaccagttctcagaagcaatgtccgcacccctggtggacgccgagtacatggccgagtaatcgagagggcacggcgggacctccgcgctctcgtcgccagcaagaactgcgcgccgatcatgctccgcctcgcgtggcacgacgccggcacttacgacgccaagaccaacacaggaggccccaacggctccataaggttcccacaggagtacagccactcttcaaacgcagggatcaagatcgccattgacctcttagagcctgtgagcagaagcacccccagatccatacccagaactgtatcagcctcgccggagttgtcccccgtcaaattcccctgttggaccgacggttgacttcttcccggggaggaaaggattcttcaattttgccaaagaaaggacccttgcccgaaagcaaaaaagaggggcctcccctccccaaaaaagtatttccccccggaagggtttttacaaaaaggggaaatttgggggc

SEQ ID NO: 48232 - protein, 78 aa, Zea mays
  misc_feature: Ceres CLONE 1456928-F
  misc_feature: SWISSPROT Homolog: EC 1.11.1.11 L-ascorbate peroxidase
MLRLAWHDAGTYDAKTNTGGPNGSIRFPQEYSHSSNAGIKIAIDLLEPVSRSTPRSIPRTVSASPELSPVKFPCWTDG

SEQ ID NO: 48233 - DNA, 661 bp, Zea mays
  misc_feature: Ceres CLONE 1456931-F
  misc_feature: Encodes the peptide sequence at SEQ ID NO. 48234
aagctggagctccccgcggtggcggccgctctataactagtggatcccccgggctgcaggaattcgcacgagaccattacctagaacatcctaatcgaaaagggacattcttcttcgcccagcctagccacgtccacgtccatcccgaggcaaacgaacaaaggcacagcgcacctcacttattacgaaccccctctgtgccactgcccactgccacctcaaatccccgcgaacctatctttcccttcccccgatccaggcggttctcttcccagaagccagcccagaatggtgggatccgacgcgctgcagtccatcgtttacagccgtgggtcactccgcctcctcgatcagaggaagctgccgctcgagatggagtacatcgacgtcaagagttccgccgatggctggaatgcaataagagacatggttgtccgtggtgctccagcaatagccatagcagcggcactagcattagccgttgaagtttctgatttagattttattggtacgcctgaagaagcagcttcttttgtttcaaagaaattggaataccttgtatccagccgaccaactgcagtgaacctatctgatgctgcaacaaagctccaaactttggtatcaaaggcagctgaaactgcaaaagattccaagtctatct

SEQ ID NO: 48234 - protein, 124 aa, Zea mays
  misc_feature: Ceres CLONE 1456931-F
  misc_feature: SWISSPROT Homolog: EC 5.3.1.23 S-methyl-5-thioribose-1-phosphate isomerase
MVGSDALQSIVYSRGSLRLLDQRKLPLEMEYIDVKSSADGWNAIRDMVVRGAPAIAIAAALALAVEVSDLDFIGTPEEAASFVSKKLEYLVSSRPTAVNLSDAATKLQTLVSKAAETAKDSKSI

SEQ ID NO: 48235 - DNA, 744 bp, Zea mays
  misc_feature: Ceres CLONE 1456934-F
  misc_feature (156)..(156): n is a, c, t, g, unknown, or other
  misc_feature (167)..(167): n is a, c, t, g, unknown, or other
  misc_feature (391)..(391): n is a, c, t, g, unknown, or other
aaaggtggagctccccgcggtggcggccgctctatactagtggatcccccgggctgcaggaattcgcacgagaccattacctagaacatcctaatcgaaaaaccccaaagcagtgtaagcctcacttcttcctcgacccccccccccccaaaattnttgggggggtnatagcaggatgaagttaggtagcgaacggggggggcttccaagccctttgccctcgtgctgttggtggcattgtccgggaggggcatgtccgcggcgggttaagggtggtgtgcctttaaggtggaggtggggaagttgtgcggccacaagctgaacggggggtatggggggggggggggagggaggggtgtttttggggggggggggggggggggccaaaatnaaaattttcaccctggggggggtgggggccccctgtcgggggggggggggggggggaggggaagtacccatggggccaactttgcgtgtgggggaccgcaaactgcgggggggatggtgtggaggtgggggggggggggtggggtggggggatggggcggtgggggggtttttggtggtagcgtgggggggggggaaggggagtgtgaagggggaggaggggtgcgggagggcggggttatgggaggggggggggtggagtgggggggggggaggggagtggtgggtcggtggggtgggtaggggggagaggtgggaggcggggcgatgagacaagtaatggagggcagtgag

SEQ ID NO: 48236 - DNA, 678 bp, Zea mays
  misc_feature: Ceres CLONE 1456946-F
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
aagctggagctccccgcggtggcggccgctctagaactagtggatcccccgggctgcaggaattcgcacgagaccattacctagaacatcctaatcgaaaaaacgcacgcaatctcgcagcaaaccgccgggcccctcgcgcgcacacacctcagctccctcgtaccggggctccatgggcaacttcgcatcgtgcacgctggcgaggacggccggggccgggagggccagcggctcgaccgtcgtgctcccggacgggcgggtgcggcaggtggccctcccggccacggcggccgagctgatgctcgacgcgccgggccatttccctgcgacgcgcgggcgctgcggcccggggcggcgatcgaggcgctcgcggcggacaaaggccctcgtgcggcggggcgctgtacccccggcctccccccatggagccggcctgggcgccccccccttggcgcccccgccaaaaagggccgccccctggggcggccccccgggggggtggcccaaccggggggaaaaaaggccccggccccccccaaaggggggaaaaaaacccgggccgggggtcccttcccccccgcccccacaggggaaaaaagggtccccccccccccttttttttnnnnccccccgcccccccaaaaaaacccccccagggggccggcgcgccccttt

SEQ ID NO: 48237 - DNA, 649 bp, Zea mays
  misc_feature: Ceres CLONE 1456963-F
  misc_feature: Encodes the peptide sequence at SEQ ID NO. 48238
tggagctccccgcggtggcggccgctctagaactagtggatcccccgggctgcaggaattcgcacgagaccattacctagaacatcctaatcgaaaaatcacaattcacaacaccagttgccaaccccacgcacgctctgcgacgcgcgagttccccttccccactcccagcttccgtttcctcggaccccaccaccgcgcccccattcctcagagctcagatgcagccgcagcccgccgagatggaccccgccgtcgacgcctccgcctccaccgcgcaggccgactccaacgtcagcgccgccgtccccgcacccgatccctccccgcccctgccggcgccggaggctgagacggtcgatccgccgcccccgccgcccgcaccagcgcccaagacggtcacctggagcgagaagctcacgtccgagtcgccgacgcacgtgcacgccgccgctgcggcggagtccagccagtacgtgtcccgcgggcccgcgtcctcctcgtctaaaggcgccgtggaggcgatgagggagacgctgtcgaggtgggggaagtcgtggggggagaccaccaagatggtcgagagcctcagccgcgacacgtggcaacacttcaagactggacctagttttactgaagctgctatggg

SEQ ID NO: 48238 - protein, 142 aa, Zea mays
  misc_feature: Ceres CLONE 1456963-F
MQPQPAEMDPAVDASASTAQADSNVSAAVPAPDPSPPLPAPEAETVDPPPPPPAPAPKTVTWSEKLTSESPTHVHAAAAAESSQYVSRGPASSSSKGAVEAMRETLSRWGKSWGETTKMVESLSRDTWQHFKTGPSFTEAAM

SEQ ID NO: 48239 - DNA, 526 bp, Zea mays
  misc_feature: Ceres CLONE 1456980-F
caaaatacacgccccacaccacctacccccccgatctcaacccaacaaccaccctaaacaccgccgttcctcccctttaaaccacaaggtggcggccgcctctacaatagtggatcccccgggctgcaggaattcgcacgagaccattacctagaacatcctaatcgaaaaatagcctccgcctctccttccagtgtccgccgtcgtgcgctcgctacccctctccctcgaagcctttgccggcgaagagcgcccagtcgcccaccaggacgaagtttggtgctgcctacccggctgctgtcttcgctgggaactccaccccctctgccgaggacttggcacccctttctggagtcccgttgggtggctaagttcaaccctgaaaacgaatgccactttctttttgtccccaaactggcccgggtaaaggcccctctcacccaaacttcccctggccccccttggcccaggccaaaaaaatattcgccccccccggcccaccccccccttaaccccccccgacccc

SEQ ID NO: 48240 - DNA, 633 bp, Zea mays
  misc_feature: Ceres CLONE 1456987-F
  misc_feature: Encodes the peptide sequence at SEQ ID NO. 48241
gcggtggcggccgctctagaactagtggatcccccgggctgcaggaattcgcacgagaccattacctagaacatcctaatcgaaaaacacagcccaatactactagccacaagacagctgcagcagcagcagcaccgcgcggacccgacctgacctgactgacctcctcccacgcccggacggcggaaggccgcagcagccaagccatggcggtggacctgatgtcctgcggcggcggcggggcgtacgagcacctggcgttccaggaggcggccgcggcggggctgcgcagcctggagctgctggcttcctcgctctccccgtgcgccgcggggcgggcggagtcgccgccgctggggcagatcgccgaccaggccgtgtcccgctttcgccgcgtcatcaacctgctggaccgcacgggccacgcccggcttccgccgcgcgcccgccgccggggcgaagcctatagggatgacggagaacggaggcggcgcccccctccctcggtcggccgaacagcggtggcggtggagcccgcgcagaagacggccctgacgctggaacatcgccaagccgggcgccgggcacgggccccgccggtgtccccgacgtcaacctccattctggctcggg

SEQ ID NO: 48241 - protein, 142 aa, Zea mays
  misc_feature: Ceres CLONE 1456987-F
MAVDLMSCGGGGAYEHLAFQEAAAAGLRSLELLASSLSPCAAGRAESPPLGQIADQAVSRFRRVINLLDRTGHARLPPRARRRGEAYRDDGERRRRPPPSVGRTAVAVEPAQKTALTLEHRQAGRRARAPPVSPTSTSILAR

SEQ ID NO: 48242 - DNA, 673 bp, Zea mays
  misc_feature: Ceres CLONE 1456990-F
  misc_feature: Encodes the peptide sequence at SEQ ID NO. 48243
aagctggagctccccgcggtggcggccgctctagaactagtggatcccccgggctgcaggaattcgcacgagaccattacctagaacatcctaattgaaaaatcataccgccgaaccaaatccaacgtccacagaaaagaaaacacattcccgtcgactcccctagtttcatcctattcatttctccccccaaacactccagctactagttactcgaggaatccatgtgcggcggcgcaatcatcttcgactacatcccggcgcggcgccgggtgtcgacagccgacttctggcctggttctgaagcagacgccgaggacattcatgcctcgcactccactgacccacagagaggtaagccctgcttccgtctttctctgctctccaggcgacaacacgccatccaggcagcaagctgcaaacggtcaatggtgtgacgccgtgctgccgactgtttccatgcagcgccgcccccgcgcgcgaaggcgaagcctgggcgccgcaagaaccagtaccgcgggatccggcagcggccgtggggccaggtgggaggggggaaaatccgcgacccccgtgaaagggccgtccgccccctgggctccggcccctacccccaccccctgaaggccgcccccgcggcgatttacaaacggcggcccccgagcgcgcaatc

SEQ ID NO: 48243 - protein, 70 aa, Zea mays
  misc_feature: Ceres CLONE 1456990-F
MCGGAIIFDYIPARRRVSTADFWPGSEADAEDIHASHSTDPQRGKPCFRLSLLSRRQHAIQAASCKRSMV

SEQ ID NO: 48244 - DNA, 1093 bp, Zea mays
  misc_feature: Ceres CLONE 1456991
  misc_feature: Encodes the peptide sequence at SEQ ID NO. 48245
acctgcttcctccttcccatccgtaggtgttgctaacatattggtatcaaaggtcatcgatccccggatctggagccgatccactacacccgtcgtgccaagcatctcggtgccatggatccacaggtttagctcgccttggaagctcaaaaactcgatcgttcctcaccgagctcgacaagaaattcgcagcgcttgacgccaagtgggagtcacgcatcggcgacctggagcgctcgacgggccgattcagttccacgatctcaaggctgacatccacacagatgtgacggcccagctggaattcttcatcaacacggtgaccgaacgctcggatcagatcgcgactgcaacagctttgcgggttgcggtgctggagtcggcatccgcggccttcgactcgtggcgcaccagcattgaatcctcggtggcggatgtcaaggtcggcatcgaatcgatccagacgaccgtcgccaaactgtctcaaactaaggatcctccaccgccggtgccagcacaccttcaacatggcatcctcggcgagttcaggtcggtttccacgcacccatctaccaaattcaggaccgacggcccagaggggcacgacatcgactcttatcgctgggaggctggttttggacgcgtttacgcatccacccacttcctgcacaatgttactgttctccagcgtcggatggtgtatcgtggagtacgcgccgtgcagcaaggcttgatccaatggtcgacgctgccgtcgtcgctagccacccgggaagacctcgaagcactccggcaatgctttccactagcgcctgcttggggacaagccagcgctcaaggcgggggcaatgtcagcactcaggagactacgccaacagtccaagctcctacggctgtcatcgcggacaggggaactgatgaagtacagacttcaaagccaaagaggagggttcggcccagtagccgggtgatgggtccagaatgggtgcattagacttaagtctcgctagcccaagagtattatttatgttttgctgtatccgaactggagggaaacaagaaagaaaatatctatctaaaaaaaaaaaaaaaa

SEQ ID NO: 48245 - protein, 99 aa, Zea mays
  misc_feature: Ceres CLONE 1456991
MVYRGVRAVQQGLIQWSTLPSSLATREDLEALRQCFPLAPAWGQASAQGGGNVSTQETTPTVQAPTAVIADRGTDEVQTSKPKRRVRPSSRVMGPEWVH

SEQ ID NO: 48246 - DNA, 637 bp, Zea mays
  misc_feature: Ceres CLONE 1456997-F
  misc_feature: Encodes the peptide sequence at SEQ ID NO. 48247
cgcggtggcggccgctctagaactagtggatcccccgggctgcaggaattcgcacgagaccattacctagaacatcctaatcgaaaaatttcagtgtcctccctcgtctcgagaccttgccccatccagcccaacgctccgtccatcaactgaatagcttggcggtgtaaccctgtcgtgtgcgatgagcccctcgccgttggtcaccgccgcggcgtcggctgccgtggtggcgctggctgtcgccaaccgcgtgctctacaagctcgcgcttgtgcctctcaaggcgtaccccttcttcctcgcccagctcaccaccttcgggtacgttgccgtgtacttctcgatgctctacacgaggtaccgcactgggttggtgactagagacatgctggcgctccccaagcaccgggttcgtcgctatcggtttgctggacgcacttggagtcgctgctggcatgtctgctggagctatgctaccagggcctgctattcctatactgtcccagtttttggttgccaacttaggcaaccgtatttctgtactcaccctaagatttttgggaggttcccgttgatgcccacctcttaccaatttcatttgattgccgggggttagattctgctatggttccac

SEQ ID NO: 48247 - protein, 144 aa, Zea mays
  misc_feature: Ceres CLONE 1456997-F
MSPSPLVTAAASAAVVALAVANRVLYKLALVPLKAYPFFLAQLTTFGYVAVYFSMLYTRYRTGLVTRDMLALPKHRVRRYRFAGRTWSRCWHVCWSYATRACYSYTVPVFGCQLRQPYFCTHPKIFGRFPLMPTSYQFHLIAGG

SEQ ID NO: 48248 - DNA, 667 bp, Zea mays
  misc_feature: Ceres CLONE 1457028-F
  misc_feature: Encodes the peptide sequence at SEQ ID NO. 48249
aaactggagctccccgcggtggcggccgctctagaactagtggatcccccgggctgcaggaattcgcacgagaccattacctagaacatcctaatcgaaaaaagacatcgcggccctaccttaccgttgccggcctgcccttcccagcccggcagtccacaccgtccccgtcctcccactccccactcgcaaccatttcaaatcgctctctcgacccaactgtactcgccgtcgtcaattcatcatccatccccatccccccatcgactcccagatctctatccccctctccctgtcctcactctctcgagcgcgttgtggcggatgtcctcgtcggcgcgtttcgatctccgggcctcgtcgcatcagttgcagccgccgccgtcgcacgccagcatgagcagcgacgggggcgcgttcaccaacgcggagaacctggagcactgcgcccggaacctgaaacagacgctcgtcaccttcggaattccgggcatctctcgacctcttccccaccggatccggcctccattgcaagaacttggaacctgcatctaatgccctgcttgagaaacccacaaagggaacattgagttcaaggaagtcctacaaatgcaccaaccggaggcggaagccaattttgataacctcacgggccggaaactaaaaa

SEQ ID NO: 48249 - protein, 76 aa, Zea mays
  misc_feature: Ceres CLONE 1457028-F
MSSSARFDLRASSHQLQPPPSHASMSSDGGAFTNAENLEHCARNLKQTLVTFGIPGISRPLPHRIRPPLQELGTCI

SEQ ID NO: 48250 - DNA, 631 bp, Zea mays
  misc_feature: Ceres CLONE 1457050-F
ctctagaactagtggatcccccgggctgcaggaattcgcacgagaccattacctagaacatcctaatcgaaaaagggagcctttgcctttcccctccgcccgccagccattaatggcggcggcatctccatccactcccccctcgcccccctcccactgctgctacttctagaagcgctggtggcagggcaggcggtatcccggccgctggcgctggcgcgagagttggttggtggtggtgttcagcccccctccctcttcaggtttagggtggagcgatccgtgcaggccaacgcggggtgcgtgacccagaaagggaaaccgccgccttttttctcttctgccgccccgcttttccaatccctcctcaacctcatccgccccgcccgcaccatcaccaaaaaggtccccgccttcttcttcctcttctcctctgcccctgcttgtcgtttgctcgtgctcccccacccctttctgattcagccagggttccttccgcggggcggcgcgttcgcatgggcaactgctggggccccaaaatcacttccaacgcccctcccgcggggccctcctccccgtcagggaccgggtccaaatttggcaagccagaaacggggcgggcggcagcccc

SEQ ID NO: 48251 - DNA, 718 bp, Zea mays
  misc_feature: Ceres CLONE 1457054-F
  misc_feature: Encodes the peptide sequence at SEQ ID NO. 48252
  misc_feature (28)..(28): n is a, c, t, g, unknown, or other
  misc_feature (30)..(30): n is a, c, t, g, unknown, or other
  misc_feature (44)..(44): n is a, c, t, g, unknown, or other
  misc_feature (45)..(45): n is a, c, t, g, unknown, or other
cccccttttttccctctcgcgcctcctncnaaaaaagttccatnngcccaacctaaacaaaaatggagctccacgcggtggcggccgctctagaatagtggatcccccgggctgcaggaattcgcacgagaccattacctagaacatcctaatcgaaaagacgacggagtaccgtctcctctcctttcctctcctgcaactgcaagcgaccacccctccacccccatccacccacccgcccgccgacgcttggatcccctcccttgtttgccgtgtccccgcccaaaccccgtagccgccgccacagcaatcgctgccgccgccgctggaggccgggccgtgggggctgaaatgaaggaggtggtgctccacgtgtatgacgagaccaacagtgactccgagaagacgaacaacaccatcctccagatcaaccgcatcttcaaggaccgcatcggcctcggcggcatcttccacaccaccgtccaggtctatggcgaggacgagtggacgctcgggatctgcgagacctgaagcagagagtttaggctgccccgtaggcaagaacccccctggacaccctacggggagcgcatcctccctccgggaagaactgagtgccgggaatccgaaggcaggataacccggatgcctggggggcagcgtcatttcgaaaagtgggccttgggccacttccgcaccaattttcctgcccccaaga

SEQ ID NO: 48252 - protein, 59 aa, Zea mays
  misc_feature: Ceres CLONE 1457054-F
MKEVVLHVYDETNSDSEKTNNTILQINRIFKDRIGLGGIFHTTVQVYGEDEWTLGICET

SEQ ID NO: 48253 - DNA, 577 bp, Zea mays
  misc_feature: Ceres CLONE 1457072-F
  misc_feature (166)..(166): n is a, c, t, g, unknown, or other
  misc_feature (181)..(181): n is a, c, t, g, unknown, or other
  misc_feature (187)..(187): n is a, c, t, g, unknown, or other
  misc_feature (210)..(210): n is a, c, t, g, unknown, or other
  misc_feature (213)..(213): n is a, c, t, g, unknown, or other
  misc_feature (220)..(220): n is a, c, t, g, unknown, or other
  misc_feature (221)..(221): n is a, c, t, g, unknown, or other
  misc_feature (228)..(228): n is a, c, t, g, unknown, or other
  misc_feature (478)..(478): n is a, c, t, g, unknown, or other
ctggagctccccgcggtggcggccgctctagaactagtggatcccccgggctgcaggaattcgcacgagaccattacctagaacatcctaatcgaaaaagtcgccgcctctccccactccctctcgtcgccgtcctctcccgttcgcaacgccacgctccccaccngccgaaatggccccngaagcngaggtgggcagggcacccggtgnccnggccaanngaagaangacggataaaaggtggaccgaaacccctcttgtttccaaaaaaaaaggggcccaaaaacccaatttttggggtttttgggggggggcggtttttcccccccccaaaaaaaagcccccgcccccccatattttcaaaaagggggcccaaaaggggggggggggggatttcttcggcggcgcggggggggtgtttttttcttttataaaaaaaacccccccccccaagagggggggggcccccccgccggcnctaaaaaaaaaaaaaattttcccccccccccccccccccccccacaaaaaaaaaaaacccccccccccccccccccgggcgaaagaaagatttttttta

SEQ ID NO: 48254 - DNA, 670 bp, Zea mays
  misc_feature: Ceres CLONE 1457074-F
  misc_feature (204)..(204): n is a, c, t, g, unknown, or other
  misc_feature (284)..(284): n is a, c, t, g, unknown, or other
  misc_feature (287)..(287): n is a, c, t, g, unknown, or other
  misc_feature (290)..(290): n is a, c, t, g, unknown, or other
  misc_feature (307)..(307): n is a, c, t, g, unknown, or other
  misc_feature (314)..(314): n is a, c, t, g, unknown, or other
  misc_feature (335)..(335): n is a, c, t, g, unknown, or other
  misc_feature (354)..(354): n is a, c, t, g, unknown, or other
  misc_feature (360)..(360): n is a, c, t, g, unknown, or other
  misc_feature (366)..(366): n is a, c, t, g, unknown, or other
  misc_feature (371)..(371): n is a, c, t, g, unknown, or other
  misc_feature (372)..(372): n is a, c, t, g, unknown, or other
  misc_feature (379)..(379): n is a, c, t, g, unknown, or other
  misc_feature (387)..(387): n is a, c, t, g, unknown, or other
  misc_feature (394)..(394): n is a, c, t, g, unknown, or other
  misc_feature (396)..(396): n is a, c, t, g, unknown, or other
  misc_feature (446)..(446): n is a, c, t, g, unknown, or other
  misc_feature (486)..(486): n is a, c, t, g, unknown, or other
  misc_feature (490)..(490): n is a, c, t, g, unknown, or other
  misc_feature (491)..(491): n is a, c, t, g, unknown, or other
  misc_feature (505)..(505): n is a, c, t, g, unknown, or other
  misc_feature (529)..(529): n is a, c, t, g, unknown, or other
  misc_feature (530)..(530): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (616)..(616): n is a, c, t, g, unknown, or other
  misc_feature (617)..(617): n is a, c, t, g, unknown, or other
  misc_feature (619)..(619): n is a, c, t, g, unknown, or other
  misc_feature (621)..(621): n is a, c, t, g, unknown, or other
tccccgcggtggcggccgctctagaactagtggatcccccgggctgcaggaattcgcacgagaccattacctagaacatcctaatcgaaaaatcgccaagtttttttaactatacaatccaggaaggaagtcactgtcacttggtgagatcgatggcccgcgtcgccgccgtcctcgttgctctcctcgccctctttgccgtcncggccacggcgcaagcccctgccgcgtcgcccaagcgcgccccagcccctgcgccacccaagatggcccctctcccgccnccnccnaaccaggcccccatganctccccnccctcgcctcccacaatgtcnccggcgttcgccccctccnccgacnctccanccacnnaaccccncccgtccnaattttncnaccccatgcccccgccggagcccccctctgactccggccccccccccccncacagaaaaaaacacaacccctcctccctccccaataaanttcnnccccaatcccccgnccctttaccccccccccccccccnntttctaaaaatcccaaaaatgaattctaaaaaaccccaacccccccccaaaaccccccccnnnccnnnaaaaaaaacccccccccnntncnccttgtttaccacaccacctgttttttttgtttgtggtctgaccttggt

SEQ ID NO: 48255 - DNA, 687 bp, Zea mays
  misc_feature: Ceres CLONE 1457076-F
  misc_feature: Encodes the peptide sequence at SEQ ID NO. 48256
acccgcggtggcggccgctctagaactagtggatcccccgggctgcaggaattcgcacgagaccattacctagaacatcctaatcgaaaacttctttctctcggcgacccgtcccggaccctatgtcgtcgccgctcgagccccacgactacatcggactctccgccgccgccgccgcggcgccaccgacaccgacctcttgctcgtcggacgcgtcctcgccggagccccgcctcacccttcgcctcggcgagtcgggctaccgagcccttcgaccgctacctgtaccgggaccggtgccaggactctgctccacgctcacactcgggccggtgcctgctccccccaggtggccgctgacttgtccgacgagcgcgcgtgttccgaccacgctcagagatttccccacccccaagattacgacacaggtggatcattcccttgcggcaacactgtcctgaaggctgaggatcaccgtaaagacttctgaaattaaatctcctaagaacttccggctcttcgagggcccccaagggattaaggtttccggctgcctgatgcacggtgtcaagtggccggcagggcccccagttcttttgaagagggattacaggaaggccttcccccttttttttttagttgagggaggggtttttctggtaggtaccccccactattttatgaacc

SEQ ID NO: 48256 - protein, 112 aa, Zea mays
  misc_feature: Ceres CLONE 1457076-F
MSSPLEPHDYIGLSAAAAAAPPTPTSCSSDASSPEPRLTLRLGESGYRALRPLPVPGPVPGLCSTLTLGPVPAPPRWPLTCPTSARVPTTLRDFPTPKITTQVDHSLAATLS

SEQ ID NO: 48257 - DNA, 648 bp, Zea mays
  misc_feature: Ceres CLONE 1457095-F
  misc_feature: Translation starting site: 75
  misc_feature: SWISSPROT Homolog: EC 1.14.19.2 Acyl-[acyl-carrier-protein] desaturase
agtggatcccccgggctgcaggaattcgcacgagaccattacctagaacatcctaatcgaaaacataccagactatgcttaacaccctcgacggtgtcagagatgagacaggtgcaagccccactgcttgggctgtttggacgagggcatggactgctgaggagaacaggcatggtgatcttctcaacaagtacatgtacctcactgggagggtagatatgaggcaaattgagaagacaattcagtatcttattggctctggaatggatcctaggactgagaataatccttatcttggtttcatctacacctccttccaagagcggggcgaccttcatctcccatgggaacactgctcgtcatgccaaggactttggcgacttaaaagctcgcacaaatctgtggcatcatcgcctcagatgagaagcgacttgaaactgcttaccccaagatcgtgggagaaattgtttgacatcgacccttaagggtacagtgtttgcctctgcctaacctgatgaagaaaaagatctccatggcccgcccaccctgattgttttaacggtaaggcacaaacaagctgttttgaacactttcttcaatgggtccgcccaaaaggcctttggcgttttaccactgccccggggaaca

SEQ ID NO: 48258 - DNA, 657 bp, Zea mays
  misc_feature: Ceres CLONE 1457096-F
  misc_feature (377)..(377): n is a, c, t, g, unknown, or other
  misc_feature (418)..(418): n is a, c, t, g, unknown, or other
atagctggagctccccgcggtggcggccgctctagaactagtggatcccccgggctgcaggaattcgcacgagaccattacctagaacatcctaatcgaaaaattttctcccttgccactcaaaggcgcgatggcccctagatcggatcacgccggcggcagcgccgccgctccggtggccacgcaggcccacttcgactccatggatcccctcttccacgtcctccgcgtgctaccattctccttccttcggccgccgcgcacccgcctgaggctgccgtcgaacctggcgcttccctcacccatgaccgtcttctccctcatcctactcacctacttcgcggtcgtctccggcctcgtctacgacgtcatccctnagccccccgggagtcggagcgcccaagaccccggcacggcncccgtccgcccagtcgtcttcctccccaggcgcgtcaacgggcagtacatcatcgaagggctctcctcggggtcatgttcgtccttggcgcgttggcatcatcctcctcaccttgcggtcaaccgcaccaggccccggaaccttcccgcctcgttggaaagccccggccaatcccccttctcattccctaacccatggccatgttcttcctccgaaaaaaaaccccggctacctttggg

SEQ ID NO: 48259 - DNA, 665 bp, Zea mays
  misc_feature: Ceres CLONE 1457098-F
  misc_feature: Encodes the peptide sequence at SEQ ID NO. 48260
  misc_feature (443)..(443): n is a, c, t, g, unknown, or other
  misc_feature (475)..(475): n is a, c, t, g, unknown, or other
  misc_feature (561)..(561): n is a, c, t, g, unknown, or other
  misc_feature (588)..(588): n is a, c, t, g, unknown, or other
  misc_feature (601)..(601): n is a, c, t, g, unknown, or other
ctccccgcggtggcggccgctctagaactagtggatcccccgggctgcaggaattcgcacgagaccattacctagaacatcctaattgaaaacttcaaccatcgttagagtttccttggtagtttttttccctcttgtcgcagcaccccccacccacacacacccaaggccccaactgcagtgcccatccggcagtcaggtcgatggcggcggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcccggtcttcaacgtcaacgccaatatcctcgacaaggtcatcgcgtactgcaggaagcacgcctcggcgccgcgcgccgatggcggtgatgcngaagcaagtgctgcgagtaacaaggcctcagncgacgatctcaagtcctttgatgctgagttcgtcgatgttgacctggtcaccctcttggagctcattaaggctgcagactacctgnagatcaatgggctgctggacctgaccntgccagccgtcgncgacatgatcaaggggaagactccagaaggatacgcgagacatcgacatcgagaatgacttccc

SEQ ID NO: 48260 - protein, 151 aa, Zea mays
  misc_feature: Ceres CLONE 1457098-F
  misc_feature (12)..(71): Pfam Name: Skp1_POZ Pfam Description: Skp1 family, tetramerisation domain
  misc_feature (94)..(152): Pfam Name: Skp1 Pfam Description: Skp1 family, dimerisation domain
  misc_feature (91)..(91): Xaa is any aa, unknown, or other
  misc_feature (120)..(120): Xaa is any aa, unknown, or other
  misc_feature (129)..(129): Xaa is any aa, unknown, or other
  misc_feature (133)..(133): Xaa is any aa, unknown, or other
MAAEAAAAGKEKMRTLVSSDFKKFDVEESVARESLIILNLMADCDDSDIPVFNVNANILDKVIAYCRKHASAPRADGGDAEASAASNKASXDDLKSFDAEFVDVDLVTLLELIKAADYLXINGLLDLTXPAVXDMIKGKTPEGYARHRHRE

SEQ ID NO: 48261 - DNA, 644 bp, Zea mays
  misc_feature: Ceres CLONE 1457105-F
  misc_feature: Encodes the peptide sequence at SEQ ID NO. 48262
tggcggccgctctagaactagtggatcccccgggctgcaggaattcgcacgagaccattacctagaacatcctaatcgaaaactcatacctcaatcatcatcttctttaatcaacattgcgagagcctccctcctcgttcggttcggacttttgcttcggcgactttacgcggtaggccaccgtaaaccctagccccagaccgcgggtcatagccaacgagatgcagatcttcgtcttgacgctgacggggaagaccatcacgctcgacgtcgagagcagcgacaccatcgataatgtcaaggccaagatccaggacaaggagggcatttcgcgtgaccagcagaggctgatttttgctggcaagcaattggaggatgggaggacattagctgattacaacattcagaaggagtcaacactcccttcggtcttgaggctcaagggtggaactatgatcaaggtgaagacactaactgggaaggaaatcgagattaacatcgagcccaatgacacaattgataggatcaaggagcatgttgaggagagagaaggcatcccacctgttcagcagaggctcatttatgctgggaagcaacttgctgatgacaaaactgtcaaggattacaacattgaaggtggttca

SEQ ID NO: 48262 - protein, 141 aa, Zea mays
  misc_feature: Ceres CLONE 1457105-F
  misc_feature (6)..(74): Pfam Name: ubiquitin Pfam Description: Ubiquitin family
  misc_feature (82)..(141): Pfam Name: ubiquitin Pfam Description: Ubiquitin family
MQIFVLTLTGKTITLDVESSDTIDNVKAKIQDKEGISRDQQRLIFAGKQLEDGRTLADYNIQKESTLPSVLRLKGGTMIKVKTLTGKEIEINIEPNDTIDRIKEHVEEREGIPPVQQRLIYAGKQLADDKTVKDYNIEGGS

SEQ ID NO: 48263 - DNA, 668 bp, Zea mays
  misc_feature: Ceres CLONE 1457112-F
  misc_feature: Encodes the peptide sequence at SEQ ID NO. 48264
  misc_feature (641)..(641): n is a, c, t, g, unknown, or other
  misc_feature (654)..(654): n is a, c, t, g, unknown, or other
tccccgcggtggcggccgctctagaactagtggatcccccgggctgcaggaattcgcacgagaccattacctagaacatcctaatcgaaaacgaccacttccgacgggccactcgccgccgctcgcccgccctgctcttcaccccttctcccgggaccgggacaagcgatctcccctccccgtccccgtagtccgcaggagagagatttttttttctcggttgcaatgaagagttatccgtgggcgggggcccgccctcctgccgtcgtgcagctcctcctcttcctcgcccacctcgtcgaccgcggcggcgctgccggtggaggcagcaagggcagctcagtgtacccggcggctgtcgtctacccgcatcactcccgccagatctcctggaaacccagggtgttcctgtatcagcacttcctcagcgacgacgaggctaaccacctgatctccctcgcgagagcggagctcaagaggtcagcggtcgccgataatatgtccggcaagagcacgctcagtgaggtccgcaccagctccggcaccttcctcaggaagggccaggatcctattgttgagggtatagaggacaaaattgctgcatggacattccttccaaaagagaatgatgaagatatccnagtcctaagatantagcatgggggaga

SEQ ID NO: 48264 - protein, 142 aa, Zea mays
  misc_feature: Ceres CLONE 1457112-F
  misc_feature: SWISSPROT Homolog: EC 1.14.11.2 Procollagen-proline dioxygenase
  misc_feature (139)..(139): Xaa is any aa, unknown, or other
MKSYPWAGARPPAVVQLLLFLAHLVDRGGAAGGGSKGSSVYPAAVVYPHHSRQISWKPRVFLYQHFLSDDEANHLISLARAELKRSAVADNMSGKSTLSEVRTSSGTFLRKGQDPIVEGIEDKIAAWTFLPKENDEDIXVLR

SEQ ID NO: 48265 - DNA, 681 bp, Zea mays
  misc_feature: Ceres CLONE 1457114-F
  misc_feature: Encodes the peptide sequence at SEQ ID NO. 48266
  misc_feature (358)..(358): n is a, c, t, g, unknown, or other
aaagctggagctccccgcggtggcggccgctctagaactagtggatcccccgggctgcaggaattcgcacgagaccattacctagaacatcctaatcgaaaaacccacccaaactcctcgtgcgcctcgtggattcgtgggtcgcgactcgcgaccagacgacaaacgtcgagaggggccgatcgtgatcgagcagcgatgtcgacgtcgcggaggcggacactgctcaaggtcatcgtccttggcgacagcggggtcgggaagacgtcgctgatgaaccaatatgtccacaaaaagttcagtcagcagtacaaagctacaatcggtgcagatttcgtcacaaaggaggttctgatcngagacaggctagtcacgttgcagatatgggacaccgcggggcaggagagattccagagtcttgggggtgcattctacagaggggccgattgctgtgtgctcgtctatgatgttaactcttacaggtcatttgatacactcaatacatggcatgatgaattcctcaccaagctaggccatcagatcctaaaactttttccttcatcttactcgggaaacagattgatgtagatggttgaaaaagcagagtggtttctgataagaaagcaatggagtggtgtgcttctaaaggcatatcccttattttgaaacttctgcaaagaa

SEQ ID NO: 48266 - protein, 129 aa, Zea mays
  misc_feature: Ceres CLONE 1457114-F
  misc_feature (11)..(130): Pfam Name: Ras Pfam Description: Ras family
  misc_feature: SWISSPROT Homolog: EC 2.7.11.1 Non-specific serine/threonine protein kinase
  misc_feature (54)..(54): Xaa is any aa, unknown, or other
MSTSRRRTLLKVIVLGDSGVGKTSLMNQYVHKKFSQQYKATIGADFVTKEVLIXDRLVTLQIWDTAGQERFQSLGGAFYRGADCCVLVYDVNSYRSFDTLNTWHDEFLTKLGHQILKLFPSSYSGNRLM

SEQ ID NO: 48267 - DNA, 667 bp, Zea mays
  misc_feature: Ceres CLONE 1457129-F
  misc_feature: Encodes the peptide sequence at SEQ ID NO. 48268
aaagctggagctccccgcggtggcggccgctctagaactagtggatcccccgggctgcaggaattcgcacgagaccattacctagaacatcctaatcgaaaacttttttccccactcgacgtcctccctcgccccctcctcctcctgttaggccgagtggcaaacccctagctactacctcgctccagaagctttctttcccctagatctcccatcccatccccatgtccggccgcgctgccgatccggcggccttggcggcgaaggggaagttaggggagctaatgtgggagcaccgggtgcaggcggccgtagcggtggcgctggtggccgcggccgccgtctcgatctccgtcgtggggcccaggctcagcgccctggtgtccttcttctggccgctgctcctctccacgggcttcttcctggtggcggtcgccgtgctgctccggatctcgccgccgcccgcgggcgacgacgacgagtccggcaaggagctcgtcgacttcgtcgcctggtgccgcccggagcacctcgtcccggacgcggcggccgtggaagctccgctggagccggagacctgacggaatgccggaagaagagtcggagaagaggccgaacgcagccgagctgtgccatggcaatggctatggcgatggcggggctccgt

SEQ ID NO: 48268 - protein, 118 aa, Zea mays
  misc_feature: Ceres CLONE 1457129-F
MSGRAADPAALAAKGKLGELMWEHRVQAAVAVALVAAAAVSISVVGPRLSALVSFFWPLLLSTGFFLVAVAVLLRISPPPAGDDDESGKELVDFVAWCRPEHLVPDAAAVEAPLEPET

SEQ ID NO: 48269 - DNA, 677 bp, Zea mays
  misc_feature: Ceres CLONE 1457130-F
  misc_feature: Encodes the peptide sequence at SEQ ID NO. 48270
  misc_feature (388)..(388): n is a, c, t, g, unknown, or other
acccgcggtggcggccgctctagaactagtggatcccccgggctgcaggaattcgcacgagaccattacctagaacatcctaatcgaaaaaaagcaaggcaagtctagtcttgcttcgccgaattccaaaccctagcctcgcctgttgcggccgcggcggagatggcgaagtctctgcgatccaagcgcgagaagcggctgcggacattgcgccgggagatagcggagcccttctacgacaagaaggaggccgccaagctcaccgcgcaggccgccgcgcttgctgctcccccgctccaggtccgcgggcccccgccgtcccaggatgccggcagctcccgcggcgctagctcatcctcggctctcgatgtgggggggggcgaggaangaaacaactggtctaaaaccttcttgaagccacttggcatcattagcaagaagaaggtacagcttcctttgaagatccagaaagaccagcgaaaagctaggaaagaaggggaagttttctttttaaaaagtagacgcgtaaagccttgtagtccttataaatcaaggtagttcctgtttcccagtttggaccaacaaatccaaagggcggtcctgcgcccccctaagtcccattcatgggctagcctcccctaggccaacaaggcgtattggaaaaacaaggcgcgctc

SEQ ID NO: 48270 - protein, 131 aa, Zea mays
  misc_feature: Ceres CLONE 1457130-F
  misc_feature (76)..(76): Xaa is any aa, unknown, or other
MAKSLRSKREKRLRTLRREIAEPFYDKKEAAKLTAQAAALAAPPLQVRGPPPSQDAGSSRGASSSSALDVGGGEEXNNWSKTFLKPLGIISKKKVQLPLKIQKDQRKARKEGEVFFLKSRRVKPCSPYKSR

SEQ ID NO: 48271 - DNA, 698 bp, Zea mays
  misc_feature: Ceres CLONE 1457134-F
  misc_feature: Translation starting site: 371
  misc_feature (386)..(386): n is a, c, t, g, unknown, or other
aaagctggagctccccgcggtggcggccgctctagaactagtggatcccccgggctgcaggaattcgcacgagaccattacctagaacatcctaatcgaaaaacactcgtctccgcagtttgaaaccacgcccgcggctagtgcaagctactccgtctccgtagcataatggagaggtaggtttgttatttggcgacgacataagcacgggcgggcgaccggggcgacgattcacagtggtgcgaagagaggacgccccgcacccagagaccatcctagcagccatctccgactttctcgcgcccgccttcttcgacttcacgaacgagcgatccgtgctctgcctcgtgaagatgttcagaacatgagaatggggggggcccaancggctgtggttctgtcgcacgtgctggccctgcccatgctcggggagtggcccacaacgtctccgggggggtacttgaaccaggggggtcgctttcgggcccacgacggctggccgagtcccccctcgtcctccgggtctgggtttggggtccccgctacttgctgggcgaacgtcaggcgacagcgaaggctcctggctttttgcatcaccgggagggaaaacgccggcgcccacacgggaatttttctcgcgatgctcacacgcccggggttaccggagcaaactgggggctaccgggccggagagtaaa

SEQ ID NO: 48272 - DNA, 650 bp, Zea mays
  misc_feature: Ceres CLONE 1457142-F
  misc_feature: Encodes the peptide sequence at SEQ ID NO. 48273
  misc_feature (650)..(650): n is a, c, t, g, unknown, or other
cgcggtggcggccgctctagaactagtggatcccccgggctgcaggaattcgcacgagaccattacctagaacatcctaatcgaaaaatcgaatcgtctcgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaatgatggcgaactcaagaatctctacgaagctaaagtctgggataagccatgggagaacttcaaggagctgcaagaattcaagcctgttgaagagtgtgctaacgcctaacgatctctccttcaccatgtgcgagcctgaagctcaaagcaaagttgcataataaggagccgcctcacaacatgctagaccatgctcccttgtgtaatttcataagactacaacccttttacggcttgttcggttgtgtctgtatctaacgcaattgaaagtgattan

SEQ ID NO: 48273 - protein, 103 aa, Zea mays
  misc_feature: Ceres CLONE 1457142-F
  misc_feature (10)..(98): Pfam Name: Cystatin Pfam Description: Cystatin domain
MADNTGTLAGGIKDVPGNENDLHLQELARFAVDEHNKKANALLGFEKLVKAKTQVVAGTMYYLTIEVNDGELKNLYEAKVWDKPWENFKELQEFKPVEECANA

SEQ ID NO: 48274 - DNA, 687 bp, Zea mays
  misc_feature: Ceres CLONE 1457144-F
  misc_feature: Pfam Name: DUF37 Pfam Description: Domain of unknown function DUF37
  misc_feature (427)..(427): n is a, c, t, g, unknown, or other
aagctggagctccccgcggtggcggccgctctataactagtggatcccccgggctgcaggaattcgcacgagaccattacctagaacatcctaatcgaaaaaccaaaaagtggtatcccactgcattatccaaaaccgaaaaaaaaaactcctgcggagattgaccgaccaccacccccgcctgcgttcgcgagccgtcaccgccatggctgccgctgccccccatgcatcctcctccatcatgcctgttttgtgtggacggactctctcaggaagcacattttctttcggtgcttcgtgccccaggtgacggaaggtaccgggatggagactccactgcggcgcttagcacgatggcttgattgaatactcatgtgcatagagggattcacagcgaggacgacatgcattatgacagcaacatcgnacattccatgcagagattctgaaaacgagataaatcacccttgctacccccaagctgcctcaatgtaccaccttgaattgtgaaatctatccgaggatacaaaaaatatgtcgttcgaaagggaccccatctttgactgccgggcaccctcgccccttgcacccctctaggggggataagggtgtggaccccccaaaatgggtttgggggaagaactatggcccatctcggaatcggaacccccttaaaaattttaaaac

SEQ ID NO: 48275 - DNA, 629 bp, Zea mays
  misc_feature: Ceres CLONE 1457146-F
  misc_feature: Translation starting site: 103
  misc_feature: Pfam Name: CBFD_NFYB_HMF Pfam Description: Histone-like transcription factor (CBF/NF-Y) and archaeal histone
ccccgcggtggcggccgctctagaactagtggatcccccgggctgcaggaattcgcacgagaccattacctagaacatcctaatcgaaaaaacaccctagtaatggatcccatctccagcatccctcccccggtgatgggcgcggcggtggcataccctccggcggccggcgcctcttactccgccggtccgtacgcgcacgcacacgcagggttgggctcgctgtaccctcctcctcaggcgccgggacccccctcctcgcaccaaggcggcgcggcagttgcgcacctgcacctgttctgggcggagcagtaccgcgagatctaggcgacgactgacttcaagaaccacaacctgccactggcccgcatcaagaagatcatgaatgctgacgaggaacgtgcgcttgatcaccgccgaggcgacggtggtgttcgccttctcctgctagatgttcatcctgcatcttacccgccactgctgggctcacgcatagtacaaaaaactgcgcattctgcaaaactggaacatctcggccgccgtgggacgcacctaagtcttcgaatttcctcaggaacattctgccgcgggaaaaaccccaggaccccttactcctcctgcagccacca

SEQ ID NO: 48276 - DNA, 662 bp, Zea mays
  misc_feature: Ceres CLONE 1457149-F
aagctggagctccccgcggtggcggccgctctagaactagtggatcccccgggctgcaggaattcgcacgaaaccattacctagaacatcctaatcgaaaaatcggcgttcccgatttctcagagcaattccatgtcctggtcaccaaagcactagagccgaacgccgcccgtgtagagcacagtgtagatcgtcttcggctagcccagctgatacgatggagaggatggcccacatggcgttgctggtggcaccatcatttctataagacagcaaggcgaggcgcccccggcggggtacagcggccgcaccagcgggagcggcggctagacaatgaacttccgggccgttggccaaggtgtggagctcgatgggtggagtccgcctccacagctgtgtcgagggactcagtcaccggctcgcagctagctggagaacgagatcggactcgcgctggacgatgccgactgactcttctccgccaactttcgggcctgcttgcatgcctttctcctgagcagtgacagtgattaagcgagtcctgcgcctgcagcccgtactatgcttgaccgacctgtacctgtcgttcaccgttgtaatgttgctcctgcgctctcctcttgacagatggttttctaatttgctaccagtccctttatgcc

SEQ ID NO: 48277 - DNA, 767 bp, Zea mays
  misc_feature: Ceres CLONE 1457151-F
  misc_feature: Encodes the peptide sequence at SEQ ID NO. 48278
  misc_feature (27)..(27): n is a, c, t, g, unknown, or other
  misc_feature (28)..(28): n is a, c, t, g, unknown, or other
  misc_feature (41)..(41): n is a, c, t, g, unknown, or other
  misc_feature (767)..(767): n is a, c, t, g, unknown, or other
ttaaatatagaggaggacggccggtgnnactccctctcttnctccacacccccaaaaaggagctcaccgcggtggcggccgctctagaactagtggatcccccgggctgcaggaattcgcacgagaccattacctagaacatcctaatcgaaaactagcagacagcaacatgaccgaggaggaggccaaaaaggtggaggtggaagtggaggtcaccaaggcggcgccggcgaaggagaacgccgccgaagagaaggccgtcatccccgcgaccgagtcgccggtcgcccaggagaagccgccagcgccggccgacgactccaaggccctggccatcgccgagattgcagataaatctactcctgagaagcctatcgctgagaagcaagggggctccagtatcagagatctcgcttcttgcaagggcggaaactgagaagaggaaactctctgattaaagcatgggaagataatgaaaaagcaacaagctgataccacggctactaaaaaaaggatccgttatttctttcaatgggagcacactaagaaaggcaaacttagaaccctgaaatgaagaaaaattgagaaaccactggcaaaaaaaaagaaacgttgcaaaattgctggagaaagaatcaaaaaacaaggggttgccattggatcccccaggggaaagtcccaaggaaaaaaaccagaagctaattggtgggaacccaaaaaaccgcccggcttaaagggaaagttccctctaaactgggccctaaaan

SEQ ID NO: 48278 - protein, 88 aa, Zea mays
  misc_feature: Ceres CLONE 1457151-F
MTEEEAKKVEVEVEVTKAAPAKENAAEEKAVIPATESPVAQEKPPAPADDSKALAIAEIADKSTPEKPIAEKQGGSSIRDLASCKGGN

SEQ ID NO: 48279 - DNA, 859 bp, Zea mays
  misc_feature: Ceres CLONE 1457164-F
  misc_feature (18)..(18): n is a, c, t, g, unknown, or other
  misc_feature (22)..(22): n is a, c, t, g, unknown, or other
  misc_feature (34)..(34): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (311)..(311): n is a, c, t, g, unknown, or other
  misc_feature (312)..(312): n is a, c, t, g, unknown, or other
  misc_feature (329)..(329): n is a, c, t, g, unknown, or other
  misc_feature (330)..(330): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (345)..(345): n is a, c, t, g, unknown, or other
  misc_feature (346)..(346): n is a, c, t, g, unknown, or other
  misc_feature (348)..(348): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (362)..(362): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (369)..(369): n is a, c, t, g, unknown, or other
  misc_feature (379)..(379): n is a, c, t, g, unknown, or other
  misc_feature (384)..(384): n is a, c, t, g, unknown, or other
  misc_feature (385)..(385): n is a, c, t, g, unknown, or other
  misc_feature (445)..(445): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (859)..(859): n is a, c, t, g, unknown, or other
atttttgtgctattattntatnatattggaggtncaannnnnnnntcnnnnnnnccaaagctggagctccccgcggtggcggccgctctagatctagtggatcccccgggctgcaggatttcgcacgagaccattacctagaacatcctaatcgaaaaatttcctcgccctccaacctctcctgatctcctcctctggtccgcatagaggagcagcttgccagccaaggacaccggagcacgggcacgggcgcacggcgagggcgaacctgcacccctcccctcttcttccgtttccacagcggggggtannggaaaaaggggaggagnntggnnngnnnnnctnnanatccnnnagtggangnnngangggcttttcnttcgnngaagaagcctggtggaaccacgagtcctccctgttgggtgggggcccccgccgacgcagncccccacccccccccggctcggggaaccggtggggattgctttggaaagtcaaaagcgccccccctcctctcgggtcacccgacgttttgaggagtaataaacaaagggctcgtccacctcccgccgagcgcttagggactacnnncttgggaaaagatatataaaaaaatattggtgggggaaacgggcatccgtcttcctccctccccttcccttggggggagaccaccctctctgttgtcaacggtcaccggacaccaggagggtagcgcagatagggccattgtgttcgactctcctgccgtgtggggagggaggcagccccccaccgcagggatcagagggggaccgagcggagccttgcccggagatctatgatggggagtcgccgcgccttgtcttcttttgtctcn

SEQ ID NO: 48280 - DNA, 548 bp, Zea mays
  misc_feature: Ceres CLONE 1457168-F
  misc_feature: Translation starting site: 147
  misc_feature (287)..(287): n is a, c, t, g, unknown, or other
  misc_feature (295)..(295): n is a, c, t, g, unknown, or other
  misc_feature (391)..(391): n is a, c, t, g, unknown, or other
  misc_feature (410)..(410): n is a, c, t, g, unknown, or other
ggagctccccgcggtggcggccgctctagaactagtggatcccccgggctgcaggaattcgcacgaagaccattacctagaacatcctaatcgaaaaggaacttccggtgccggcggcgaccacttgtggcgatccatccctcaccatgtcgtcggagaaggaggcggcgctcgccgccgtgctcgatgacagcccaaccatatttgacaagatcatcaaaaaggaataccttctactgtggtttatgaggacgagaaggtactggctttcagggacataaaccctncagctccnacacacattctcatcatccccaaagtcaaggatggactaactgggcctggcaaaggctgaagagagcacataaaaatactggctatctcctctatngtgcaaggtttgtgcaaancagaagacttgagaatgctacgcgtcgtcatcatgacggcccaggtggatgtcaatctggtttacaaattcccgtttaattcccctcgaagggagggaaattgaaacgggcccccccgcaaaaaaaaatttgggattt

SEQ ID NO: 48281 - DNA, 658 bp, Zea mays
  misc_feature: Ceres CLONE 1457171-F
  misc_feature: Encodes the peptide sequence at SEQ ID NO. 48282
tggagctcaccgcggtggcggccgctctagaactagtggatcccccgggctgcaggaattcgcacgagaccattacctagaacatcctaatcgaaaactagaagccaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcagccaacatcaaggtcgagtcctactggccggcgctcttcgccaagctcctggagaagcgcaacgtcgaggacctcatcctctccgttggatctggtggcggagctgctccagttgctgctgccgcccctgctggtggtgctgcggccgcggctgccccggctgtcgaggagaagaaggaagaggccaaggaggagtctgatgacgacatgggcttcagcctgttcgactgaggagacccctcgcccccagccattagcaaatttcacttgtgctgtccaagactatcttgtcttatgttatgtctctaggcttttgttacaactacccaagttttgagtttttgagacgtggctatggcaatgtgacgatgaactcaa

SEQ ID NO: 48282 - protein, 109 aa, Zea mays
  misc_feature: Ceres CLONE 1457171-F
  misc_feature (21)..(108): Pfam Name: Ribosomal_60s Pfam Description: 60s Acidic ribosomal protein
MASGELACTYAALILSDDGIAITAEKIATIVKAANIKVESYWPALFAKLLEKRNVEDLILSVGSGGGAAPVAAAAPAGGAAAAAAPAVEEKKEEAKEESDDDMGFSLFD

SEQ ID NO: 48283 - DNA, 632 bp, Zea mays
  misc_feature: Ceres CLONE 1457181-F
  misc_feature: Encodes the peptide sequence at SEQ ID NO. 48284
  misc_feature (209)..(209): n is a, c, t, g, unknown, or other
  misc_feature (215)..(215): n is a, c, t, g, unknown, or other
  misc_feature (252)..(252): n is a, c, t, g, unknown, or other
  misc_feature (273)..(273): n is a, c, t, g, unknown, or other
ggagctccccgcggtggcggccgctctagaactagtggatcccccgggctgcaggaattcgcacgagaccattacctagaacatcctaatcgaaaacccgagccgccaaaaccctaccgccgccgcgaatcccgcacgaccccaaccatgaccgtgctgagccgccctaccccgggcacggcccagtgcttcgggcgggaagagaccgncgtcgncgtcgcgtacacgaagccggggcgcggcctgatcaangtgaacggcgtcccgattganctgatccgacggagatgctccggctcaaggcctcgaggccatctgctggcggggcggtcccgggtcaagacatcgacatgtcgatccccggtccccgccgcgggaaaaaatctcaaatctactccatcccccaagcgtctcccaaggggtctctcctactacccaaatacatctaccaagaccccaaaaagagattaaagaatcttttccccctacgaatagcaccctctcgttggttgacacccggggctgcgaaaccaaaaaaatttgccggaaaatggtgccccccccccggttcccaaaatctcaccccttaaaagggggcccggggcaccatcgaatttttccaaacggggggg

SEQ ID NO: 48284 - protein, 107 aa, Zea mays
  misc_feature: Ceres CLONE 1457181-F
  misc_feature (21)..(21): Xaa is any aa, unknown, or other
  misc_feature (23)..(23): Xaa is any aa, unknown, or other
  misc_feature (35)..(35): Xaa is any aa, unknown, or other
  misc_feature (42)..(42): Xaa is any aa, unknown, or other
MTVLSRPTPGTAQCFGREETXVXVAYTKPGRGLIXVNGVPIXLIRRRCSGSRPRGHLLAGRSRVKTSTCRSPVPAAGKNLKSTPSPKRLPRGLSYYPNTSTKTPKRD

SEQ ID NO: 48285 - DNA, 638 bp, Zea mays
  misc_feature: Ceres CLONE 1457183-F
  misc_feature: Encodes the peptide sequence at SEQ ID NO. 48286
  misc_feature (377)..(377): n is a, c, t, g, unknown, or other
gctctagaactagtggatcccccgggctgcaggaattcgcacgagaccattacctagaacatcctaatcgaaaagccttcgacgccccaaaccctagcccgacccctcctcctccacctgcgccaccgcccaccatgagctccgccgccgcgccagcttccgtcggcagcggcaaggagcttgccaacccgccagctgacgggatcaccaacctccgcttctccaaccacagcaacaacctccctcgtctcctcatggggacaagacggtgcggttctactacgccgaacgcaacctgctcaagggggaattcatgcaccccgagggcggtcctcaattgctggcttccacaaaaactccttggggcttttaggccngaaaccaaaaatgcggtccccagggttgggattttagcctgcccaaagaaaaacctttttggggggggcataaatgggccccgtttctttggcgggaaaaaacccctttaggggcgggggggagaggatccccgcgggggggggggaaaaaaaatgggaaaagggcgggggacccacagaagaattttggggggaaaaaaacccccccccttgggggggaagaatatcccccccccgcgaggggggtgatttttttccttg

SEQ ID NO: 48286 - protein, 117 aa, Zea mays
  misc_feature: Ceres CLONE 1457183-F
MSSAAAPASVGSGKELANPPADGITNLRFSNHSNNLPRLLMGTRRCGSTTPNATCSRGNSCTPRAVLNCWLPQKLLGAFRPETKNAVPRVGILACPKKNLFGGGINGPRFFGGKKPL

SEQ ID NO: 48287 - DNA, 659 bp, Zea mays
  misc_feature: Ceres CLONE 1457184-F
  misc_feature: Translation starting site: 274
  misc_feature: SWISSPROT Homolog: EC 1.11.1.7 Peroxidase
  misc_feature (339)..(339): n is a, c, t, g, unknown, or other
aagctggagctccccgcggtggcggccgctctagaactagtggatcccccgggctgcaggaattcgcacgagaccattacctagaacatcctaatcgaaaatcaccaaacgccggtggagtcactcgagcccgcccgggtctcttcctcttccattgattccattcaagatcactactgttaccagccagccagtcgttcgttaagaagagagcgagcgagcaagagagagagagagagggagaagggggaagatcagaacgaagagagggagatgagggggcaaacgcagacagcttccgcggggggccggtggcgaagcgacggcgctgcggcgtgntgttggtggtgggtggccgtggtcctcctgctttgccatttaccgagctgcgcgcgcgcggggctgctggaatccaacccgggcctgggctacaacttctacaagaacagctgccccagcgtggactccatcgtccgcagcgtcacctgggcgcaggtcgccgccaaccctgccctcccgggtcgcctcccctcgcctcattccatgactgcttcgtcaagggctgcaacgcgtcgatcctgctggaacacgggcaagcgaagagacggcggcgccaaactgtcggtgggcgggtacgaagtgatcgacccatcaaggcc

SEQ ID NO: 48288 - DNA, 662 bp, Zea mays
  misc_feature: Ceres CLONE 1457188-F
  misc_feature: Pfam Name: Cation_ATPase_C Pfam Description: Cation transporting ATPase, C-terminus
  misc_feature: SWISSPROT Homolog: EC 3.6.3.8 Calcium-transporting ATPase
aagctggagctccccgcggtggcggccgctctagaatagtggatcccccgggctgcaggaattcgcacgagaccattacctagaacatcctaatcgaaaactcaaactgggggcagtgctcctcatgggagggcttcaaggtgtcgccattcactgcaggagcgaggacattcagctttgatgcaaatccatgcgattacttccagggtggcaagattaaagcaacgaccctctctttgtctgtcttggtggcaattgagatgttcaactcactgaatgccctgtcagaggatggcagcctcctgagcatgccgccatgggttaatccatggcttctcctggccatgtccgtttcttttgggctgcatttcttgatcctctacgtgcctttcctggctcaagtgtttgggattgtgcccctcattttgaacgaatggctcttgttgatagcagtggccttaccaggggtgctgatcgatgaggttctcaaatttgttgggcggtgcctgacagctcgtgcctaaaacaatcagggaagaggaaagcaaagtaaatgctagtgatcatcggtattaaaatctggaccgccacggaaatcgatattggatgtgacaccccattggttttgaattgctaagggctctccatcctttctgattctt

SEQ ID NO: 48289 - DNA, 651 bp, Zea mays
  misc_feature: Ceres CLONE 1457189-F
  misc_feature: Encodes the peptide sequence at SEQ ID NO. 48290
acccgcggtggcggccgctctagaactagtggatcccccgggctgcaggaattcgcacgagaccattacctagaacatcctaatcgaaaaaaacaaaaaaaatctcaattctcaaagtcgtcgatccagcggtagcagcgcacaaaccgatcgatctaggagagggagacaaccaaccaatttcatcgccgatcaaacaaggaaaaagatcccggccatggccacgcggtcgctggagctgacgctgatctcgggcaaggacctcaaggacgtgaacctgatgtccaggatggaggtctacgccgtggtgtcgctctccggcgacccccggtcgcggcagcgggtccaggccgaccgcaccggcggccgcaacccgacctggaacgccacgctccgcttcgccgtcccggccaccggcgccggctccctccacgtcctcctccgcgccgagcgcgccctcggcgaccgcgacgtcggcgaggtccacatcccgctgtccgagctcctctccggcgcccccgacggccccgtccccgccaagttcgtcgcctaccaggtgcgcaagatctcctcgggcaagccccagggagtcctcaacctgtcgtacaagctcggcgaggtcgccacggctacgccccctcccgctacgcc

SEQ ID NO: 48290 - protein, 144 aa, Zea mays
  misc_feature: Ceres CLONE 1457189-F
  misc_feature (6)..(90): Pfam Name: C2 Pfam Description: C2 domain
MATRSLELTLISGKDLKDVNLMSRMEVYAVVSLSGDPRSRQRVQADRTGGRNPTWNATLRFAVPATGAGSLHVLLRAERALGDRDVGEVHIPLSELLSGAPDGPVPAKFVAYQVRKISSGKPQGVLNLSYKLGEVATATPPPAT

SEQ ID NO: 48291 - DNA, 655 bp, Zea mays
  misc_feature: Ceres CLONE 1457191-F
  misc_feature: Encodes the peptide sequence at SEQ ID NO. 48292
tggagctccccgcggtggcggccgctctagaactagtggatcccccgggctgcaggaattcgcacgagaccattacctagaacatcctaatcgaaaaaaaaaacctctgagagacgaaaccccaaggcggagccggaggacccgatggaaaagaaggatctgctcgccgtccggaagaggctgcctgcggcggcggccaagcggaggcacaaggtggtgacgcccgctaaggccggcgccgggcgtctcgcgaaggtgatcgctggatacctcgcgtccgactcctacatgtacgcgccgctgatctccgctccgccatctctcccaccgccgcctccggcgtcttcggtggcgccatccgcgacgcctcttatttccgctcctgagaaagaaatcactggtgcaaaaatacagaggctctttgcaagctacattcactgtctagaagtatctgtggacatgttcttggagctgtgcttctagcatgacctttaagagctacaatacaatagttgtttctatgatctgttatgttaatgactaggtactgtggcttaccaatctgccttcttctggagttctcatgtgatcgctcactatttaatatagattgttcagttaagtagctttatcttgcgggctatgttcactaatg

SEQ ID NO: 48292 - protein, 112 aa, Zea mays
  misc_feature: Ceres CLONE 1457191-F
MEKKDLLAVRKRLPAAAAKRRHKVVTPAKAGAGRLAKVIAGYLASDSYMYAPLISAPPSLPPPPPASSVAPSATPLISAPEKEITGAKIQRLFASYIHCLEVSVDMFLELCF

SEQ ID NO: 48293 - DNA, 659 bp, Zea mays
  misc_feature: Ceres CLONE 1457197-F
  misc_feature: Encodes the peptide sequence at SEQ ID NO. 48294
  misc_feature (566)..(566): n is a, c, t, g, unknown, or other
  misc_feature (567)..(567): n is a, c, t, g, unknown, or other
aaagctggagctccccgcggtggcggccgctcttcactatagtatacccccgggctgaggaattcattcgacaacaccttacctagaactcctaatcgaaaaactgcgatacggtgagcttcgttcgttcagttcatccgtgttcttgtttgctacgtctacagagagatgatgtcttgctgcggaggcaactgtgggtgggcgccttgttggctggtgtaccgtactgtgggacacaacgaggactttgtgtttcccttttgcaccatcacaaaacccatggctcgtcaaccttggagcaataatggccaaagaaattccccttcaaattcattatatggaggagttcctggacccatgcctctggtcccttttaggaaggaacttgcagttggttgtgaacacatgcgtagaattgctgctgataatactcttgtgctagacgatattctgggccttacgcaagaattacctgtcattgaagaccagcatccatatacttgccaaacaaaccattcccagacttcttgttgataaggaaatcggaaaccacgaattataacccnngggaggcatgaatttagatgaacagatgcttgctccttaatctatcaaggaagaagtcgttgtccgtaaatctgacatatagagttgcaagt

SEQ ID NO: 48294 - protein, 121 aa, Zea mays
  misc_feature: Ceres CLONE 1457197-F
MMSCCGGNCGWAPCWLVYRTVGHNEDFVFPFCTITKPMARQPWSNNGQRNSPSNSLYGGVPGPMPLVPFRKELAVGCEHMRRIAADNTLVLDDILGLTQELPVIEDQHPYTCQTNHSQTSC

SEQ ID NO: 48295 - DNA, 663 bp, Zea mays
  misc_feature: Ceres CLONE 1457208-F
  misc_feature: Encodes the peptide sequence at SEQ ID NO. 48296
cgattgggtaccgggccccccctcgagccctgcagtggtaaaggagagtataaccgaatagaaatagctttggtgcaaacaagcaagcagcagagcagatcaagtaaaggtagcaatttgagtagtgtgcaagctaagatggggcaacaagaaaaggaagtgatcccgctgatgaccccgtacaagatgggacagctggagctctcccaccgcgtggtgctggcgccgatgacgcggtgccgcgccatcggggacgtgccgcagccgcacgccgccgtgtactactcgcagcgcgccagcaggggcggcgtgctcatcaccgagggcacgggggtgtccgccaccgcgcagggcttcccggggtcccccggcatctggacgcaggagcaggtggcggcgtggaagcccatcgtcgacgccgtccaccgcaagggcgcgctcttcttctgccagatcgcgcacgtcggaagggcatccaccaacgatttccagccggacggccaggcgccggtctcgagcacggacgcgcagctcccacccgacgccgagtccggcacggtgttctccaggccacgccggctgcgggccgacgagatcccggggatcgtcgacgacttcaggcgcgccgcgcgcaacgcgatcgaggccgggttcgacggcgtg

SEQ ID NO: 48296 - protein, 175 aa, Zea mays
  misc_feature: Ceres CLONE 1457208-F
  misc_feature (10)..(175): Pfam Name: Oxidored_FMN Pfam Description: NADH:flavin oxidoreductase / NADH oxidase family
  misc_feature: SWISSPROT Homolog: EC 1.3.1.42 12-oxophytodienoate reductase
MGQQEKEVIPLMTPYKMGQLELSHRVVLAPMTRCRAIGDVPQPHAAVYYSQRASRGGVLITEGTGVSATAQGFPGSPGIWTQEQVAAWKPIVDAVHRKGALFFCQIAHVGRASTNDFQPDGQAPVSSTDAQLPPDAESGTVFSRPRRLRADEIPGIVDDFRRAARNAIEAGFDGV

SEQ ID NO: 48297 - DNA, 670 bp, Zea mays
  misc_feature: Ceres CLONE 1457212-F
caattgggtccgggccccccctcgagccctgcagtggtaaaggatttgtggccgatgcgctcggtatccctcactatcgtcgttcaatgccatggatctgcgcctgttcgagaacatgtgtgtctgtgtagtcagctacgcgtgaggacacgtgtcatctgaagagcaagttggtacctggaatctcaagtcccaggtcaagaacaggtaccgcaggatgaggcgcatggaggatgctgcgatgagttcgtgagagagatctaggccgtcgtctcccagtcaactttgggttgctggaccgttgtctccttataatgtaattatttatagaactcctattatatagtaaagatgtgacattcgatccaaaaaaaaaaaaaaaaaaccagagctctgggaattcctgcagcccgggggatccactagttctagagcggccgccaccgcggtggagctccagcttttgttccctttagggagggttaatttcgagcttggcgtattcatggtcatagctgttttctgtgtgaaattggtatcggctcacaattcccacaacatacgagccgggagcctaaagtgtaaaggctggggtgcctaatgagtgagctaactcacattaattggggtggcgctcactgcccggttttcaggccgggaaaactggtcg

SEQ ID NO: 48298 - DNA, 627 bp, Zea mays
  misc_feature: Ceres CLONE 1457215-F
  misc_feature: Encodes the peptide sequence at SEQ ID NO. 48299
gggccccccctcgagcactgtagtggtaaaggtccctgtccgtggcgttcctggcggccccgccttccgcgggcggctgggtcgcctggggcctcaaccccagggcgcagagcatggacggcacgcaggcgctggtcgccgtccccagctccggcggcggcggcgcgtacgaggtgcagacctacagcatctccgggacctcgctcggcgccccgggcccgctctccgcctaccggacttccggcctcgccgccgaggtcggcggcgacggccgcgtccgggtgttcgcgaccctcgtgctccccaacggcacgggcgccgaggtcaaccacgtctggcaggtcgggccctactccggcgggatccagatacacgacaccaagggcgacaacatgaacgccaaggggacgctcaaccttctaaccggcgccactgccgccgccggcggagggggcagcatcatcaggaagaaaaatgtgagttggtcggtccccagaccccaaacaccccctaacaaggcattccttcgtttcttcgattctgaccccatcagggcagttcttcgatacagccaagacaatcagctggcaaattttattccacaaaatataaactctctcgctgtaa

SEQ ID NO: 48299 - protein, 171 aa, Zea mays
  misc_feature: Ceres CLONE 1457215-F
  misc_feature (1)..(123): Pfam Name: DUF568 Pfam Description: Protein of unknown function (DUF568)
MDGTQALVAVPSSGGGGAYEVQTYSISGTSLGAPGPLSAYRTSGLAAEVGGDGRVRVFATLVLPNGTGAEVNHVWQVGPYSGGIQIHDTKGDNMNAKGTLNLLTGATAAAGGGGSIIRKKNVSWSVPRPQTPPNKAFLRFFDSDPIRAVLRYSQDNQLANFIPQNINSLAV

SEQ ID NO: 48300 - DNA, 655 bp, Zea mays
  misc_feature: Ceres CLONE 1457219-F
  misc_feature: Encodes the peptide sequence at SEQ ID NO. 48301
  misc_feature (54)..(54): n is a, c, t, g, unknown, or other
caattgggtaccgggcccccctcgagccctgcagtgtaaagggggcgcggagcncaccgtccagtccatcactgccctttgttctctcctccacagtcgcagacaaagctggtccgtctcgcggagaggggaaggtggataggcggcacccacccatcacccatggctgggttgcaaagatcggcgaccacgttcagacggtccggctcgtcgggcctggtctgggacgagcgtttcctgaccgaggccgaggccgaggccgacgccgacgccgaggcgaaggccggcgccgcggaggatgccgagcagccggagctccggcactcgaggagcgtcggcatgctgcgccgtgcgggcagcggtggagacagccgcagcaagaagggcaaggagagtaggcagaagcagacggagtcggcgcggcgcagcaaccagcaggtgttccggaccaaggacgtggccccggacatggatcccccctcgccgagggtctccggctgcgccttctgcgccgtcttccgcgggggctctggcggtgcccgcaggccacaggcacgccgccggtccaagcccaggaagaagtgacggcgtagcaacacgtacgtacgtgcggtacgttgttgtttgtgtcatctgtaaagtccgggccatggtg

SEQ ID NO: 48301 - protein, 140 aa, Zea mays
  misc_feature: Ceres CLONE 1457219-F
MAGLQRSATTFRRSGSSGLVWDERFLTEAEAEADADAEAKAGAAEDAEQPELRHSRSVGMLRRAGSGGDSRSKKGKESRQKQTESARRSNQQVFRTKDVAPDMDPPSPRVSGCAFCAVFRGGSGGARRPQARRRSKPRKK

SEQ ID NO: 48302 - DNA, 655 bp, Zea mays
  misc_feature: Ceres CLONE 1457220-F
  misc_feature: Encodes the peptide sequence at SEQ ID NO. 48303
  misc_feature (310)..(310): n is a, c, t, g, unknown, or other
cgattgggtaccgggcccccccctcgagccactgcagtggtaaaggagagtaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatnccttgccgacgaacgatccatggttctctgtatctgcgtctgttcatatgcctgatgccgacttgtgctgtatgtagttgcctggatttcaatcctgttttgcttacgtacccaccccatggatcatctggtcaccgcgacccattaatcctagtaaataacaagtttcaaaaaatggatcccaaaaaaaaaaaaaaaaacccgaacctcctggaaattcctggggccccgggggaaaacctatattttaaaaacggcccccccccccgcgggggaaaccccccttttttgttccccttttggggggggggtaatttttccaagcttggggggaaaaaaaagggg

SEQ ID NO: 48303 - protein, 58 aa, Zea mays; identical to SEQ ID NO: 46528
  misc_feature: Ceres CLONE 1457220-F
  misc_feature (6)..(56): Pfam Name: UPF0057 Pfam Description: Uncharacterized protein family UPF0057

SEQ ID NO: 48304 - DNA, 849 bp, Zea mays
  misc_feature: Ceres CLONE 1457222-R
  misc_feature: SWISSPROT Homolog: EC 4.2.1.19 Imidazoleglycerol-phosphate dehydratase
  misc_feature (607)..(607): n is a, c, t, g, unknown, or other
  misc_feature (849)..(849): n is a, c, t, g, unknown, or other
ctccccgcggtggcggccgctctagaactagtggatcccccgggctgcaggaattcccagagctctggttttttttttttttttttgaacgcgcaaagatcaatgcattcccttcaatgtccaaacaatttacatacccctatgtttctgcggatgatccaaacgcagcattattcctgaccggggtagcttacaaagtcacaggctcacagcatgtctagaccttcaatcttcaaatatcctgtaactcccgcgagcaaataataaagttgcagtagcgagcaaaccccctatgccactgtcacaaggcaaaaaaaaaggggggcttgctagttgctaaatggttcttgattatcccattagcaatgttcaaaggctaacgcaggctcccaacgtgagcagcaaaaaccaagctgtctactctgcaggttttcctctcattgatgtgccctgcaggggaaaatatgcgttcgtccaaactgcgatgctatgatctcgacaaaacacctttggagctggggacagtgccttgacggcccaggtcatactctgttgcctgtcaaagggcccaagcaaacgctttgaaagatgcctcgatgatatggtngtgagtttttcccaccaagctgacggatgtgaagagtcatcccagatgtgttcaccacagattggaagaagtgctcaaccagctgtgtatcatatgtgccaactctttgagtaggatatctaagccacagcttaaatgagggcgaccagacagatccagtataacctcaacgctgcctcatcaagcggtgctgtaaaatgaccaaatcggttattccctttcgatcaccagtgctttcaagn

SEQ ID NO: 48305 - DNA, 655 bp, Zea mays
  misc_feature: Ceres CLONE 1457222-F
  misc_feature: Encodes the peptide sequence at SEQ ID NO. 48306
  misc_feature (655)..(655): n is a, c, t, g, unknown, or other
caattgggtacgggccccccctcgagccactgcagtggtaaaggaggctcgacatcctccgcctccgaacatggccgacccgaacctcgtgctcccctccgcgaagtgcctccaccccggcgcggcaactccatcgagccgcggcgtggccatccgcgaggtgatctccaccgatttgtataaggtcaatgggggaggtggagcagaggcgtggtgatcgatctgcggggggaagattgtggataggcgtgggaacgccaccggccaggtctacctcctcgccggggacggacgactcaaacgctccgtgatgtccagcgaggggacaacggagaactacgacgagctagagctctcgcgacggtgacgaggacgtatacgggcacgaagggtgtactacaggatgagcgcaatatcaaccagggaatcgcgcctaaactcataggcatcgatgggaggaactaaagcgatgttgatacagacatgctagacattgatggaacacagaataaatcgaagtggggtggctatgctattttcggagtctccacgagagtatctatggcaggagctggtgcttagggaattctgctgtataaacatatcctgtagatagcttgaattaaggagcttgccctgactgttcctgctacan

SEQ ID NO: 48306 - protein, 32 aa, Zea mays
  misc_feature: Ceres CLONE 1457222-F
  misc_feature: SWISSPROT Homolog: EC 4.2.1.11 Phosphopyruvate hydratase
MLDIDGTQNKSKWGGYAIFGVSTRVSMAGAGA

SEQ ID NO: 48307 - DNA, 781 bp, Zea mays
  misc_feature: Ceres CLONE 1457228-F
  misc_feature: Encodes the peptide sequence at SEQ ID NO. 48308
  misc_feature (1)..(1): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (54)..(54): n is a, c, t, g, unknown, or other
  misc_feature (55)..(55): n is a, c, t, g, unknown, or other
  misc_feature (482)..(482): n is a, c, t, g, unknown, or other
  misc_feature (550)..(550): n is a, c, t, g, unknown, or other
  misc_feature (585)..(585): n is a, c, t, g, unknown, or other
  misc_feature (586)..(586): n is a, c, t, g, unknown, or other
  misc_feature (644)..(644): n is a, c, t, g, unknown, or other
  misc_feature (686)..(686): n is a, c, t, g, unknown, or other
nttttcccccttaactccctaatccaattccaaataaaaaannntttttctccnncccccaaatgggtaccgggccccccctcgaaccactgcagtggtaaaggggaggccacctcacccctggcagggttgaagcctcgcctttccaaggggaatcaaagccatggacctaatgctgtcaaatcaaagagcccaacgagtggagacgaaggtcagacgaggaaaaaggctcccaattcttctcttcctaaggcacccattgtccaggtgtcccatggtgacgctggtgtcggcagtaataaagatggcaagaatgagtctcgctcatcttccgtggatgcaacattgctggatgactccaaggagaaaaaggaaaactcgtaagccattagcacagctcttttccatcaaaagtgacgaaaaacagtcaaatggtgagagtgcaaagtttttaaaagttggtaaaattaaaacatatgaanaaaaccttcgaggggggaggaagagagcaggagaaaggaaagagaggccgaggtccaacagtcggggnaggccaggcgggcaggagaggagggaggagagccnntaggggtagggagaggaaggccagcggtgaagaaagtgggagttggttattggttggntctaaaatagttgaaatttaaaggggaacgacccaatgtcgnaagacgttctcttagatggacccccaccccccccgcccaacggtatcacaattagaacaaaaaatttccccgacactacatataaaacaaacaat

SEQ ID NO: 48308 - protein, 126 aa, Zea mays
  misc_feature: Ceres CLONE 1457228-F
  misc_feature (13)..(13): Xaa is any aa, unknown, or other
  misc_feature (14)..(14): Xaa is any aa, unknown, or other
  misc_feature (18)..(18): Xaa is any aa, unknown, or other
FPLNSLIQFQIKXXFSPXPKWVPGPPSNHCSGKGEATSPLAGLKPRLSKGNQSHGPNAVKSKSPTSGDEGQTRKKAPNSSLPKAPIVQVSHGDAGVGSNKDGKNESRSSSVDATLLDDSKEKKENS

SEQ ID NO: 48309 - DNA, 651 bp, Zea mays
  misc_feature: Ceres CLONE 1457234-F
  misc_feature: Encodes the peptide sequence at SEQ ID NO. 48310
  misc_feature (651)..(651): n is a, c, t, g, unknown, or other
cgattgggtaccgggccccccctcgagccctgcagtggtaaagggtagagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgcctcgaggctatctgctgctgctgctagttctgcttggagggcatgggcgtccatcatcgtggagatgtggccatgcgggacacccaccgccgaataaaatgcttgtacttatatgcacgcacgttagaaatgcattagtgtctgtttgatgtgatcttttgtgtgtgtgtgcgcgcatcttcatttgcactgggaaatgctttattatttgtgaagtctgtaaatctggtgtatgtatcttgggcagatgaactctattattgtgcatatatctcgcttgattggacaaaaaaaaaaaaaaaacctgatgctccagcttttcaccctatcccagagcggcagcttcagatccagaagtgatgccatgcn

SEQ ID NO: 48310 - protein, 54 aa, Zea mays
  misc_feature: Ceres CLONE 1457234-F
MYNPPSGQDMSYYDHVQKRHEEKGCLYACLFTACCCFCCFETCECCLEAICCCC

SEQ ID NO: 48311 - DNA, 657 bp, Zea mays
  misc_feature: Ceres CLONE 1457236-F
  misc_feature: Encodes the peptide sequence at SEQ ID NO. 48312
cgattgggtaccgggccccccctcgagccctgcagtggtaaaggggagacgtgccccactcgacaacccagtcttcccctattcctcctttcctctcttttcatttcccatctctctctgcgccgtcccgtgctccctccgctagttctcccaattccttccccacctcctcggtcgtcgcctcccccaaagagcaggagccgcctcgtccctgccggtcccgacccccatcccgtgccgcgtccaacgccatgaatcccgagtacgactacctcttcaagctgctcctcatcggcgactccggtgttgggaagtcttgcctgctgctgaggtttgcggatgattcatatctggagagctatatcagtactattggagttgattttaaaatccgcaccgttgagcaagatgggaagacaatacagctacagatttgggatactgctggccaagaacgctttaggaccatcacaagcagctactaccgtggagctcatggcattattgttgcgtatgatgtaactgaccaggagagctttaacaatgtcaagcactggctgaatgacattgataggtatgccagtgacatgtgcaccagcttgtggtggggaacaagtgtgacctggctgaagacagagtaatttcttaccaggctgg

SEQ ID NO: 48312 - protein, 129 aa, Zea mays
  misc_feature: Ceres CLONE 1457236-F
  misc_feature (10)..(128): Pfam Name: Ras Pfam Description: Ras family
  misc_feature: SWISSPROT Homolog: EC 2.7.11.1 Non-specific serine/threonine protein kinase
MNPEYDYLFKLLLIGDSGVGKSCLLLRFADDSYLESYISTIGVDFKIRTVEQDGKTIQLQIWDTAGQERFRTITSSYYRGAHGIIVAYDVTDQESFNNVKHWLNDIDRYASDMCTSLWWGTSVTWLKTE

SEQ ID NO: 48313 - DNA, 793 bp, Zea mays
  misc_feature: Ceres CLONE 1457238-F
  misc_feature (36)..(36): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (440)..(440): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (475)..(475): n is a, c, t, g, unknown, or other
  misc_feature (476)..(476): n is a, c, t, g, unknown, or other
  misc_feature (512)..(512): n is a, c, t, g, unknown, or other
  misc_feature (513)..(513): n is a, c, t, g, unknown, or other
  misc_feature (515)..(515): n is a, c, t, g, unknown, or other
  misc_feature (531)..(531): n is a, c, t, g, unknown, or other
  misc_feature (547)..(547): n is a, c, t, g, unknown, or other
  misc_feature (548)..(548): n is a, c, t, g, unknown, or other
  misc_feature (562)..(562): n is a, c, t, g, unknown, or other
  misc_feature (575)..(575): n is a, c, t, g, unknown, or other
  misc_feature (585)..(585): n is a, c, t, g, unknown, or other
  misc_feature (586)..(586): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (608)..(608): n is a, c, t, g, unknown, or other
  misc_feature (618)..(618): n is a, c, t, g, unknown, or other
  misc_feature (639)..(639): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (672)..(672): n is a, c, t, g, unknown, or other
  misc_feature (675)..(675): n is a, c, t, g, unknown, or other
  misc_feature (681)..(681): n is a, c, t, g, unknown, or other
  misc_feature (682)..(682): n is a, c, t, g, unknown, or other
  misc_feature (693)..(693): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (753)..(753): n is a, c, t, g, unknown, or other
  misc_feature (755)..(755): n is a, c, t, g, unknown, or other
ggatcggtcgtacccgccctaaagggcagtctatanaaantnnnnnnnnncaaaagtgggactccccgcggtggcggccgctctataatagtggatcccccgggctgcaggaattcgcacgagaccattacctagaacatcctaatcgaaaaaaccccacccatctcactctcgtctcctgttcgccagagccactccgctccagacattttcctcccctaaatctccctcccgagactggtcccgctgccgacttggccatggcgaccatggggaacctcgcggagctagcgtggcagcaccggggggtggaaatccccccggtggctatcgtggccgaggccgcgagcctcaatatccgccgtctgtcatgcgcccggtgccgtggtgtccttcttgtgggtgttggtcttctcgtatggtgtttttacaaggagaangnnnacttgctgttttggatgtggccccccccccnnggggggggagggggaggccggctaagacatcagtcnncntccccccccaatagcngcctcgcgctaccgtnncctgaggggtgggntgaacggtgagcnttcactcccnntgtaggccaccacccaannngnctctattttnccaaacctccccgcaacaacnaannngaacaacaaccttattataagaaccagnctntactgnngcaaattgtangcttttaaatttttannngaaataataatttctcccaatatcaacaacaccaccgatggncngtttatattatggccggactataagttgtggatatacg

SEQ ID NO: 48314 - DNA, 659 bp, Zea mays
  misc_feature: Ceres CLONE 1457239-F
  misc_feature: Encodes the peptide sequence at SEQ ID NO. 48315
  misc_feature (421)..(421): n is a, c, t, g, unknown, or other
gctctagaactagtggatcccccgggctgcaggaattcgcacgagaccattacctagaacatcctaatcgaaaaactaaaactcggatagatctcagtgcagtgcttccctgttccctccatcaagaaacagcaaagatccagtgcagagagagagagaagcgccatggcactctgaacaagaaaagaaagagctagagagatctcagtcagccagtctctcacaacacaatgccggcaaccaccaagccgatcttgctcccaagggcgtgggcagcagcgccactcctcctcctgctgctgctcgtcctgcacgggagaggaggccactgcgtcggcatggaggtggcggaactggagatggactcggaggcgcaccggcggttgctgcgggaggcgaccacggggcggaggtacatcanctacaacgccctgtggggcgacgtggtgccgtgctccaggaccggggtgccctactacaactgccggatctcgaccaccgccaacccctacacccggggctgcgagagcatcacccagtgcagggacccggatccctaggcttttgctttgcttgccccctcgccttgcaaagggaagtgggtgtggggctggctgctcctcgctccttcaactttgcagggggggtgttgctgccaa

SEQ ID NO: 48315 - protein, 109 aa, Zea mays
  misc_feature: Ceres CLONE 1457239-F
  misc_feature (37)..(106): Pfam Name: RALF Pfam Description: Rapid ALkalinization Factor (RALF)
  misc_feature (64)..(64): Xaa is any aa, unknown, or other
MPATTKPILLPRAWAAAPLLLLLLLVLHGRGGHCVGMEVAELEMDSEAHRRLLREATTGRRYIXYNALWGDVVPCSRTGVPYYNCRISTTANPYTRGCESITQCRDPDP

SEQ ID NO: 48316 - DNA, 650 bp, Zea mays
  misc_feature: Ceres CLONE 1457242-F
  misc_feature (252)..(252): n is a, c, t, g, unknown, or other
tccccgcggtggcggccgctctagaactagtggatcccccgggctgcaggaattcgcacgagaccattacctagaacatcctaatcgaaaagctcgcaccgcttaatcaacaacctgacaagttagctacccgcgcagcgccgcgcgccatggctacgatgaaccaccgcattgtgcccctcctgctggtcgcagccacactgctcgcgcaggccgcggcctgcccctactgcccgacgccgaagccgccgncggcctccgccgccgtcgtcgtcgtccacgccgtgccctcccccgccctactcgccgtcgccgtccacgccgacgggtaagtgccccgtgaacacgctcaagctgctcgcgtgcgtggacgcgctcaacggcctcgtgcacgccgtcatcgggaccaaggccagcgacacctgctgcccgctgctctccggcgtggccgacctcgacgccgcgctctgcctctgcaccaccatcaaggccaaggcgctcagcgtcagcctcgtgctccccgtcgccatctcggtgctcggtaacgagtcggcaagcatgtgccctccagcttccagtggccgtaatcacatcagctgcataaatgtgctactatgaagtatcaccaccactaatctatatccgcatgc

SEQ ID NO: 48317 - DNA, 695 bp, Zea mays
  misc_feature: Ceres CLONE 1457245-F
  misc_feature: Encodes the peptide sequence at SEQ ID NO. 48318
aaagctggagctccccgcggtggcggccgctctagaactagtggatcccccgggctgcaggaattcgcacgagaccattacctagaacatcctaatcgaaaaaagaagaaatccagtagcacactagacactagcagtaacgccaagaaagaatggcgtgctgcaccaccaccagccgtctcgtcctctcggcggcggccgccctgctcgccgtggcctgcggcgccgcggaagccccgagctactgcgcgccggggcaggccatcccgtaccgcccgctgtccggctgcacctggtacgttgcgagccggagctgcgacgtgatcgaggccatgctcccgaaccgggccgtcctcaaggagacgtgctgcagccagctgcgggacatcccggcggagtgccggtgccgggcgctgcgggtgatgatggagacgcctctcgtcgtgggcgcgaagcgggggcccagcagaggtgctgggtcgcgcaggctcggttcgcccccgacctcgtcgccgcgggcgagtgcggcctgctcaccgccacggcaggcctttctgcaccccctccacaacaagtgataaggtgacccagggtaatgaaccgctccccgtaaccgggcgggtcccaaaaaaagggggaaaataatcccccggccaaacgggtcttataaaattcaagggccccggccggccccc

SEQ ID NO: 48318 - protein, 141 aa, Zea mays
  misc_feature: Ceres CLONE 1457245-F
MACCTTTSRLVLSAAAALLAVACGAAEAPSYCAPGQAIPYRPLSGCTWYVASRSCDVIEAMLPNRAVLKETCCSQLRDIPAECRCRALRVMMETPLVVGAKRGPSRGAGSRRLGSPPTSSPRASAACSPPRQAFLHPLHNK

SEQ ID NO: 48319 - DNA, 693 bp, Zea mays
  misc_feature: Ceres CLONE 1457249-F
  misc_feature: Encodes the peptide sequence at SEQ ID NO. 48320
  misc_feature (410)..(410): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaacattcacatcgcactctcctccagcctccaggcttggcaagcgtgcttcacatgaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcnaccgcttcgtggacctcggcgagttcagggcgttccacgcgcgcggcggcggcggcatgaacgacgacgccgagctccgcgccgccttcgacgtctacgacgtcgacggcgacggccgcgtcacggcggccgagctgggcaaggtgctcgcgcgcatctncgagggcagatgcaccgcccaagaagtgcgagcggagggtcgccggcgtcgacgccgaacggctgcgtcgggttcgaggacttcaagaagaggatgtgcccccatccccaaacccgaacccgg

SEQ ID NO: 48320 - protein, 175 aa, Zea mays
  misc_feature: Ceres CLONE 1457249-F
  misc_feature (106)..(134): Pfam Name: efhand Pfam Description: EF hand
  misc_feature (29)..(57): Pfam Name: efhand Pfam Description: EF hand
  misc_feature: SWISSPROT Homolog: EC 2.7.11.1 Non-specific serine/threonine protein kinase
  misc_feature (82)..(82): Xaa is any aa, unknown, or other
  misc_feature (135)..(135): Xaa is any aa, unknown, or other
MSNSAASEKQSQQAGHRQRPPAASAADAEMQRVFCRIDADGDGRISASELAAVTRAISPPASSSHGRREVAAMMDELDTDRXRFVDLGEFRAFHARGGGGMNDDAELRAAFDVYDVDGDGRVTAAELGKVLARIXEGRCTAQEVRAEGRRRRRRTAASGSRTSRRGCAPIPKPEP

SEQ ID NO: 48321 - DNA, 723 bp, Zea mays
  misc_feature: Ceres CLONE 1457258-F
  misc_feature: Encodes the peptide sequence at SEQ ID NO. 48322
  misc_feature (504)..(504): n is a, c, t, g, unknown, or other
  misc_feature (586)..(586): n is a, c, t, g, unknown, or other
ggagctccccgcggtggcggccgctctagaatagtggatcccccgggctgcaggaattcgcacgagaccattacctagaacatcctaatcgaaaaaaagcacatagccttatctgctctctctctctctccccagtccccacccgacgcgacgactccagttccaatccgtgctccgctaggtcaatcgaagagtccaaagatcccagctttcccatcccatggcgggcggcgacctcacgcctcctcctcctcctcccgaagagacgccgccggcagcggcggccgaggacctgatcgagatcgtggaggaagggtcggggcggctggacatcgcgcggtacgtggaccacgtgcgcgacctgtcggcgggcgccatcgcgacgttcgagggcacgacgcgggaccacttcgcgggggcgcgcgtggtggaactccggtacgaggcgtacgcggccatgggcgcggcgccgctgggcggcatactgcgggagggccgggcccnggcacgcctgcggggggctggcctgggcccaccgcctggggccccctcccccgccgggaaagccagggggggtcggggggcncctcccccaagaaccggggccaaaaccttgggagggcctggcccttatttttttaaaaaaattaggggggtctcgggcccctttgggaaaaaagggggggtaacaacaaacggggggtttggagagagagaacccct

SEQ ID NO: 48322 - protein, 167 aa, Zea mays
  misc_feature: Ceres CLONE 1457258-F
  misc_feature (95)..(95): Xaa is any aa, unknown, or other
MAGGDLTPPPPPPEETPPAAAAEDLIEIVEEGSGRLDIARYVDHVRDLSAGAIATFEGTTRDHFAGARVVELRYEAYAAMGAAPLGGILREGRAXARLRGAGLGPPPGAPSPAGKARGGRGAPPPRTGAKTLGGPGPYFFKKIRGVSGPFGKKGGVTTNGGFGEREP

SEQ ID NO: 48323 - DNA, 699 bp, Zea mays
  misc_feature: Ceres CLONE 1457267-F
  misc_feature: Translation starting site: 112
  misc_feature: SWISSPROT Homolog: EC 3.2.1.23 Beta-galactosidase
ggagctccccgcggtggcggccgctctagaactagtggatcccccgggctgcaggaattcgcacgagaccattacctaggacatcctaatcgaaaaattgcgcacaccttgatgctgggcatgagcaggacggggttggccggagcggcgctgcgggtggcgctgacggcgctgctgccgctggacctgccggcctactacgtgtacaagctgaccacgtacctcctcggggccgtcttctatcgataccgtcgacctcgagggggggcccggtacccaattcgccctatagtgagtcgtattacgcgcgctcactggccgtcgttttacaacgtcatgactgggaaaaccctggcgttacccatattaatcgccttgcatcacatccccctttcgccagctgacccaccaccgaagaggcccgcaccgatcgcccttcccaacagttgcgcatcctgaatggcgaatggaaattgtaagcgttaatattttgttaaaattcgcgttccatttttgttaactcacctcatttttttaacccgtatgccgaaatcggcaaaatcccttatagatcagaacaatagaccgagatagggttgagtgttgttccagtttggaacaaaagtccactattacagaacgcggactccaacgtcgaagggcgaaaaaacggtctatcagggcgatggcccactactc

SEQ ID NO: 48324 - DNA, 735 bp, Zea mays
  misc_feature: Ceres CLONE 1457268-F
  misc_feature: Encodes the peptide sequence at SEQ ID NO. 48325
  misc_feature (120)..(120): n is a, c, t, g, unknown, or other
acccgcggtggcggccgctctagaactagtggatcccccgggctgcaggaattcgcacgagaccattacctagaacatcctaatcgaaaaatccagtctccgtgtccagtcgagtctcancaaggaagatgtgggggagaggaaagaagcgtttcggcggtggcggcagcggtgagcccgcggccaagcgccaggccgcgagggacgatggcccctccgaatccgctgaagacggtaccgtcgtagccgagatatcgaagaacaagagggtgtccgttaggagctggaaaggcagggtcttcgtcgacttacgcgagttctacttcaaggacggcaaggactctcccctcgcgcagaggtatgtgactcccattacatcagtggaagatattgaaggactggggccccccccccacatgaggccctccaacgaaaatacctgatgggagcccgccaagccgtccccgtgacggggcgagccttttggcttcttctcttgtttgaggcccggaggtaccggacatttgttctttgttgccctttttgccgcccgggttcgctttttgtcccccctaaacctacttgcctggcgtttccgggggccgccttgtgtcggaaagtgtatgcggtccccggccctccggtcaagctcagtgtaccttgctcctctgggacggagccgcgttttccctgccctcctcctattactggggatcgcttataaacgcgcctggg

SEQ ID NO: 48325 - protein, 104 aa, Zea mays
  misc_feature: Ceres CLONE 1457268-F
  misc_feature (10)..(91): Pfam Name: PC4 Pfam Description: Transcriptional Coactivator p15 (PC4)
MWGRGKKRFGGGGSGEPAAKRQAARDDGPSESAEDGTVVAEISKNKRVSVRSWKGRVFVDLREFYFKDGKDSPLAQRYVTPITSVEDIEGLGPPPHMRPSNENT

SEQ ID NO: 48326 - DNA, 697 bp, Zea mays
  misc_feature: Ceres CLONE 1457269-F
  misc_feature: SWISSPROT Homolog: EC 2.7.7.27 Glucose-1-phosphate adenylyltransferase
aaactggagctccccgcggtggcggccgctctataatagtggatcccccgggctgcaggaattcgcacgagaccattacctagaacatcctaatcgaaaaattctgtgatatctttctgccaacaatggatttggttttggttccctgctattcccctccgctttgctaatgcaaatgtcgtcgagcagccaattccgagcgtgacaatctcgctgcaaatgattcaacatacctcaatcctcaagatcgtgaccgggtttttgcttttcttctgagacgaggagcagggacaattatcgtcccccttgacaaacaagcgagcaaaacctgcaacgacattgctggccaactagtcactgatagatattcctgtcagtgagtatctcactgccaatgtatcccttatctctgtgcccccacaatttaaccttgcttacgacgaacagaacctctcagtaaccttatgtagcaacacccgaaggatacacgaatgaatgttttgctgaagtctaaggtgtgcaggctattcacattaatccaactgggttcttggtacggcatatgctcgtatgtagatctctgctgccgtgtgtgtcagcataatgcgatggaattttctatccatgcatggaacctcctgtactctctggactatgaaaagttcattttagcactacgataaaccactgctgatgt

SEQ ID NO: 48327 - DNA, 703 bp, Zea mays
  misc_feature: Ceres CLONE 1457271-F
  misc_feature: Encodes the peptide sequence at SEQ ID NO. 48328
aaagctggagctccccgcggtggcggccgctctagaactagtggatcccccgggctgcaggaattcgcacgagaccattacctagaacatcctaatcgaaaaacattcacatcgcactctcctccagcctccaggcttggcaagcgtgcttcacatgaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcgtggacctcggcgagttcagggcgttccacgcgcgcggcggcggcggcgtggacgacgacgccgagctccgcgccgccttcgacgtctacgacgtcgacggcgacggccgcgtcacggcggccgagctgggcaaggtgctcgcgcgcatcggcgagggcagatgcagcgccgaggagtgcgagcggatggtcgccggcgtcgacgccgacggctgcgtcgggttcgaggacttcaagaagatgatgtgcccccagccgcaagccgaagccggcgccgccgggcgg

SEQ ID NO: 48328 - protein, 179 aa, Zea mays
  misc_feature: Ceres CLONE 1457271-F
  misc_feature (106)..(134): Pfam Name: efhand Pfam Description: EF hand
  misc_feature (29)..(57): Pfam Name: efhand Pfam Description: EF hand
  misc_feature (69)..(97): Pfam Name: efhand Pfam Description: EF hand
  misc_feature: SWISSPROT Homolog: EC 2.7.11.1 Non-specific serine/threonine protein kinase
MSNSAASEKQSQQAGHRQRPPAASAADAEMQRVFCRIDADGDGRISASELAAVTRAISPPASSSHGRREVAAMMDELDTDRDGFVDLGEFRAFHARGGGGVDDDAELRAAFDVYDVDGDGRVTAAELGKVLARIGEGRCSAEECERMVAGVDADGCVGFEDFKKMMCPQPQAEAGAAGR

SEQ ID NO: 48329 - DNA, 731 bp, Zea mays
  misc_feature: Ceres CLONE 1457272-F
  misc_feature: Encodes the peptide sequence at SEQ ID NO. 48330
aagctggagctccccgcggtggcggccgctctagaactagtggatcccccgggctgcagtgattcgcacgagaccattacctagaacatcctaatcgaaaattccagggcgctcctgcacgtcgctagcgccactagggacctcaagaagcgtgtgccctgggtgctcggtgtcgaggcggaccccagcggcggcccacgggtgcaggaggcggccatgaagctgtaccacagccgtaggcgcggtgagggcgaggaggcaggcaaggtggacctgctccaggccttccaggcggtggaggtggccgtgagaggattcttcttcgggtaccggcagctggtggcggcggtgatgggtacggcggaggtgtcaggcaaccggtcgctgttcgtgccggcggagaagatggcccccctcgcccaaatgttcctggagcccccatactaacccagcctggacgcccgcttgacgtttctagcggattactggggtccacttccttttattggggaggcttctgcccccgtcaagaaaaaacttaaaccggcaaaatgggcccggtttgaacccccaaatccccgcagtttttgcagggactggaaaaaacccaaggaggggttttcgttgggggcctttttggcctttgggggcgataggggggatttcttttttttaaaaaactaaaaaaaaaaatttttattttatatcctccaacccccgcgggggtgggc

SEQ ID NO: 48330 - protein, 76 aa, Zea mays
  misc_feature: Ceres CLONE 1457272-F
MKLYHSRRRGEGEEAGKVDLLQAFQAVEVAVRGFFFGYRQLVAAVMGTAEVSGNRSLFVPAEKMAPLAQMFLEPPY

SEQ ID NO: 48331 - DNA, 733 bp, Zea mays
  misc_feature: Ceres CLONE 1457275-F
  misc_feature (373)..(373): n is a, c, t, g, unknown, or other
aaaactggagctccccgcggtggcggccgctctagaactagtggatcccccgggctgcaggaattcgcacgagaccattacctagaacatcctaatcgaaaattggccgccgcccccctgcccatctcctcctctctccattcttgcagccaccaaaccctagcccccccaatcccctcctcccaaggtgccaatccttgccgctcggatcatcatcatcgtggtgcgagtcttcaatcattttggtggagggaagaagggaggaaggaaagggggagaatctaaggtggtggacttccggatcgtacttagggatttgcccgaactttcggtaaaggtacttgatacatgttgggaatgaagggagtagcancacgtcccatttccctctcaccataaccctgcccaggcccacccctaatttaattagaaacttattgtcaaaggaagtttgttaattttttaaaatggccgggcgcctgggttaatccagtccgggcccaaggttaacttttccttgggggccaaaaaaaaaaaccttagttggtttttccccaaaaaaaaaaaaaaaatttttttcttcccccccccccccgggggggggccgggaaccaattccccccaaaaggaggataaataaccccccccccggggccctcttttaaaaagcggggaggggaaaaaaacccggggaacacaaaaaaaagccccggaggaaaaaaccccctttttc

SEQ ID NO: 48332 - DNA, 697 bp, Zea mays
  misc_feature: Ceres CLONE 1457282-F
  misc_feature: Encodes the peptide sequence at SEQ ID NO. 48333
  misc_feature (389)..(389): n is a, c, t, g, unknown, or other
ctctccgcggtggcggccgctctagaactagtggatcccccgggctgcaggaattcgcacgagaccattacatagaacatcctaatcgaaaacacaagatagttctacacttgtccaaaatgagggcaccacaaaagaccccctatcatccactttgccagactccttagatgagatcaatcaattaagatctggcaccggtgaacaatcttcagttaccggttctgcaacagattcaatgcaggtgggattcacggcatcagatcatatggatctactgattgaacaaattaagatgcttgctggggaggtcgcatttggtaccagttcgctgaaaaaactaatcgaacagtccatacacgaccctgaaggggggggggagcaaatcnataatttacaacgtgaaatccagcaaaaaaggagaacatatgcgagccctggaaaaaacaaatcatggaaaaggggccaggcatccgtttgcctaatgcattccatggagggaaatgccagcaaaactatccccgaaaacttaacggcctcattggcagggaagaaaggctttcggaacttaaaggttcaaaagccagccgaaaaattccgggtccccccaggaaaaaagcctcacttcaaaaataaatttgggaaaagccccccaatttgacagagaaaaaagtccctttccccgtttgaacaaaaa

SEQ ID NO: 48333 - protein, 140 aa, Zea mays
  misc_feature: Ceres CLONE 1457282-F
  misc_feature (51)..(51): Xaa is any aa, unknown, or other
MQVGFTASDHMDLLIEQIKMLAGEVAFGTSSLKKLIEQSIHDPEGGGEQIXNLQREIQQKRRTYASPGKNKSWKRGQASVCLMHSMEGNASKTIPENLTASLAGKKGFRNLKVQKPAEKFRVPPGKKPHFKNKFGKSPPI

SEQ ID NO: 48334 - DNA, 682 bp, Zea mays
  misc_feature: Ceres CLONE 1457287-F
  misc_feature: Encodes the peptide sequence at SEQ ID NO. 48335
  misc_feature (559)..(559): n is a, c, t, g, unknown, or other
  misc_feature (682)..(682): n is a, c, t, g, unknown, or other
aaagctggagctccccgcggtggcggccgctctagaactagtggatcccccgggctgcaggaattcgcacgagaccattacctagaacatcctaatctaaaagaatcgtccgccgtcttctgaaaaggtcactcaaaggcccgccgtctgcagcgctggcgaccgcagagccggcgaccaccgtgcgtcctgtctcctcgtctgctccgtccatctccacagcttgtgcaggtcgctgaaacacttggatcaaaacagagcttgagatgaagcactacaccctgaaggatcagggtgtttatgctcttccatctactgcaaaatccaattggaaggatatctactgcatctacttccaaaacagcatgatgcaatacttgacgacaaaggaaaaggtccaaccgttacaattgaatctccacccaaaaggttcaaaatggacctctacgtattaaagaaaggtcggacacaagatcttccaacaactgaagattttctcagattatcagcagcttttaggttgtagaatgtcctttatataattatatataactgctcnacttttatgaagacatttcatgtaaatataacaaggtagcttgaaatgtttgcacaaacatactaccttctgcccgggctcatttaactctattttactttatacaaatctgctatgctcgan

SEQ ID NO: 48335 - protein, 62 aa, Zea mays; identical to SEQ ID NO: 8764
  misc_feature: Ceres CLONE 1457287-F

SEQ ID NO: 48336 - DNA, 667 bp, Zea mays
  misc_feature: Ceres CLONE 1457290-F
  misc_feature: Encodes the peptide sequence at SEQ ID NO. 48337
aagctggagctccccgcggtggcggccgctctagaactagtggatcccccgggctgcaggaattcgcacgagaccattacctagaacatcctaatcgaaaaactcctgacctcacctctccgaactgcagcacctcccctcccgccacccacacgtgctcccatggccgccaccgcgatctcagtccgcctccacccaaccgccgcgcgccatgtggcctccgcccgccgcgcccgcctcggggccgtccgcgcgcagtccgcgccggcggcggcggcggcggcgctgacgcaggacgacctcaagcggctggcggcggtgcgcgccgtcaagcaggtgaagagcgggatggtgctcgggctcgggacgggctccacggccgccttcgccgtcgccgagatcggcgcgctcctggccgcgggcaagctcgaaaaaatcgtcggggtgcccacatccaagcgcaccttcaaacaagcgcagtcgctcggaatcccgctcctccacgctcgaaaacaaccccgctcatcgaacctccccaccgaagggggccgaagaaggttgaaccccgaacctaaacccttgagaaagggccgcggcaggtcgctcttcctttcgagaagaaaatgggctcgaagcccaccccccggaacaaagtttattagggtca

SEQ ID NO: 48337 - protein, 168 aa, Zea mays
  misc_feature: Ceres CLONE 1457290-F
  misc_feature: SWISSPROT Homolog: EC 5.3.1.6 Ribose-5-phosphate isomerase
MAATAISVRLHPTAARHVASARRARLGAVRAQSAPAAAAAALTQDDLKRLAAVRAVKQVKSGMVLGLGTGSTAAFAVAEIGALLAAGKLEKIVGVPTSKRTFKQAQSLGIPLLHARKQPRSSNLPTEGGRRRLNPEPKPLRKGRGRSLFLSRRKWARSPPPGTKFIRV

SEQ ID NO: 48338 - DNA, 677 bp, Zea mays
  misc_feature: Ceres CLONE 1457291-F
  misc_feature: Translation starting site: 157
  misc_feature (677)..(677): n is a, c, t, g, unknown, or other
ctccccgcggtggcggccgctctagaactagtggatcccccgggctgcaggaattcgcacgagaccattacctagaacatcctaatcgaaaaagctggagggcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtaaaacgcgcgcgcgtgcgcctgtgctgcctgatccggatgcgcgcctaattaatctgccgcatatgcgcgcctttctgggttttactttgcaggtgggcggagctggagagcggggcgacaaccatcgcgttcacgccgctgcaccagcgggagacggacgagctgtcgggggcggtgcagctgccggactcgtcggccgccggccggggctccgtgaaggtctgcttcgcctacgcggacgtcgaacgcgcgtacaagcgcgccgtgaacaacggggcgggtgcccgtgaccgccccgaaggacaagcccctgggggccagaagtccgggctccctgcggggacatggacggcaacatcgtggcgcatcgcgaactacttgcggagagan

SEQ ID NO: 48339 - DNA, 689 bp, Zea mays
  misc_feature: Ceres CLONE 1457293-F
  misc_feature: Encodes the peptide sequence at SEQ ID NO. 48340
  misc_feature (680)..(680): n is a, c, t, g, unknown, or other
tggagctccccgcggtggcggccgctctagaactagtggatcccccgggctgcaggaattcgcacgagaccattacctagaacatcctaatcgaaaagataaaccacagagccaccccactaactactttcaccattgtttccagaaaaatctccgcgcataatattctctagagcaaacgctctgtcatcacacaacactagttcgtccgcacgacactcccgcagttcctcgacaggggagaggtttccattccaggcggttgcggttgcggttggcggcggagatgagccgggggagcaagctccggtggctgtggcgcgcgccggcgcgggcgctggggcgggcgcgggacctgtacgtgcgggggctgacggggtgcgcgcgccacgtcccctccgacgccgtgttcgggtaccccgtgttcgtgccggcgccgctgtccaggagccacagcgccgtcggctggggcgccgggtcgtccgaagccgacgaagacctgcgcgaggtggtccgcgccgcgtcgcagcgccgcgtggagcagcgccgcgccgagctgcaggccgtggcccggagccagagcatggccgcctcgctctccatggcgcgcatcgacgaggacgcgccgtgcgacttcggggcgcccggggcgctgtgcccgagaagccagagctgtgtcngcgaccccg

SEQ ID NO: 48340 - protein, 134 aa, Zea mays
  misc_feature: Ceres CLONE 1457293-F
  misc_feature (132)..(132): Xaa is any aa, unknown, or other
MSRGSKLRWLWRAPARALGRARDLYVRGLTGCARHVPSDAVFGYPVFVPAPLSRSHSAVGWGAGSSEADEDLREVVRAASQRRVEQRRAELQAVARSQSMAASLSMARIDEDAPCDFGAPGALCPRSQSCVXDP

SEQ ID NO: 48341 - DNA, 657 bp, Zea mays
  misc_feature: Ceres CLONE 1457297-F
  misc_feature: Encodes the peptide sequence at SEQ ID NO. 48342
ggagctccccgcggtggcggccgctctagaactagtggatcccccgggctgcaggaattcgcacgagaccattacctagaacatcctaatcgaaaacttttcccctcagcctcccctcctctccggtgtacgtctccgtcgagatggcctccccggtccgggggagcctcccctcccttggccgcgctcttctcacgtcggctccggcgcgaatgctctccgcggaggcctctgatgccctcgttgagatcaagcccggccatatcgggatggtctccaggatccctgaggagcatctccgacgtactgctctaatttattcacgtgctatgaatgattccggtgcgcgtcacgacggtcgtgacgtcggaaaatccctctctgtcatccctacgtggaagaacccttcgatgagatggacatcttctgcgcatccatatgctaatgtcggcgaaggcgacttttgtgtgacagtgcatagacagcaagggcttttgccgaagatcctgcctgtaattatgtcggtcggacacgccgtgcacctgcttctgaggactaaggcctactcctgagaactcctcgtggagaacgccccgccataaacgcacctagcgtggagctcagaaacttcggtgatgctgacacttgcctcgatgc

SEQ ID NO: 48342 - protein, 142 aa, Zea mays
  misc_feature: Ceres CLONE 1457297-F
MASPVRGSLPSLGRALLTSAPARMLSAEASDALVEIKPGHIGMVSRIPEEHLRRTALIYSRAMNDSGARHDGRDVGKSLSVIPTWKNPSMRWTSSAHPYANVGEGDFCVTVHRQQGLLPKILPVIMSVGHAVHLLLRTKAYS

SEQ ID NO: 48343 - DNA, 687 bp, Zea mays
  misc_feature: Ceres CLONE 1457299-F
  misc_feature: Encodes the peptide sequence at SEQ ID NO. 48344
ctggagctccccgcggtggcggccgctctagaactagtggatcccccgggctgcaggaattcgcacgagaccattacctagaacatcctaatcgaaaactgttgcgccggccaccacagtgcagaagaacacacagcatccgcctgcctcgccgcagcaatggccgccgccgccgccgtggcgagatcctttctccggtacagcggctcatcgtccctccgcagcgcggcggccagagccgcctcgcgggccggaccggttccgctgccgaggcggatgcccagttctgggccccgcgtactcctaagcgtgtgcctggagtccctgatgcccatgcacagcgccacggcttcggcgctcatgacgtcgctactcgctgccccggcttgcaaggggttgggttggctatcagaagatggatgatttgtcattattggagacctgcagtgatggtatctggtctggattatggaatacctcgtgaatttatagtacttggttggcgtctcagttaacatgttttgtgctctgggattccagtttgtatgaaatttacataattcttcctgagatttattttggctcactagctgtcaaaaagactttggtcttgacgaccaggctgatcatgtacatctggactgaatgaacttgattaaaggctttcaaaaaaaaaaaaaaaagctt

SEQ ID NO: 48344 - protein, 87 aa, Zea mays
  misc_feature: Ceres CLONE 1457299-F
MAAAAAVARSFLRYSGSSSLRSAAARAASRAGPVPLPRRMPSSGPRVLLSVCLESLMPMHSATASALMTSLLAAPACKGLGWLSEDG

SEQ ID NO: 48345 - DNA, 758 bp, Zea mays
  misc_feature: Ceres CLONE 1457301-F
  misc_feature: Encodes the peptide sequence at SEQ ID NO. 48346
  misc_feature (404)..(404): n is a, c, t, g, unknown, or other
  misc_feature (409)..(409): n is a, c, t, g, unknown, or other
  misc_feature (410)..(410): n is a, c, t, g, unknown, or other
  misc_feature (575)..(575): n is a, c, t, g, unknown, or other
  misc_feature (758)..(758): n is a, c, t, g, unknown, or other
atagctggagctccccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggttttctccgtctacctcggggggaaagtaaggggacttccccncctanntttctccacccccccccggaaacggggggaaagacaacaaaaaagactgcgcatctatcccgcgccaccgcgcctccttggcgatccccgaaccgacaaagacctccgggaaaggtggctggcccggcttcatccttccgcacacgggggggcgcactgccccanaaatcccggtcctggcgcccctggcccaagaaaggggggcgggaaaaaaggcgcgcccaagccgtgtccgggtctaacaaaaccccgtatacctccacagaaagaggggtgcctaaggtccgcgcaaaggcaacgttccccaaaaccccgctcgcccccacctcattccccccctggcgcacn

SEQ ID NO: 48346 - protein, 190 aa, Zea mays
  misc_feature: Ceres CLONE 1457301-F
  misc_feature (74)..(74): Xaa is any aa, unknown, or other
  misc_feature (129)..(129): Xaa is any aa, unknown, or other
MDASGAGSKGKKGAAGRKAGGPRKKSVTRSVKAGLQFPVGRIGRYLKKGRYAQRVGTGFLRLPRGESKGTSPPXFLHPPPETGGKTTKKTAHLSRATAPPWRSPNRQRPPGKVAGPASSFRTRGGALPXKSRSWRPWPKKGGREKRRAQAVSGSNKTPYTSTERGVPKVRAKATFPKTPLAPTSFPPWRT

SEQ ID NO: 48347 - DNA, 691 bp, Zea mays
  misc_feature: Ceres CLONE 1457304-F
  misc_feature (340)..(340): n is a, c, t, g, unknown, or other
ctggagctccccgcggtggcggccgctctagaactagtggatcccccgggctgcaggaattcgcacgagaccatacctagaacatcctaatagaaaaatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgncgtcatctcctcctccccaccccgccctacgacctgacgtcgttccgggtcagccccatcaaggagtccatcgtgtcccgcgagatgacccggcgctacatgacggacatgatcaccccacgcccgacaccgacttggtgatcgtgggcgccgggtccgcgggcctgtcctgcgcgtacgacctgtccaaggacccctccgtgagcgtcgccatcgtggaacagtccctgtccccggggcggcggcccgtggctgggcggcaaactgttcctcgccatggtggtgcccaagccggccccactgttcctggaacaaactgggcttgggctacaaaaaagcccaaggactgcg

SEQ ID NO: 48348 - DNA, 671 bp, Zea mays
  misc_feature: Ceres CLONE 1457317-F
  misc_feature: Encodes the peptide sequence at SEQ ID NO. 48349
ggagctccccgcggtggcggccgctctagaactagtggatcccccgggctgcaggaattcgcacgagaccattacctagaacatcctaatcgaaaaaaagttccctaaccggctaaccctaatttcacggccgcccacccgccagcgccctgcgcccagccggcaccctaagttcccacttcccagttcccacccgccagccgccaaccgcccagcccgctgccccgctcccgccccgagctgcgcggctgcgcccccaagctgcgcgcctgcgccgtccccgaggcccgagctgtgcctgcgtcgtccgtcgtggcccgagctgcgcctgcgccgtccccgaggcccgagctgcgcggctgcgcccccgagctgcgccgtccgtcggcccccactcgtcgttcctcccgtcgcgcggcgcagcgctcacgcaaggccctcggaccagcagatcgacggcttcaccgcggatcgaccagcagatcaacgccgcccttcagaccctcaggattcaactgtatcagctcaagatcaatatttttttaaatgagtaagcttgcaaatatgttctcggctctttgtctggatgctgaaagcaatgaagatgttggccgagctgaagtaccacaggcgtcttccagcacagacaatactgctgcaagcaaacctga

SEQ ID NO: 48349 - protein, 41 aa, Zea mays
  misc_feature: Ceres CLONE 1457317-F
MSKLANMFSALCLDAESNEDVGRAEVPQASSSTDNTAASKP

SEQ ID NO: 48350 - DNA, 687 bp, Zea mays
  misc_feature: Ceres CLONE 1457321-F
  misc_feature: Translation starting site: 184
  misc_feature: Pfam Name: MRG Pfam Description: MRG
  misc_feature (557)..(557): n is a, c, t, g, unknown, or other
ggagctccccgcggtggcggccgctctagaactagtggatcccccgggctgcaggaattcgcacgagaccattacctagaacatcctaatcgaaaagtccgattgtgcgctgtcgcagcctctgccctctcccagcccgctcctccatctccggtgagacgcgaattgaatcgcatcgaatccatgggcagctcctcgaataccaacacgagcggcggggccagcgacaaggaggagaagaagaaggaggacaagatcaaaggcaaggactcgtcggggccatccttcaaggagaacgaaagggtcctcgcctaccacggccccctcctctacgaggccaaggttcaaaggatcgaaaaccatgaagatgaatggcgctactttgtccattatctcggttggaataagaactgggatgaatgggttgcaaatgaccgcttgtgggatttgacgaagaaaacgtgcgcaaacaacaagagcttgataagaatcaggtagttgacaaaacaatgaagtctggacggtcaacacagcataaaccaaaagtctccaatgcngatgcaaaagctgataaagatgaccctaagagtctcatggagggaaagaaacgtaaaagtcagcttgggactgagattcaggacaaggaaaaagatcctcacataggctactagggtggcagtctccttt

SEQ ID NO: 48351 - DNA, 668 bp, Zea mays
  misc_feature: Ceres CLONE 1457324-F
  misc_feature: Translation starting site: 272
  misc_feature: SWISSPROT Homolog: EC 2.3.1.48 Histone acetyltransferase
tggagctccccgcggtggcggccgctctagaactagtggatcccccgggctgcaggaattcgcacgagaccattacctagaacatcctaatcgaaaaaataatgtccttattttggagctcgcgccgcccgccgcccgccgccgcgcccgaacgcagccatcgattccccatttctttcccgcctcctcactcccgcctcttctactcccaaaatcccaaaaccctagctcgctaacgaccccaggcagacgcgccgtcctcccctcccccatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatggaatccaggcgaggtgagctctgtagactgcactgctattcagccatttgacctaaaccattttttttggtgaagatggaaaaatatatggttacaaaaatcttaagataaatgtgtggataagtgcgaaatctttccatggatatgctgatgtttcatttgacgaaacatctgatggagggaaaggaataacagatctaaagcctgttcttcagaacatttttggagaaaacttggtagaaaaagagaattcctgcatacatttt

SEQ ID NO: 48352 - DNA, 674 bp, Zea mays
  misc_feature: Ceres CLONE 1457326-F
  misc_feature: Encodes the peptide sequence at SEQ ID NO. 48353
ctggagctccccgcggtggcggccgctctagaactagtggatcccccgggctgcaggaattcgcacgagaccattacctagaacatcctaatcgaaaacctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgaaggccctgctgattggcagagcagcccgcacccctggatctacgagaagtaaacatggaaagtttcacatcaaaccttgagagccagaaggaagcatgtcacccatttggtgt

SEQ ID NO: 48353 - protein, 149 aa, Zea mays
  misc_feature: Ceres CLONE 1457326-F
  misc_feature (2)..(134): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSPHPWIYEK

SEQ ID NO: 48354 - DNA, 707 bp, Zea mays
  misc_feature: Ceres CLONE 1457327-F
  misc_feature: Encodes the peptide sequence at SEQ ID NO. 48355
  misc_feature (516)..(516): n is a, c, t, g, unknown, or other
ccccgcggtggcggccgctctagaactagtggatcccccgggctgcaggaattcgcacgagaccattacctagaacatcctaatcgaaaaatcgtcctgctcatcccctactactagttgagtttttcaagtgaagagaagccattagccatggcggcggtggatctgtccaagctggtgaaggagaagcgcttctgggtggcctccttcctcgtcgtatgggcagcagcgctgcagggccacatgatgtggatgcagcgccaggacaccttcaagcacaagtttggtatcgaccaagcagacggacccgatgctcaggattcctcatcttcgtcttcgtcttcctcttcttagtaggtcagttaccttgtatcgtctgaagcggtttgttcggaaggaccacacctccctcctttaataaacgggccggaaaaaaggcaaatgaacagacaagtgcggggtgggaaaccccaacccagcgttcctttggaggaagggcatttttccttccctttnatcctcgaaaaaattctgaacccctaactttttggggggggggagggaaaaccttgggtgggttatttgttggcccaaaacccctggcttttaagttggggttttataggtgggaggggcctttttcccaaaaaaaaaaaaaaaaaaaagtttttcctaccccctcccccctcgggggggggcccttgtct

SEQ ID NO: 48355 - protein, 67 aa, Zea mays; identical to SEQ ID NO: 47667
  misc_feature: Ceres CLONE 1457327-F

SEQ ID NO: 48356 - DNA, 725 bp, Zea mays
  misc_feature: Ceres CLONE 1457329-F
  misc_feature: Encodes the peptide sequence at SEQ ID NO. 48357
  misc_feature (436)..(436): n is a, c, t, g, unknown, or other
  misc_feature (444)..(444): n is a, c, t, g, unknown, or other
ggagctccccgcggtggcggccgctctagaactagtggatcccccgggctgcaggaattcgcacgagaccattacctagaacatcctaatcgaaaagcttttcacggtgcccacccagcgtgcaacctaggcgagaaccgcctccccctccgctccttccagctcgctctgtaatctgcatcagcctcgcccgccgccgtcgccgccatggggaggggaaagttcaaggggaagcccacaggccgccgcaacttctccacacccgaggagatcgctgctggtacttcaggtcggccacgcaccttttagaagaaggaggaagaggaagatgaggaagaggtagaaagagaagagtctgaggaagaatctgaagaggattctgatgaaaagactaaaccataaggcactggagggtattattcagattgaaaatccnaacttggntgaaagccaagaatataaaggccaaagaaagttgattttgggcaagacacttgactcctcagggctgaaagaaaaggagcttgaaaaacaaaaagctccctgaaccgtaattggagcttcggggagcaggaaaaaaccgacacagccccaaaagattgggaaacgcctttgctttaaaaaaaaaacaaagggcttaaagcgcgcaaaaaacccccaaaaaaaaaaaaccctccccagggaccaaagaaaatctcaaacccccaaaattatctccccactta

SEQ ID NO: 48357 - protein, 33 aa, Zea mays
  misc_feature: Ceres CLONE 1457329-F
MGRGKFKGKPTGRRNFSTPEEIAAGTSGRPRTF

SEQ ID NO: 48358 - DNA, 720 bp, Zea mays
  misc_feature: Ceres CLONE 1457331-F
  misc_feature: Encodes the peptide sequence at SEQ ID NO. 48359
aaagctggagctccccgcggtggcggccgctctagaactagtggatcccccgggctgcaggaattcgcacgagaccattacctagaacatcctaatcgaaaaagacccttctcttcatcttcactctcctggtttattcctccgtgccgatctcgtcttctccgacgggaccatggcgccgtcctcctcccgattcgacgatccggcggcggtgaggcgccccccgcagcatgaacggaagccgccgtatatgttgcttctcccgctcgtctacgcccccgtcctccccctcatcaggatcgggctgcggcacaatcccgtagtgagggaccgtctcttctacggcgtcctcgccggcgcattcgcccacggcgcctacctcatatcggaactgtatgatgtggagagcaaatgatgggcatccctcgaaggatgaggggataagttttcaggtagcaaaatttgattccatcgggattccagattgttggatgagagctgacatggcaattcagactaactagtgtgctatgtacccatatgttttctttggtcttgctattatgtttggcaaaaggatggaatggttgagcaaataaagtaattccagattgagaaatatttccaaaaaaaaaaaaaaaaaagcttatcgataccgtcgacctcgagggggggcccggtacccattcgccctatagtgagtcgtattacgcgcgctcc

SEQ ID NO: 48359 - protein, 80 aa, Zea mays; identical to SEQ ID NO: 9524
  misc_feature: Ceres CLONE 1457331-F

SEQ ID NO: 48360 - DNA, 668 bp, Zea mays
  misc_feature: Ceres CLONE 1457334-F
  misc_feature: Encodes the peptide sequence at SEQ ID NO. 48361
ctggagctccccgcggtggcggccgctctagaactagtggatcccccgggctgcaggaattcgcacgagaccattacctagaacatcctaatcgaaacgcagagaccatacctagaacatcctaatcgaaaagctaccaccgtgctctcacgacagatttccgagctcggtatttatcctgctgtcgatcctttggattccacatccagaatgttgtctcctcatgttcttggcgaggctcactacaacactgctcgtggtgttcagaaggttcttcagaattacaagaatcttcaagatattattgccattttggggaaatggatgagctcagtgaggacgacaagttaacagtcgctcgcgctaggaaaattcagcggttccttagccaaacctttccatggtgctgaagttttcacaggcgcacctggaaagtatgttgagcttaaggagggtgttcaaagtttccagggtgttctgggatgggaatacgatgacctttcagagcaggcattctacatggttggaagaatagaggaggtcattgccaaggctgaaaagattgcaaggaaaacgcttgataaaaaactccctcttttacaagcacctgcaattttaaccttttcggggccaactggtgtgctttttacggcctgttagcaagaaat

SEQ ID NO: 48361 - protein, 46 aa, Zea mays
  misc_feature: Ceres CLONE 1457334-F
  misc_feature: SWISSPROT Homolog: EC 3.6.3.14 H(+)-transporting two-sector ATPase
MLSPHVLGEAHYNTARGVQKVLQNYKNLQDIIAILGKWMSSVRTTS

SEQ ID NO: 48362 - DNA, 845 bp, Zea mays
  misc_feature: Ceres CLONE 1457339-F
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (299)..(299): n is a, c, t, g, unknown, or other
  misc_feature (321)..(321): n is a, c, t, g, unknown, or other
  misc_feature (359)..(359): n is a, c, t, g, unknown, or other
  misc_feature (364)..(364): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (370)..(370): n is a, c, t, g, unknown, or other
  misc_feature (374)..(374): n is a, c, t, g, unknown, or other
  misc_feature (379)..(379): n is a, c, t, g, unknown, or other
  misc_feature (384)..(384): n is a, c, t, g, unknown, or other
  misc_feature (395)..(395): n is a, c, t, g, unknown, or other
  misc_feature (407)..(407): n is a, c, t, g, unknown, or other
  misc_feature (408)..(408): n is a, c, t, g, unknown, or other
  misc_feature (420)..(420): n is a, c, t, g, unknown, or other
  misc_feature (424)..(424): n is a, c, t, g, unknown, or other
  misc_feature (455)..(455): n is a, c, t, g, unknown, or other
  misc_feature (481)..(481): n is a, c, t, g, unknown, or other
  misc_feature (484)..(484): n is a, c, t, g, unknown, or other
  misc_feature (486)..(486): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (504)..(504): n is a, c, t, g, unknown, or other
  misc_feature (505)..(505): n is a, c, t, g, unknown, or other
  misc_feature (507)..(507): n is a, c, t, g, unknown, or other
  misc_feature (512)..(512): n is a, c, t, g, unknown, or other
  misc_feature (516)..(516): n is a, c, t, g, unknown, or other
  misc_feature (520)..(520): n is a, c, t, g, unknown, or other
  misc_feature (523)..(523): n is a, c, t, g, unknown, or other
  misc_feature (524)..(524): n is a, c, t, g, unknown, or other
  misc_feature (542)..(542): n is a, c, t, g, unknown, or other
  misc_feature (545)..(545): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (554)..(554): n is a, c, t, g, unknown, or other
  misc_feature (564)..(564): n is a, c, t, g, unknown, or other
  misc_feature (583)..(583): n is a, c, t, g, unknown, or other
  misc_feature (589)..(589): n is a, c, t, g, unknown, or other
  misc_feature (607)..(607): n is a, c, t, g, unknown, or other
  misc_feature (619)..(619): n is a, c, t, g, unknown, or other
  misc_feature (629)..(629): n is a, c, t, g, unknown, or other
  misc_feature (681)..(681): n is a, c, t, g, unknown, or other
  misc_feature (682)..(682): n is a, c, t, g, unknown, or other
  misc_feature (702)..(702): n is a, c, t, g, unknown, or other
  misc_feature (713)..(713): n is a, c, t, g, unknown, or other
  misc_feature (718)..(718): n is a, c, t, g, unknown, or other
  misc_feature (725)..(725): n is a, c, t, g, unknown, or other
  misc_feature (749)..(749): n is a, c, t, g, unknown, or other
tttttcccctccggccccctcttatattttttgnnnnggggggggnnnnnaaaatctggagctccccgcggtgggggccgctctataactagtggatcccccgggctgcaggaattctcacgagaccattacctagaacttcttattgaaaaagctgtctccagtgagagaagacgatgattggggaaatcgagagatgagctaccggagagtccctcgcgagggagccgagcctcctccaggagatcctcgatttcgagcggaccctgacccctgccaccagaaggtagggggttttnctttggggcagggaggttttcnctccccctgggcgggtgggggcgggggggggggggggngttancnnncngccngggcngcccncgggcgggggngagggggggtgnnttgtggttttangggngtggggtttggggcggggggggggggggggnggaggggggaggggggggtgtgttgnccncnccgggccgggggnnnnanntnccccngagngggntgnntggaggagggaagggtgnggnggnnncatnagcagggcgngagagggtggcggcgtgcngcaaancaaggcacggggggtagntatggtgtgagngacaagcccngggtgcgggggaagatttaaagaatgggagagagaatgttttagtacgccannttgcgggggctccaccgctncttgtgggcgntgtanataaaanaaaggagaatggtgtggcggtgtntctggggggaggaggcggtgaataagaaagatgaaaaaaatatcagacattgactacgctcggtggtggctgtctcgttggcgagagagagaaaaa

SEQ ID NO: 48363 - DNA, 663 bp, Zea mays
  misc_feature: Ceres CLONE 1457340-F
  misc_feature: Encodes the peptide sequence at SEQ ID NO. 48364
  misc_feature (347)..(347): n is a, c, t, g, unknown, or other
  misc_feature (403)..(403): n is a, c, t, g, unknown, or other
ctccccgcggtggcggccgctctagaactagtggatcccccgggctgcaggaattcgcacgagaccattacctagaacatcctaatcgaaaagtcacgcagctgaccgcggcccgcatccgctacgccaacgctgcgacgggcacgggcagcgcgataaaatccgccgcggccgcctccacccacctcgacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcanaaacagaactcctggtcgccggacatcgagcgcgacaaggcgtgggagcgccggcncaggggcatgcgccgcgggggcacggcgctgcgccgcgcccgcagcgtcacggacgacaacctcgacgagctccgcggctgcctcgacctgggcttcgggcttcgagccggcgcacgccccccgcgggggcctgggcctgggcctgcggcgggaggaacccccctcctggaaacgctggcccgggctcaacctctactaagccgtccacggggggggggggggaaagcgcccccctggctccggggggggccccggtcga

SEQ ID NO: 48364 - protein, 129 aa, Zea mays
  misc_feature: Ceres CLONE 1457340-F
  misc_feature (21)..(118): Pfam Name: DUF1685 Pfam Description: Protein of unknown function (DUF1685)
  misc_feature (24)..(24): Xaa is any aa, unknown, or other
  misc_feature (43)..(43): Xaa is any aa, unknown, or other
MEKAGQQRHVIGGGGKKAPALGLXKQNSWSPDIERDKAWERRXRGMRRGGTALRRARSVTDDNLDELRGCLDLGFGLRAGARPPRGPGPGPAAGGTPLLETLARAQPLLSRPRGGGGKAPPWLRGGPRS

SEQ ID NO: 48365 - DNA, 719 bp, Zea mays
  misc_feature: Ceres CLONE 1457342-F
  misc_feature: Translation starting site: 221
  misc_feature: Pfam Name: Sod_Fe_C Pfam Description: Iron/manganese superoxide dismutases, C-terminal domain
  misc_feature: SWISSPROT Homolog: EC 1.15.1.1 Superoxide dismutase
  misc_feature (84)..(84): n is a, c, t, g, unknown, or other
  misc_feature (379)..(379): n is a, c, t, g, unknown, or other
  misc_feature (384)..(384): n is a, c, t, g, unknown, or other
  misc_feature (397)..(397): n is a, c, t, g, unknown, or other
  misc_feature (409)..(409): n is a, c, t, g, unknown, or other
aagctggagctccccgcggtggcggccgctctataactagtggatcccccgggctgcaggaattcgcacgagaccattacctanaacatcctaatcgaaaatcaaaggaatagtgagccgccccgccgctcctcagtcatcctctccatctcggtgtcacacactccgcatactcgcttacaagagtccagtgacagcgatcgagcgagcgagcgaaggcatggctctccgcaccctggcatcgaagaacgccctatccttcgcgctcggcggctcggcccggccgtcggcggcgtccgcgaggggggtgacgacggtcgcgctccccgacctctcctacaacttcggtgcgctggagccggccatcttgtgagaaatnatgtncttgtaacacaanacaaattatttnaccccccccgattattatgagaaggcgctggaccagctccacgcttgccgtcgccaagggtgacacctccgctgtcgtcccgctccggggcgccatcaagttcagcggcggcgggcatgggtaacattgcatcttttgcaagaccctccagcctattagcgaatgaggtggggtagcgccacatgggaaacttggctcggccatcgatgaagattttggatcgtttgacgcacttgtacagaagacgaatgcacaaggcgctgctttacaacgatctggatgggtggtggttagctttgtataacgagga

SEQ ID NO: 48366 - DNA, 707 bp, Zea mays
  misc_feature: Ceres CLONE 1457347-F
  misc_feature: Translation starting site: 116
  misc_feature: Pfam Name: Coprogen_oxidas Pfam Description: Coproporphyrinogen III oxidase
  misc_feature (252)..(252): n is a, c, t, g, unknown, or other
  misc_feature (286)..(286): n is a, c, t, g, unknown, or other
tccccgcggtggcggccgctctagaactagtggatcccccgggctgcaggaattcgcacgagaccattacctagaacatcctaatcgaaaaaaaccacccacccacccaaacccaatggcgtccaacctcctctccgccccgtcccgaaccctagctccgtcgccggcgccggcccccgcgggcctccgcgggcgtgtgccggtgcaggcgcacctcctgcgcggtggcctcggcctcgccccccgacgcancagccgcgcgctccgcgtgcgcgcgtcggtggcnatcgaaaagagactccggagagcgagccgcccccgacgttcctcgcgaggagggcacgggtccgggtccgtgcgggcgcggtttgaggccttgatcccgcggttgcaaggggaaggtttgccccttctctcaggaggccaacgggggggggccccccttttttaaaaaattttgggtccgccccttggcggggggggggggaattaatccggttcttggggggaaggcccccgccccccaaaaaagccgggggttaaacttttcctttcctctaaagggggtttgttggacccaagatcttttccctgcccccaggggggggggggccccccaaaaaaagggggccccccccctcggaaaagaaaccaaaaaccggggcccccggcgctttttttttccgcgggggaaaaattttctcggg

SEQ ID NO: 48367 - DNA, 683 bp, Zea mays
  misc_feature: Ceres CLONE 1457351-F
  misc_feature: Encodes the peptide sequence at SEQ ID NO. 48368
aagctggagctccccgcggtggcggccgctctagaactagtggatcccccgggctgcaggaattcgcacgagaccattacctagaacatcctaatcgaaaaactcaccggctgagtcagcttcaatctcacctgtgacctgtacactcccagatcagacggttcacgtacgacggttggcaacactcacaaccaccgcaccgcacaccgcagcccaagttctcctctgcatctgaaatatcttgccacctgacgcgacagcgacaagatccaagaactcgctcgcgcgcacggacagggccggaacccagggatcgagactgaacagcagtccgagacgccatgaacgtggaggaggaggtcgggaggctcaaggaggagatccataggctcggccagcagcagcccgatggctcttacaaggtcaagtttggcgttctcttcaacgacgatcggtgtgcaaatatctttgaagcactagttggcaccttgagggccgccaagaagaggaagatcttgacctacgaaggcgagctgcttctgcaaggtgtccatgacaacgtggagataaccctgttgcccccacctgcagttgctgccgcttgaagcgaagagcaacaccaagttctcgattccatacaactcgtatgcttgtattctgccgtgcctatattagattctctc

SEQ ID NO: 48368 - protein, 87 aa, Zea mays; identical to SEQ ID NO: 46334
  misc_feature: Ceres CLONE 1457351-F

SEQ ID NO: 48369 - DNA, 691 bp, Zea mays
  misc_feature: Ceres CLONE 1457354-F
  misc_feature: Encodes the peptide sequence at SEQ ID NO. 48370
caaagctggagctccccgcggtggcggccgctctagaactagtggatcccccgggctgcaggaattcgcacgagaccattacctagaacatcctaatcgaaaaataaaggcattctcctcgcgccccacccggcggttatcttcaccaccatatcgacatcgacgccagcgagccaaggacagaacagccggcgcccggccctaaaactgccgtgcagcgagagagaagcgagggaaagatggaccggtaccagagagtggagaagcagggggaggaggcacccatcaaggaaaacgagatccgcattaccacgcaggggaggatgcgcaactacatcacctacgccaccggcttgcttcaggacaaaggttctgatgaggttgtattcaaggccatggggagggctatcaataagactgtcatggttgtggaattgatcaagaggaggattgttggcctccatcagaataccaccactggatctactgatattactgatatgtgggagccattggaggaaggcctacttccgtaagtgacttgtttctattccaggatagaactataactgcatatgaacctgtaattttggagttcaagattatatctctctgcaggcttgagacaacaagacatgtctctatgatcactataactctttcaaagaaggagctggacacatcatctatc

SEQ ID NO: 48370 - protein, 98 aa, Zea mays
  misc_feature: Ceres CLONE 1457354-F
  misc_feature (17)..(87): Pfam Name: Alba Pfam Description: Alba
  misc_feature: SWISSPROT Homolog: EC 3.1.26.5 Ribonuclease P
MDRYQRVEKQGEEAPIKENEIRITTQGRMRNYITYATGLLQDKGSDEVVFKAMGRAINKTVMVVELIKRRIVGLHQNTTTGSTDITDMWEPLEEGLLP

SEQ ID NO: 48371 - DNA, 725 bp, Zea mays
  misc_feature: Ceres CLONE 1457356-F
  misc_feature: Encodes the peptide sequence at SEQ ID NO. 48372
  misc_feature (415)..(415): n is a, c, t, g, unknown, or other
aaagctggagctccccgcggtggcggccgctctagaactagtggatcccccgggctgcaggaattcgcacgagaccattacctagaacatcctaatcgaaaaaaccgtcgcccccctttctctctcgctcaaaagttgctgctggagccatctcccctctctccgacccccaacaatggatgaggcgcaagttgtggagtcaaaggatggaaccatctcggttgcttctgcatttgctggttttcaggaagctgtgcaagacaaggatcacaaattcttgacaaaagcagtggaagaagcatatcgaggagtcgattgcggtgacggaggtccatttggagcagttgtcgtccgtaatgacgaagtagtagttagctgccataacatggttctaaagcacactgaccctactgcncatgctgaagtaactgcaattagagaggcttgcaaaaaacttgggaaaaatgagctctctgactgcaaaatttacgcgtcttgccaagcatgccccatgggctttgggtgcatttcacctctcccaaatcaaaaggctggtttatgggggccaaggagaggcggccatcccccttggaattgaaagaatttccttgcaaaagctctcaaaagggcctgggtttcccccaaagggccactttggaaaatcaaaaaaacaaccggcatgggggcctttgtccccccaaaccaattcttttaaaaaaaaaaaa

SEQ ID NO: 48372 - protein, 140 aa, Zea mays
  misc_feature: Ceres CLONE 1457356-F
  misc_feature (28)..(117): Pfam Name: dCMP_cyt_deam_1 Pfam Description: Cytidine and deoxycytidylate deaminase zinc-binding region
  misc_feature: SWISSPROT Homolog: EC 3.5.4.3 Guanine deaminase
MDEAQVVESKDGTISVASAFAGFQEAVQDKDHKFLTKAVEEAYRGVDCGDGGPFGAVVVRNDEVVVSCHNMVLKHTDPTAHAEVTAIREACKKLGKNELSDCKIYASCQACPMGFGCISPLPNQKAGLWGPRRGGHPPWN

SEQ ID NO: 48373 - DNA, 728 bp, Zea mays
  misc_feature: Ceres CLONE 1457363-F
  misc_feature: Encodes the peptide sequence at SEQ ID NO. 48374
  misc_feature (454)..(454): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
aaaagctggagctccccgcggtggcggccgctctagaactagtggatcccccgggctgcaggaattcgcacgagaccattacctagaacatcctaatcgaaaaaatcgaccctgcatccaaatctaggttttcggttcccctccacaggatgtccgaccccgccgctggaggcgccatggttcctgctgccggacgcggcatcgcatgggcgaacggcggcccccggttcggcgacatggtctgggccaaggtgaagtcccatccgtggtggcctggccatatctacagcgtcagcctcaccgacgacgaggaggtacaccgcggccaccgcgacgggctcgtcctcgtcgccttcttcggtgactcgagctatgggtggtttgaccccagcgagctcgtccccttcgaggaccacttcaccgagaaggcggcccaggggcgcagcttccgcancaactttgccgcccccctggccaaggcctccaacaaggtacccccccgaaggggctgggcctgcttgccctttgaaaattctggagcctttccgcccccccccagggagggggattttttttggggaaaatccccggtttttccccccggctttaaaccccttccacaaatacggggcccaggggataattttcccgagaagggcttaatattttggggcccccttttttaaaaaaaaaaccccttgattttccttacggggnnnnnnnnnnnn

SEQ ID NO: 48374 - protein, 178 aa, Zea mays
  misc_feature: Ceres CLONE 1457363-F
  misc_feature (24)..(98): Pfam Name: PWWP Pfam Description: PWWP domain
  misc_feature (102)..(102): Xaa is any aa, unknown, or other
MSDPAAGGAMVPAAGRGIAWANGGPRFGDMVWAKVKSHPWWPGHIYSVSLTDDEEVHRGHRDGLVLVAFFGDSSYGWFDPSELVPFEDHFTEKAAQGRSFRXNFAAPLAKASNKVPPRRGWACLPFENSGAFPPPPREGDFFWGKSPVFPPGFKPLPQIRGPGDNFPEKGLIFWGPLF

SEQ ID NO: 48375 - DNA, 781 bp, Zea mays
  misc_feature: Ceres CLONE 1457367-F
  misc_feature: Encodes the peptide sequence at SEQ ID NO. 48376
  misc_feature (419)..(419): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (670)..(670): n is a, c, t, g, unknown, or other
  misc_feature (671)..(671): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (775)..(775): n is a, c, t, g, unknown, or other
  misc_feature (776)..(776): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
ggagctccccgcggtggcggccgctctagaactagtggatcccccgggctgcaggaattcgcacgagaccattacctagaacatcctaatcgaaaaattccttaccggaagagaacaaaataactcggaaaagaaggagacgccgaatattcgaaaggggagggggaaagcaaagctgatggcggaggaccatgggaaagcaaagcagatggcggaggccccgagcaagatcgaatccatgaggaagtgggtcgtccagcacaagctacgagccgtatgttgcctctggctaggtgagatcagcagttcgatcgtctactgctggtcgcggcccaatatgaagcctagcgtccagatcatccccgacagggtgcatgcacaagctcttaccctcgatgatttagtcgcctcctgttggngggcgtacctttggccagaggctagggttccttctgggccaaaggtggcaaaaaaacaagcaattccgggcccttttcataaaaatgaaggccccgggtgggttgggcttccgaaagctcaaaatatttttggcnnnctcccaggttcccctgacccaccacgggggggaggtgttctctttttttttctgcccaaaaaaaaggggggctcctgccggnnnnnnngggggggnnnnnnnngtgggcctgannccttgggggggataggnnnnnnnnnnnnnnnnnnnnnnnnnnnnnnnnnnnnnnnnnnnnnnnnnnnnnnnnnnnnnnnnnnnnnagnnnnnnnnnnnnnnaanntnnnn

SEQ ID NO: 48376 - protein, 170 aa, Zea mays
  misc_feature: Ceres CLONE 1457367-F
  misc_feature (81)..(81): Xaa is any aa, unknown, or other
  misc_feature (126)..(126): Xaa is any aa, unknown, or other
  misc_feature (154)..(154): Xaa is any aa, unknown, or other
  misc_feature (155)..(155): Xaa is any aa, unknown, or other
  misc_feature (156)..(156): Xaa is any aa, unknown, or other
  misc_feature (159)..(159): Xaa is any aa, unknown, or other
  misc_feature (160)..(160): Xaa is any aa, unknown, or other
  misc_feature (161)..(161): Xaa is any aa, unknown, or other
  misc_feature (164)..(164): Xaa is any aa, unknown, or other
  misc_feature (165)..(165): Xaa is any aa, unknown, or other
MAEDHGKAKQMAEAPSKIESMRKWVVQHKLRAVCCLWLGEISSSIVYCWSRPNMKPSVQIIPDRVHAQALTLDDLVASCWXAYLWPEARVPSGPKVAKKQAIPGPFHKNEGPGWVGLPKAQNIFGXLPGSPDPPRGGGVLFFFLPKKKGGSCRXXXGGXXXGPXXLGGIG

SEQ ID NO: 48377 - DNA, 720 bp, Zea mays
  misc_feature: Ceres CLONE 1457368-F
  misc_feature: Encodes the peptide sequence at SEQ ID NO. 48378
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaaagaggctggaagcaacggtgccgccggagatggagacggaaaaggaggcggcagcggcgaggcaggcgaaggagtccctggagctggcgttccagatgtcccagatcctcgaaaccggcctcgaccgccacaccctgtcgctgctcatggcgctctgcgaccgcggcgccaaccccgaggccctggccgccctcgtccgcgaactctcctccactgctcccccaaccgccgccgaggctccctcccccgtgagcaacgccgccgcggggccggccccggcaacagcgtccatgttctcctccggccttcgccgtccctagggtttgtgatgtcccttttttcgccggtgagactgcttgccagttagtcgactagatcccgcagtatgcactcagccgctgtagtgcctgaatgtagtatgttcttatgttttgactaaatttgtgcctcacaagaangataatggttcaacccaatgccatatatcaccggtactgccaaaaaaaaaaaaaaaaagcttaatccttaccgtccaccccagggggggggcccgggacccattttccccctaagggggagcctaataccccgggccccccggggcgccgccttttaaaa

SEQ ID NO: 48378 - protein, 96 aa, Zea mays; identical to SEQ ID NO: 45933
  misc_feature: Ceres CLONE 1457368-F

SEQ ID NO: 48379 - DNA, 739 bp, Zea mays
  misc_feature: Ceres CLONE 1457369-F
  misc_feature: Encodes the peptide sequence at SEQ ID NO. 48380
  misc_feature (401)..(401): n is a, c, t, g, unknown, or other
  misc_feature (433)..(433): n is a, c, t, g, unknown, or other
  misc_feature (480)..(480): n is a, c, t, g, unknown, or other
  misc_feature (649)..(649): n is a, c, t, g, unknown, or other
  misc_feature (719)..(719): n is a, c, t, g, unknown, or other
tccccgcggtggcggccgctcttcaactagtggatcccccgggctgcaggtatttcgcacgagaccattacctagaacatcctaatcgaaaaaccatgggcctctgcttatccgtgtctctctggaaggagaagctctacggcgccgacggcagcagccggacagtgcagtgtcgcgtcgtccatgaggttgccggcgtggacagtggtgactgctagtgcgggaacttgggaagcgacgcccacgcgctgggggtagagcacaaggcggcggcggcggcggttccggcggtcatgggcgtgaaaagcggtgtagtggagggagctgccgctgccgtgccgggtggcactcctgtgaggtcgatatcacacacgagggtgctgatgggcgtaaagtgctancccaccgcggttcagcgggatggtactctacnacaagagcggacggccagtgtgcactgggctccggcgaagaactcgngaccaagagaaacatgctgccgcgacttcggggccgagagacctgcttttgatcttcgtcaaccagaaccaggccgtagggaaattctgccgaatgggaatgacatgtttgagttaattctaaattggacacggctctttgtttaaagggctcggcccgtttttttggnggaacttattattttcgtctcctcgcggtatcgtagaaaaaataatgctttatttcgaaatccccgctcnaacccttccacagggggggg

SEQ ID NO: 48380 - protein, 40 aa, Zea mays
  misc_feature: Ceres CLONE 1457369-F
MGLCLSVSLWKEKLYGADGSSRTVQCRVVHEVAGVDSGDC

SEQ ID NO: 48381 - DNA, 707 bp, Zea mays
  misc_feature: Ceres CLONE 1457372-F
  misc_feature: Encodes the peptide sequence at SEQ ID NO. 48382
cgcggtggcggccgctctagaactagtggatcccccgggctgcaggaattcgcacgagaccattacctagaacatcctaatcgaaaaaaaaatcgagataagagcaagatgacgtcgtcgacggcgttcagccaactgttcccttccgccgctgcggtatcccccgtccctcgctgcgtctccctgcagctcttctgcgccagcggtggagttgtccctggatggaggagaagatgccgccgcatggccatggtgcgcgcggccaccgtggatgctgcggcgcccgcctacacctccgattccctcatcctctacttcaaggcggagggcaccatggaggagagggccattcccaagatcacagaatctcttgagggtatggagggagtcaaggacctggaggtgctcattgaagaaggcatagggagcgttgtgttaacaaaggagacaactgtgcaagctactggagtagcctcgaacctggtggaagctatccagggagctggggtctagctgccaaatctaaacctggagcttcatgagattcaccaaaacccccccccgggagggggaggggcgctccccccccccccgggggggaaaaattttgggggggccggggggggggaaaaaaaaaaaaaaaaaaacccccccccccaattgatattatccccccccccccccacttcaataaaaaaaaaaaaaaa

SEQ ID NO: 48382 - protein, 134 aa, Zea mays
  misc_feature: Ceres CLONE 1457372-F
MTSSTAFSQLFPSAAAVSPVPRCVSLQLFCASGGVVPGWRRRCRRMAMVRAATVDAAAPAYTSDSLILYFKAEGTMEERAIPKITESLEGMEGVKDLEVLIEEGIGSVVLTKETTVQATGVASNLVEAIQGAGV

SEQ ID NO: 48383 - DNA, 759 bp, Zea mays
  misc_feature: Ceres CLONE 1457373-F
  misc_feature: Encodes the peptide sequence at SEQ ID NO. 48384
  misc_feature (445)..(445): n is a, c, t, g, unknown, or other
  misc_feature (454)..(454): n is a, c, t, g, unknown, or other
  misc_feature (455)..(455): n is a, c, t, g, unknown, or other
  misc_feature (459)..(459): n is a, c, t, g, unknown, or other
  misc_feature (460)..(460): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (474)..(474): n is a, c, t, g, unknown, or other
  misc_feature (485)..(485): n is a, c, t, g, unknown, or other
  misc_feature (499)..(499): n is a, c, t, g, unknown, or other
  misc_feature (584)..(584): n is a, c, t, g, unknown, or other
  misc_feature (609)..(609): n is a, c, t, g, unknown, or other
  misc_feature (631)..(631): n is a, c, t, g, unknown, or other
  misc_feature (664)..(664): n is a, c, t, g, unknown, or other
  misc_feature (687)..(687): n is a, c, t, g, unknown, or other
  misc_feature (695)..(695): n is a, c, t, g, unknown, or other
  misc_feature (701)..(701): n is a, c, t, g, unknown, or other
  misc_feature (723)..(723): n is a, c, t, g, unknown, or other
  misc_feature (748)..(748): n is a, c, t, g, unknown, or other
  misc_feature (750)..(750): n is a, c, t, g, unknown, or other
  misc_feature (752)..(752): n is a, c, t, g, unknown, or other
  misc_feature (753)..(753): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
aaagctggagctccccgcggtggcggccgctctagaactagtggatcccccgggctgcaggaattcgcacgagaccattacctagaacatcctaatcgaaaaaaaaatcaagataagagcaagatgacgtcgtcgacggcgttcagccaactgttcccttccgccgctgcggtatcccccgtccctcgctgcttctccctgcacctcttcttcgccagcggtggagttgtccctggatggaggagaagatgccgccacatggtcatggtgcgcgcggccaccgaggatgctgcggcgcccgcctacacctccgattccctcatcctctacttcgaggaggagggcaccatggaggagagggccgttcccagatcacacaaacccttgagggatggagggagcagggacccgaaccccccccacagttgatgcgaaaaatacgagnctctatgcnncggnngnnnncaacagganacccctcgggncaagctatctgtangtggccatcaaaacctgggtggaaaccttatccactgggaccttgggggtcaatcaccccacactccttaaaactgggatgtccnagggaattgttacgaagacctcctngtcgcgggccggcggaccgagnttcctccctcccccaggacgttatcttatattngcgccggagggggtgggggaaangccaaacnataatngttttttactcgttcttttggnaacggggggggtttttcttttgttncntnnccgnnn

SEQ ID NO: 48384 - protein, 101 aa, Zea mays
  misc_feature: Ceres CLONE 1457373-F
MTSSTAFSQLFPSAAAVSPVPRCFSLHLFFASGGVVPGWRRRCRHMVMVRAATEDAAAPAYTSDSLILYFEEEGTMEERAVPRSHKPLRDGGSRDPNPPHS

SEQ ID NO: 48385 - DNA, 688 bp, Zea mays
  misc_feature: Ceres CLONE 1457374-F
  misc_feature: Encodes the peptide sequence at SEQ ID NO. 48386
ctccccgcggtggcggccgctctagaactagtggatcccccgggctgcaggaattcgcacgagaccattacctagaacatcctaatcgaaaaagaggctggaagcaacggtgccgccggagatggagacggaaaaggaggcggcagcggcgaggcaggcgaaggagtccctggagctggcgttccagatgtcccagatcctcgaaaccggcctcgaccgccacaccctgtcgctgctcatggcgctctgcgaccgcggcgccaaccccgaggccctggccgccctcgtccgcgaactctcctccactgctcccccaaccgccgccgaggctccctcccccgtgagcaacgccgccgcggggccggccccggcaacagcgtccatgttctcctccggccttcgccgtccctagggtttgtgatgtcccttttttcgccggtgagactgcttgccagttagtcgactagatcccgcagtatgcactcagccgctgtagtgcctgaatgtagtatgttcttatgttttgactaaatttgtgcctcacaagaagataatggttcaaccaaatgccatatatcacgttactgcaaaaaaaaaaaaaaaaagcttatcgataccgtcgacctcgagggggggcccggtacccaattcgccctatagtgagtcgtattacgcgcgctcactggcc

SEQ ID NO: 48386 - protein, 96 aa, Zea mays; identical to SEQ ID NO: 45933
  misc_feature: Ceres CLONE 1457374-F

SEQ ID NO: 48387 - DNA, 739 bp, Zea mays
  misc_feature: Ceres CLONE 1457377-F
  misc_feature: Encodes the peptide sequence at SEQ ID NO. 48388
  misc_feature (388)..(388): n is a, c, t, g, unknown, or other
aaagctggagctccccgcggtggcggccgctctagaactagtggatcccccgggctgcaggaattcgcacgagaccattacctataacatcctaatcgaaaagcgctggacaccaccgcatgctagggaggcagggaggggagccgagcctaggacgatggcgctgggcgtgttgttccacggcgcacacctatcgctggatctggcggtggccgggatgtcgctggcggaggcgctcgggttcttcgccctcatcactaccttgctctgatccgcggcgttcctccaccactccaagcccgccgcgtagtcatagcctccacagcgaccaacgcgtctcaacctctggcagatgacaaacttgagtatgtggcatcttttcctcaangttggagggacgaacagggctacccaccaccgctgccctgcctgatttgatcctgaaccttttattgaagtcaaacgcttgtccggggacatttgcttgcgggactcggcaaaaaaaaagctggaccccacccccgcttgatcgcccttttggagggaattaaggcctgaaccccccgagggcctgaaccccgcctccggggtcctttttttttcccgggcctttcttttatccccccgagaaaaagttatttttcccgggcgtttggcaattttggaaaaaaaccccgggccccttttcgttattttaacacggggcgccccggggttttttggcccacactttccaaac

SEQ ID NO: 48388 - protein, 37 aa, Zea mays
  misc_feature: Ceres CLONE 1457377-F
MALGVLFHGAHLSLDLAVAGMSLAEALGFFALITTLL

SEQ ID NO: 48389 - DNA, 753 bp, Zea mays
  misc_feature: Ceres CLONE 1457381-F
  misc_feature: Encodes the peptide sequence at SEQ ID NO. 48390
  misc_feature (179)..(179): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (559)..(559): n is a, c, t, g, unknown, or other
  misc_feature (753)..(753): n is a, c, t, g, unknown, or other
aaagctggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtantactgatccgcaatgtcgacggaggaggctgttgtggctgaggtcccggtgaccgaggtgccagcggaggtcccggcggcccaggtggccaaggcgcccaaggcgaagaaggcgcccaaagagaataaggctcctaaggagaagaagctgtccgcgctaaagaagccggcggctcaccctccctaccctgagatggatgggggggcaatccctgcctttcaggaaaagaaggggttcaagcttcnnnncccccccaccaatttccttcagggggaagcgcggggggcaatttccccccaattttccgaaggcggtttcccggggagttgaaaaaacttcctcccccccggaaacttaaaaaggggaaaaaacttcttttngggtgtccggccaccgtagccaagtcccagggctcccaaaccaaggccccccgggggttcccccataacctaaacctcttcgacaagggagaggccaccgccgtgttgagaacccccgggggcgttctccccccccccgaggcacaggatggagggggaggggcccgggcacctcggtttcttctctgcgcgcn

SEQ ID NO: 48390 - protein, 105 aa, Zea mays
  misc_feature: Ceres CLONE 1457381-F
  misc_feature (78)..(78): Xaa is any aa, unknown, or other
  misc_feature (79)..(79): Xaa is any aa, unknown, or other
MSTEEAVVAEVPVTEVPAEVPAAQVAKAPKAKKAPKENKAPKEKKLSALKKPAAHPPYPEMDGGAIPAFQEKKGFKLXXPPTNFLQGEARGAISPQFSEGGFPGS

SEQ ID NO: 48391 - DNA, 777 bp, Zea mays
  misc_feature: Ceres CLONE 1457398-F
  misc_feature (256)..(256): n is a, c, t, g, unknown, or other
  misc_feature (355)..(355): n is a, c, t, g, unknown, or other
  misc_feature (368)..(368): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (587)..(587): n is a, c, t, g, unknown, or other
  misc_feature (608)..(608): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (627)..(627): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (732)..(732): n is a, c, t, g, unknown, or other
gctctagaactagtggatcccccgggctgcaggaattcgcacgagaccattacctagaacatcctaatcgaaaaaaaacatcatcccttttttcgcagcaggacgcatttattaagtgcgcctccgccaaccgcactctgcccgccgaaagcgtcggcgggccacctcgcactcgcgcgcgcctcaaagatgcccaggcagctcagactctccgccagcccgaagcagcagcagccgcctcctgacggcaccagcnccggcggcggtaacgcggcggccaaaggagatggaggcgggggaggaggagtctttgggcttctcactccagctttattggtcttgcagtgggcccccnggttaatgggatngatatgttttttttatttttggtccccccccccccacctttcctcctctttcccccctggctccttccttttggtccccaccaaaccccggcccccccccccccaaaatnnnccaagccttctccctggaaagcccgcggggcgggaaggaggaggggacccaatattttgcgtaaaacccggaaggtataaaagaacgccttttaggggtgggggganatatcctctacctcttcgggnattaattannnntgtccanacaaaaccccgcaatatttctttaatatatattannnnctcataacgcaatagtcggggggaacccagatgatatatgtccgccacaaaaaatataaaacctgtntaggggagggagggaacagacaccagacaacccgtcacaaataaa

SEQ ID NO: 48392 - DNA, 712 bp, Zea mays
  misc_feature: Ceres CLONE 1457400-F
  misc_feature: Translation starting site: 167
  misc_feature: Pfam Name: DUF953 Pfam Description: Eukaryotic protein of unknown function (DUF953)
  misc_feature (350)..(350): n is a, c, t, g, unknown, or other
  misc_feature (401)..(401): n is a, c, t, g, unknown, or other
  misc_feature (426)..(426): n is a, c, t, g, unknown, or other
  misc_feature (427)..(427): n is a, c, t, g, unknown, or other
  misc_feature (434)..(434): n is a, c, t, g, unknown, or other
aaagctggagctccccgcggtggcggccgctctagaactcgtggatcccccgggctgcaggaattcgcacgagaccattacctagaacatcctaatcgaaaaaatctttcttgctgctccaattcgctctctttactcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacnagcagctggaggcactggagggcaaggacggggtgctcctgcgcgcctacntcgggggacaagctccaccctcccnnactcggngcacccggggagggtggaccccaggttcgggctcaagggcgtgccaacgctgatcccgctgggaggatggcgcccccgccccctgcctcggggacgacgaggccccccctcaagggacaagtttgacccccctcctctgcgctggggggcaactgaatactggccggatctgggtttcccggtcgggtttccattctgcgagagaggggccataaaaaacaggggacctgtaaattcaggttcaccctacagggccggaacaagaggcctggggggat

SEQ ID NO: 48393 - DNA, 705 bp, Zea mays
  misc_feature: Ceres CLONE 1457404-F
  misc_feature: Encodes the peptide sequence at SEQ ID NO. 48394
  misc_feature (389)..(389): n is a, c, t, g, unknown, or other
  misc_feature (412)..(412): n is a, c, t, g, unknown, or other
aagctggagctccccgcggtggcggccgctctagaactagtggatcccccgggctgcaggaattcgcacgagaccattacctagaacatcctaatcgaaaagatacacatccgtcccttctagtctcctaataactagtttctatcttgctccccaaaccagcgcaaaccctgccctgacaccggcagcgacacgtccaccggcggcgccatggtgctcgaggcaacgatgatctgcatagacaattcggaatggatgcggaacggcgactacgctccgtcgcggttccaggcgcaggccgatgccgtcaacctcatctgcggcgccaagacccagtcaaacccggagaacacggtaggcgtgatgacaatggccggaaagggtgttcncgtgcttgtcactcccaccaccnaccctcgggaagattctcgcctgtatgcacggttttagaagttggcgctgagggcaaacttggctgcggcaatccaggtttgcccagcttggctctaaagcatccgccaggaaccagaaagcaaccagcaggagggattaatagcttttcatttggaaagtccctggggaaagtcaccaccaaaaaaaagtttttgggaaaaacccttttgggaaaaaaaaccttaaaaaaaaaaaaaaaagtggtttgccctcctttgaaaaattgggttgagatttttggggcaaaaaacc

SEQ ID NO: 48394 - protein, 79 aa, Zea mays
  misc_feature: Ceres CLONE 1457404-F
  misc_feature (60)..(60): Xaa is any aa, unknown, or other
  misc_feature (68)..(68): Xaa is any aa, unknown, or other
MVLEATMICIDNSEWMRNGDYAPSRFQAQADAVNLICGAKTQSNPENTVGVMTMAGKGVXVLVTPTTXPREDSRLYARF

SEQ ID NO: 48395 - DNA, 771 bp, Zea mays
  misc_feature: Ceres CLONE 1457409-F
  misc_feature: Encodes the peptide sequence at SEQ ID NO. 48396
aaagctggagctccccgcggtggcggccgctctagaactagtggatcccccgggctgcaggaattcgcacgagaccattacctagaacatcctaatcgaaaattaccgctaatgaacttccagaagttatagctgaagcctcaaagcactgtggtatccttcggaaagctgcagaagctggtggattgatagtcgatgcaatggctggcatccaagatgatctcaaggatgagacagtgtcagtgccactaatggctgttgagaatggatgcggcagtccatgtattgatttccggcaggttagctcatagcttgctgctgctgcaaaggatgcacatttgttaattttagagggcatggggcgatcattgtattacaacctcaatgccctttttacacagggaggcttctcccaccccccctgggtcaaaaatcacccatttggcaaacaaaactcttcaagggggagttctatcccaactgcaacccggcaaattttgaaaccagttcccttaaacaaaattgggtagcgcactggggaagggaacttactaaaagcctaccttggatttgggggtaacccggcgggaactaaaaaaaaaactctacggcgcgaacgggctaatccgctaccttttctctggggccgggggggcaaaaaaaaaccccctctttacataaaaaaccaacaaaggtggttttctcgaaaacgcaaatataaaaaaagggtctcctaagggtcacgtttccaaaaaaaacaaaaaataaaaa

SEQ ID NO: 48396 - protein, 36 aa, Zea mays
  misc_feature: Ceres CLONE 1457409-F
  misc_feature: SWISSPROT Homolog: EC 2.7.1.33 Pantothenate kinase
MAGIQDDLKDETVSVPLMAVENGCGSPCIDFRQVSS

SEQ ID NO: 48397 - DNA, 642 bp, Zea mays
  misc_feature: Ceres CLONE 1457413-F
  misc_feature: Encodes the peptide sequence at SEQ ID NO. 48398
tggagctccccgcggtggcggccgctctagaactagtggatcccccgggctgcaggaattcgcacgagaccattacctagaacatcctaatcgaaaacagtggaaaacttccctttttgggaatccaacagaccctgaaactctgaggcgaaggtgcatggttgttgaaactctggctgaaaagcattttgaattagcttttagaatgcttcatgagtttgatctcccagctgttgataattatgctggggtaactgcttccctcccaaaaaggaaaaaagggggccagttttaacaaaattcttaaagaataaagggggacttaaatgaagatgaatgggatccgggttttgggggctcctaaaaagggtaaagccccccatcttaaaaaaaacccaaattctctttccccccttgttatttcttattcggggaaacccctttgttttggttgttggggggcccctaaaaaaaggtttttccaaaaaccccccccaaaagaaaaagccccccaaaaattaaaaagtttcccccccgggggtttccccccacaatttttttccccccttttttttttttataaaaaaagggtccccccccccccctgtgttaacacacacaaccctgcgggaaaaaaatccc

SEQ ID NO: 48398 - protein, 97 aa, Zea mays
  misc_feature: Ceres CLONE 1457413-F
GAPRGGGRSRTSGSPGLQEFARDHYLEHPNRKQWKTSLFGNPTDPETLRRRCMVVETLAEKHFELAFRMLHEFDLPAVDNYAGVTASLPKRKKGGQF

SEQ ID NO: 48399 - DNA, 710 bp, Zea mays
  misc_feature: Ceres CLONE 1457414-F
  misc_feature: Encodes the peptide sequence at SEQ ID NO. 48400
aaaactggagctccccgcggtggcggccgctctagaactagtggatcccccgggctgcaggaattcgcacgagaccattacctagaacatcctaatcgaaaaccaaaattcccagtccgcgatacaagaccaatccaatccaatccaatcccagcggaagtggaagcagcttcatttccttccttgcagctagcagcgatgattcttgtggcgatagtggcggagctgctcgaggagtacaccgcgctggtggcgcgggtgctggagcagctgctcaacgacgcgccgttcccgcgccggatgcgcttcctcatgctgcggagcctccccttcgtgccgccgcctctgcccccgccgccgccgccgcacgccctccacgttaccacccgagtctgattattggctccatttttcccacgcgtttcagcctactgcccgccatggccgcccacccactagcctgcgcttgaggcagctagtagtagatactgtaggttgaccagtgatccacggtgtgtttctcgctttccttttgtctgttgatttctattggttatactacacggtgctgtaaaggatcaattagttctgcctttgaggccctcatttggtgtaaatatttttgataacatggaccatggaaaaaactttcctttgacattttctttaaaaaaaaaaaaaaaagctaatcgataccgtcaactcgaggg

SEQ ID NO: 48400 - protein, 65 aa, Zea mays; identical to SEQ ID NO: 44442
  misc_feature: Ceres CLONE 1457414-F

SEQ ID NO: 48401 - DNA, 703 bp, Zea mays
  misc_feature: Ceres CLONE 1457415-F
  misc_feature: Encodes the peptide sequence at SEQ ID NO. 48402
  misc_feature (418)..(418): n is a, c, t, g, unknown, or other
  misc_feature (497)..(497): n is a, c, t, g, unknown, or other
  misc_feature (528)..(528): n is a, c, t, g, unknown, or other
  misc_feature (533)..(533): n is a, c, t, g, unknown, or other
aaactggagctccccgcggtggcggccgctctagaactagtggatcccccgggctgcaggaattcgcacgagaccattacctagaacatcctaatcgaaaaagtgtcacctgcacattgcagaccgcctcagcgcctcaccaagcgaaactcgttggcggctagggttttgctgcctcccgagcccaaaccctagagcacccgcgcccatcccatggcgtgctaggcttcgattgagactggggggattagtaccgcaggctgggattagagcaagcgccgagcggaaatggcatcgagtaaccaattcgatctacttggagacgtcgagaacgacgaccctgcccacctcctcgcagctgccgagaagaaggcggccgcggtgcctaagcccgcgcccgcgccgggcaagttgcccnacaaagctcccgcgcccgcgcaacctgtgagggaggaaaggaaactatgtgctccaccgcgcgatgggtcaagacgtgnaagaagcggccgcggttgcaggactggcccnaggcnaaattttggccatgctgaatgccaccgctttgagggggggatgggggccgcgccgccgtttttgggaacgtggaattctccccgtaaaaatggtaaggtagccagccaaaaggggcccggggccccccccgcctttaccgggaggggggccaacgggggggaacaccaag

SEQ ID NO: 48402 - protein, 138 aa, Zea mays
  misc_feature: Ceres CLONE 1457415-F
  misc_feature (44)..(44): Xaa is any aa, unknown, or other
  misc_feature (70)..(70): Xaa is any aa, unknown, or other
  misc_feature (82)..(82): Xaa is any aa, unknown, or other
MASSNQFDLLGDVENDDPAHLLAAAEKKAAAVPKPAPAPGKLPXKAPAPAQPVREERKLCAPPRDGSRRXRSGRGCRTGPRXNFGHAECHRFEGGMGAAPPFLGTWNSPRKNGKVASQKGPGAPPAFTGRGANGGEHQ

SEQ ID NO: 48403 - DNA, 756 bp, Zea mays
  misc_feature: Ceres CLONE 1457416-F
  misc_feature: Encodes the peptide sequence at SEQ ID NO. 48404
  misc_feature (379)..(379): n is a, c, t, g, unknown, or other
ggagctccccgcggtggcggccgctctagaactagtggatcccccgggctgcaggaattcgcacgagaccattacctagaacatcctaatcgaaaatatgttcccgggtatcgctgatcgtatgagcaaggagatcacttcccttgcaccaagcagcatgaagatcaaggtcgttgcaccgcctgagaggaagtacagtgtctggataggagggtcgatcctagcctcgctcagtactttccaacagatgtggatatcgaaggaggagtacgacgagtctggcccggcaattgttcaccggaagtgcttctagggtttcacaagttcctcgtcgttacctagtctcaaattatgtcccctccatttctcgagacacctngggcaaatttgcatgatacttttgtttttttctacccccacctaaaaatctccttgggaataggcctccccccccttggaatggtggtggctccaaatccctgttcccaccacagcttggtctgccgtgaccacttggcccgtgggaattgggtttctcaaacttgaattgtattttttttgggggacctggaagaacccaaaaatactatatttttggctttaaacgcgcccccctcgggcagcatcttgaaatccttaaagacgttgggacgcctgaaccatcccctgccaaatggaagagatggggccctttttatgaagcgcgtgggaattccccccgttttcttaaaaaataataaataaacaaaacccctt

SEQ ID NO: 48404 - protein, 71 aa, Zea mays
  misc_feature: Ceres CLONE 1457416-F
MFPGIADRMSKEITSLAPSSMKIKVVAPPERKYSVWIGGSILASLSTFQQMWISKEEYDESGPAIVHRKCF

SEQ ID NO: 48405 - DNA, 705 bp, Zea mays
  misc_feature: Ceres CLONE 1457421-F
  misc_feature: Encodes the peptide sequence at SEQ ID NO. 48406
aaagctggagctccccgcggtggcggccgctctagaactagtggatcccccgggctgcaggaattcgcacgagaccattacctagaacatcctaatcgaaaaagacaaatccaaggtttcgagcacagacacaggcgaaactcgatggcggaggggtccaagccggacgtgccgctgttccagctcctcagcgatcttctccagcaggtggagtcaatgagcaatcaggaagaagtagagctgcgcgctaagattgaagcattaggattagaagtcactaaggtaccagagcagcccgctaatcatctcagcgagctagaaatagctgcagagttggacaagctgtcatcgcggcttgataacgtcgacaagatgatatcatctgccatggcctcagatccagaggcccaccccccgtctgagcagcacatctgatatctggatgccggtcataacagcgtctgccaatgagaggcgggggtttgttgggacgagcagcgaaggcacccaggaagagcaggagaattccaagcaatagctggaatatgggctgttaatagtttcgttttgtggggctggaccgaccttatccatgttcattcaaactagggtttccctggcaaaaagtttgtgggcgtaataaacaataaaaaccccttgtcctttcattccggattaagtaatgaagtgtgaatgaaaacagct

SEQ ID NO: 48406 - protein, 96 aa, Zea mays
  misc_feature: Ceres CLONE 1457421-F
MAEGSKPDVPLFQLLSDLLQQVESMSNQEEVELRAKIEALGLEVTKVPEQPANHLSELEIAAELDKLSSRLDNVDKMISSAMASDPEAHPPSEQHI

SEQ ID NO: 48407 - DNA, 708 bp, Zea mays
  misc_feature: Ceres CLONE 1457424-F
  misc_feature (380)..(380): n is a, c, t, g, unknown, or other
  misc_feature (406)..(406): n is a, c, t, g, unknown, or other
  misc_feature (463)..(463): n is a, c, t, g, unknown, or other
  misc_feature (513)..(513): n is a, c, t, g, unknown, or other
ggagctccccgcggtggcggccgctctagaactagtggatcccccgggctgcaggaattcgcacgagaccattacctagaacatcctaatcgaaaagatcccaaatgtgcccggcccggtccctctgcactgcgcccatccatccttaaaccctcctgcgcgcgtaggcctctcgctcgtctcgtctcgtctcgtccttccccagcacaccacaacctctcctcctccttcgccaggtgcctcttcgttctcctctccgttccctgcgtggcgcgcgcggcgctccaggctatcaggacgaaataactggccgcgctgcacgccggccgccgcgagaaagagcgctcgccccgcgcgctctgccgctggtttcgccgtantccgtcgccgctgattgatcctgcangaaaaacaggcaaagagctactttgagcccgagactgaactgaaaaaaagatgatgnccgaagtgcccacccccggcaggagaaccacccgacagctactttcattnaaagcccgttcccgttccccgccgggccacaagttcgaaagaattcggcagcttgcccccaaaaaccccaagaaatgcacccccaaaactccgccccctttccccaagggaaaaaaaggcacaatcggcaaaaaggtcccaaacttccaaaaatttttgtttacctttaaaaaaaaccaaaacgcttttttcctg

SEQ ID NO: 48408 - DNA, 714 bp, Zea mays
  misc_feature: Ceres CLONE 1457426-F
  misc_feature: Encodes the peptide sequence at SEQ ID NO. 48409
agagctggagctccccgcggtggcggccgctctagaactagtggatcccccgggctgcaggaattcgcacgagaccattacctagaacatcctaatcgaaaactttttctatatcgcgttacgtccctccctacccagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtaccgtaccaccgcaccgctctgtcacccggcttccttcacagtgctcgtgagtgagctggtgaggcgggatcggggcgtggcgggcttagatctacgggaatggggttgcttgccgcgtgaatcagtcggttagatgcttacccgcggagtttgcccctttttggttggatctgatgaatcgagcgtgcccttggggtcagcgtagtggaactaagcttgctgttaagtattttggtgcggctagctttagatccgtcggaattgccgtgactggatcaagcatgcgtgggttgctgggagctgaagttgt

SEQ ID NO: 48409 - protein, 67 aa, Zea mays
  misc_feature: Ceres CLONE 1457426-F
MADAKQQQQQPQQAAAAATGVWKTVKPFVNGGASGMLATCVIQPIDMVKVPYHRTALSPGFLHSARE

SEQ ID NO: 48410 - DNA, 742 bp, Zea mays
  misc_feature: Ceres CLONE 1457427-F
  misc_feature: Encodes the peptide sequence at SEQ ID NO. 48411
  misc_feature (333)..(333): n is a, c, t, g, unknown, or other
  misc_feature (368)..(368): n is a, c, t, g, unknown, or other
  misc_feature (400)..(400): n is a, c, t, g, unknown, or other
agagctggagctccccgcggtggcggccgctctagaactagtggatcccccgggctgcaggaattcgcacgagaccattacctagaacatcctaatcgaaaaatctacgttctactcccactcgcggtcgcggtagccggcggcggcggcggaggaaagcaggcaggccatggcgtcgtcgtcgtcgtcgaccccggcggccgtccgcgagatgcagaaggatctcgaggtccaggccaacgccctcagcaagatccagaaagacatcgccaagaaccaccaggtccgcaagcagtacaccatcccagtcggcgagaacgagctcgttctcanggagctggagctgctcagcgatgggggcaacgtgntacagctcatcggacgggtgctgggtcagcangacctcgctgaggccaaagcccacgttcagaagcgcatcgagtacattctccccaaagcttaagcggatggatcgggcccctcaagaccttggaggaaaagcaaaaccgccggaaggattccgtttttcctttttccccaaaggtatcggggttgtacaaatttaggtgttaaacacttgttttttgtggtggacattatccaagggctgggtttatttttctcccaatttccccccgggtttttttttttgggggggaaaaaagggggtttattttttctcccccccaccaaaaaaaaaaaaaaaaaacgggcttcaggaaaatatcgggttttttttttt

SEQ ID NO: 48411 - protein, 97 aa, Zea mays
  misc_feature: Ceres CLONE 1457427-F
  misc_feature (55)..(55): Xaa is any aa, unknown, or other
  misc_feature (67)..(67): Xaa is any aa, unknown, or other
  misc_feature (77)..(77): Xaa is any aa, unknown, or other
MASSSSSTPAAVREMQKDLEVQANALSKIQKDIAKNHQVRKQYTIPVGENELVLXELELLSDGGNVXQLIGRVLGQXDLAEAKAHVQKRIEYILPKA

SEQ ID NO: 48412 - DNA, 670 bp, Zea mays
  misc_feature: Ceres CLONE 1457429-F
  misc_feature: Encodes the peptide sequence at SEQ ID NO. 48413
aaagctggagctccccgcggtggcggccgctctagaactagtggatcccccgggctgcaggaattcgcacgagaccattacctagaacatcctaatcgaaaactctctcgatttctcgcggagcggccctccacctttatcgccgccgcctccgccgccgttgctgtgttccgtctcttcgccgatggcttcggccaagagaatgatgccaggacctcctgcttctggatatgaccggtcacctctattttacggaggaggtggtggcgccccacctccaattccgcttggaactggtagctatggtgctccatatccacaccttgggatgcgatatggctatggtccaccagtaggacctcctggttcatacggtcttttctcttcatatggtccacctgggccaatgagtggtatgggatatggcccaggacctgagctaggccgatatagctatgggtttagaggttctccaatgccggtttctagcccatggtctggtggagcattagctgaaaacactgacaacattgcttcacgaaagcgccgtggaggccctgatggactttctgagggtgactggacctgtcccaaatgcgacaacattaacttttccttcacaagcacttgcaacatgaagaaatgtggagccccaaggccaactccgtga

SEQ ID NO: 48413 - protein, 161 aa, Zea mays
  misc_feature: Ceres CLONE 1457429-F
  misc_feature (129)..(160): Pfam Name: zf-RanBP Pfam Description: Zn-finger in Ran binding protein and others
MASAKRMMPGPPASGYDRSPLFYGGGGGAPPPIPLGTGSYGAPYPHLGMRYGYGPPVGPPGSYGLFSSYGPPGPMSGMGYGPGPELGRYSYGFRGSPMPVSSPWSGGALAENTDNIASRKRRGGPDGLSEGDWTCPKCDNINFSFTSTCNMKKCGAPRPTP

SEQ ID NO: 48414 - DNA, 699 bp, Zea mays
  misc_feature: Ceres CLONE 1457430-F
  misc_feature: Encodes the peptide sequence at SEQ ID NO. 48415
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaaagaaaggaaaccctaggccgctacgcccttggccccttctctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagctacgtgcggcgaccggaccaggcagaccgtgtcatctgcaccctccttggatccctcctccccgatggcaccgtccacgtccgcaactcctacgtggtcccccacagcgagtcggccgaccaggtcgccatcgacatcgactaccaccataacatgtacgcctcgcaccagaaggtgaaccccaaggaagtcatcgtcggatggttctcgactggatttggtgtttctgggggaagtacgcttatccatgagttctattcaagggaagtacaaagccccatccatcttacagtcgacaccggcttcactagggggggagcttccatcaaagcctacgtctcatccaacctgtcccctcgtgataggcaactcgctgcgcaatcactgacgggnnnnnnnnnnnngnnnnnnn

SEQ ID NO: 48415 - protein, 166 aa, Zea mays
  misc_feature: Ceres CLONE 1457430-F
  misc_feature (17)..(127): Pfam Name: Mov34 Pfam Description: Mov34/MPN/PAD-1 family
MATPPALLFPSPSSASSPPSSAQVEAVVLFNVCDSYVRRPDQADRVICTLLGSLLPDGTVHVRNSYVVPHSESADQVAIDIDYHHNMYASHQKVNPKEVIVGWFSTGFGVSGGSTLIHEFYSREVQSPIHLTVDTGFTRGGASIKAYVSSNLSPRDRQLAAQSLTG

SEQ ID NO: 48416 - DNA, 716 bp, Zea mays
  misc_feature: Ceres CLONE 1457435-F
  misc_feature: Encodes the peptide sequence at SEQ ID NO. 48417
  misc_feature (417)..(417): n is a, c, t, g, unknown, or other
  misc_feature (420)..(420): n is a, c, t, g, unknown, or other
  misc_feature (438)..(438): n is a, c, t, g, unknown, or other
  misc_feature (439)..(439): n is a, c, t, g, unknown, or other
aaagctggagctccccgcggtggcggccgctctagaactagtggatcccccgggctgcaggaattcgcacgagaccattacctagaacatcctagtcgaaaaatcacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgtctacctggccgccgtcctcgagtacctggccnccnaaagtgctggagctggcnngcacgctgccaaagacaacaagaagacccgcatcatcccgcgccacgtgctccttgccatcggcaacgacaaggaactccggaagctgctgtccggggtcaccatcgcccagggggggtcttcccaaaaataacccgggggtccttgccaaaaaaaccgctaagaaggggggggcaaaggaggccaatttccccaaaaggccgccaaaccccccaaaaagggtaaggggggggggccccttacccccctgaaagtaaaaagccccgtacaaaaaatt

SEQ ID NO: 48417 - protein, 124 aa, Zea mays
  misc_feature: Ceres CLONE 1457435-F
  misc_feature (31)..(104): Pfam Name: Histone Pfam Description: Core histone H2A/H2B/H3/H4
  misc_feature (74)..(74): Xaa is any aa, unknown, or other
  misc_feature (75)..(75): Xaa is any aa, unknown, or other
  misc_feature (81)..(81): Xaa is any aa, unknown, or other
MDASAAGAGGKAKKGAAGRKAGGPRKKSVTRSVKAGLQFPVGRIGRYLKKGRYAQRVGTGAPVYLAAVLEYLAXXSAGAGXHAAKDNKKTRIIPRHVLLAIGNDKELRKLLSGVTIAQGGSSQK

SEQ ID NO: 48418 - DNA, 630 bp, Zea mays
  misc_feature: Ceres CLONE 1457503-F
  misc_feature: Encodes the peptide sequence at SEQ ID NO. 48419
  misc_feature (415)..(415): n is a, c, t, g, unknown, or other
tggagctccccgcggtggcggccgctctagaactagtggatcccccgggctgcaggaattcgcacgagaccatacctagaacatcctaatcgaaaacttcctctccgacgactccccaccgcaaaccccgaccagacctagggttcggcgccatgcctcagggatattacatatagcttcaccagaagcgccatggccggcgcatggactacgagggagcgcaagcgcacgacggaggcgcgcgcggtcaagaagaactccgaggatgcccgcaagttgcgtcgctgccaagggcaagaggtgtctacaataagcagtatgccgagcaggcgcagactgaagattacctgcatatgcatgacgagtcttcttccgcgcatagggcagatgatgatgttgacgaaggcgcattccntcatatctacatgatcttcatcccaacatcatgccaaggttctcagcagctcatttagcgaaacatgaagccaatgctggcaaatgggatgttcctttgccaagggcaaacttgtgctaagaaacatgttcaatgtctacccactggaacgaaaacccaccccggaaaaaaatgtacccacccccctttttgggccttattttaaagaaccccca

SEQ ID NO: 48419 - protein, 89 aa, Zea mays
  misc_feature: Ceres CLONE 1457503-F
  misc_feature (71)..(71): Xaa is any aa, unknown, or other
MDYEGAQAHDGGARGQEELRGCPQVASLPRARGVYNKQYAEQAQTEDYLHMHDESSSAHRADDDVDEGAFXHIYMIFIPTSCQGSQQLI

SEQ ID NO: 48420 - DNA, 721 bp, Zea mays
  misc_feature: Ceres CLONE 1457527-F
aaagctggagctccccgcggtggcggccgctctagaactagtggatcccccgggctgcaggaattcgcacgagaccattacctagaacatcctaatcgaaaaatcatctctaggctgatgggccgcctccaccgcaccccccaaaaccctagcgctagctgcaccacgacccgccagcatgggaggtgaacgcgactccctggtctctcccggtgtggtgggcggccgcaacgatgcgctcaggggcatcaggacacccacggaagactctgcattcatcgtttcctcttacctcgacaagtccctgctcgcatgacacctcacctaccccatccaggccacggaagactccacttccgaggacggagtccccttccgccgcctcaccggccacggccactttgtccaggacgacttcctcatgtccaacaggctgttcgggctctactgatccggggacggcaagctctgcctctggtacctctccacctgggtcaccacccagatcttcttcgagtacgagaaggacatactctcgcatcccttctcccttgacaacaaatagatcgtttccgcgtaccgcgaccgctccatcaagatgtgcaacagcctcgatgcatgcaaggacaacatctgctagtacctcgtatgaaactactgcccatcgggttggttgtcgtgcgaccgtcttctccgccagttctaaaaccgcaccatcctc

SEQ ID NO: 48421 - DNA, 599 bp, Zea mays
  misc_feature: Ceres CLONE 1457577-F
  misc_feature: Encodes the peptide sequence at SEQ ID NO. 48422
aagctggagctccccgcggtggcggccgctctagaactagtggatcccccgggctgcaggaattcgcacgagaccattacctagaacatcctaatcgaaaaattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgatggtggcggaggcccgggtgtgcatgggcaagagccagcaccactcgttcccctgcatctccgaccgcctctgcagcaacgagtgcgtcaaggaggacggcgggtggacccgccggctactgcccacctccgctactgcaggtgcccagaaaggcgtggctaagcaaaaggttcttccaaaaaaccctttggcttggcaaaaactgacccttgggagtaccaaagaaaacccctttgggtaggttgggcccaaaccctcttttcccccggggagggtttttaaaagggggggggcacgtttaccccgcccccccccctaatttaaaattttttt

SEQ ID NO: 48422 - protein, 110 aa, Zea mays
  misc_feature: Ceres CLONE 1457577-F
MELIKSRATVCALLLALLLLSHYDGGTTTTMVAEARVCMGKSQHHSFPCISDRLCSNECVKEDGGWTRRLLPTSATAGAQKGVAKQKVLPKNPLAWQKLTLGSTKENPFG

SEQ ID NO: 48423 - DNA, 748 bp, Zea mays
  misc_feature: Ceres CLONE 1457580-F
  misc_feature: Translation starting site: 211
  misc_feature (1)..(1): n is a, c, t, g, unknown, or other
  misc_feature (231)..(231): n is a, c, t, g, unknown, or other
  misc_feature (255)..(255): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (493)..(493): n is a, c, t, g, unknown, or other
  misc_feature (495)..(495): n is a, c, t, g, unknown, or other
  misc_feature (501)..(501): n is a, c, t, g, unknown, or other
  misc_feature (502)..(502): n is a, c, t, g, unknown, or other
  misc_feature (506)..(506): n is a, c, t, g, unknown, or other
  misc_feature (516)..(516): n is a, c, t, g, unknown, or other
  misc_feature (522)..(522): n is a, c, t, g, unknown, or other
naaactctggagctccccgcggtggcggccgctctagaactagtggatcccccgggctgcaggaattcgcacgagaccattacctagaacatcctaatcgaaaaaccgtccatccgtattcccgtcacgcccccaacacccccacaacccgaagcagcgaaagctcccctaagcctctccgcgcatccgatcgcaaggaagaagagggagatgagctactacgggcagcanccccccgtcggcgtcccgccgcancaagggtacccgggcaaggacggctaccccccattggtgcacccgggggggaggggtacccccccgcgggttttttttttttcctccaaggggttaccgagcnnnnnttttttttttttccccccacccccgggggaaaagaaaagggggnnnnnttnnnttttttnnnnnnnntttttttttttaaaaaaaaaaaaaaaaaaaaaaaannnnnggggggggggggggcggggggggntntaaatnntaanaaaaaaaatnaatttnttataatgggggatgagtgaagaagatatgttttaagaaagacaggggtgaaggaatacgagagacggtgaaccagcctggcggcgggaggagactagcctgcgcggcccgtctggtagccagctgctcatcaaggagggccgacggtacctagctcgcctcttggtcgggaccagggcgcgccgggacgcggggggaggaggccccccgatcgagcgaccgctcg

SEQ ID NO: 48424 - DNA, 702 bp, Zea mays
  misc_feature: Ceres CLONE 1457584-F
  misc_feature: Encodes the peptide sequence at SEQ ID NO. 48425
aaagctggagctccccgcggtggcggccgctctagaactagtggatcccccgggctgcaggaattcgcacgagaccattacctagaacatcctaatcgaaaaagaccttcaatcaataaccccgtccatctccggatatccacactcctcctccactggtcatggttccacaggcggtcacatgctgttctgtgaactaccagcgcgtgccgacgccgacggaggtgggcacgcgcaccccgtgttcctgtagggaggccgctgctgcccctgcgttctgcacgagcatgatcgtgaccgccgcgctctcacctgcttggttgcagtggccgacggatgggaatgcccactgcaccagggcgacgccggcgacgagatcaagtcatagatgccgccccactttcataaggaccaggacaacaagtgcgaggacgcgctgcacctcacctgctggtattcatgagcatccatccatattgtggaatggagagacgcgagcgtgcccctgattcgaagcaacctctcctctaaacagaagaccagcatatcttcgtccgggtatcaaaatccatccttttgctttcaatttgtgtacgtttgttatcgtcacctccgctgaaatatgttatgatctttttgtgcttcctgatttctatgttgatgctgaaaaaaaggactatgggccttaagttgtttgtcaac

SEQ ID NO: 48425 - protein, 115 aa, Zea mays
  misc_feature: Ceres CLONE 1457584-F
MVPQAVTCCSVNYQRVPTPTEVGTRTPCSCREAAAAPAFCTSMIVTAALSPAWLQWPTDGNAHCTRATPATRSSHRCRPTFIRTRTTSARTRCTSPAGIHEHPSILWNGETRACP

SEQ ID NO: 48426 - DNA, 910 bp, Zea mays
  misc_feature: Ceres CLONE 1457586-F
  misc_feature (33)..(33): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (429)..(429): n is a, c, t, g, unknown, or other
  misc_feature (432)..(432): n is a, c, t, g, unknown, or other
  misc_feature (433)..(433): n is a, c, t, g, unknown, or other
gggtgtcctctgggcgggccgggcgggtttatnttttnnnnttttnnnnntaaaactggagctccccgcggtggcggccgctctagaactagtggatcccccgggctgcaggaattcgcacgagaccattacctagaacatcctaatcgaaaaatcgcgaaggtgctgcctagggtcgttcgttccggaggggcagagagagaaagaaaaggaaaagaagcgcctttgcccgccgcgcgatcaatcagtccggggtccggcggcctgccatggtgaacctggcgactggcagggagaggcggatgtacgggccggctctggcggcaagggcggtgggagtacatcagcgcgggaacttacgtgttcgcggcgctggctcctgggtcggggcgggggaccctgtccctgtctgtgtatgcgggggagggngannccccgacggaagggcccccttccgttgggctgcccctgggcggggggcccaccaaagggcccacctccccccgacgggaacatggcttggcaacccccagtggccgcctgggggacctgtgggcagggtcactaatgccgccgactccgggcgtcccccggggagggtttttttccggggccaggggctcataggactttacattgccggggagggggcgggcctcgcacccaaccaccctgggcctttgccccctggctggggttcctcccccccactaataccacagggtccacgttatcgttggggggtggatggtatgtcccacgtggggtgcttccggcgggggaggcgtctcccttgctggccgcctctgggcggcccaccatgcagtctaattccccctgcccgcgggcgtttaaaagatccccctcaggagcgcgggccccgcgggggcaatctgcgcctgtggcctag

SEQ ID NO: 48427 - DNA, 668 bp, Zea mays
  misc_feature: Ceres CLONE 1457587-F
  misc_feature: Encodes the peptide sequence at SEQ ID NO. 48428
aagctggagctccccgcggtggcggccgctctagaactagtggatcccccgggctgcaggaattcgcacgagaccattacctagaacatcctaatcaaaaaatcacttcgccccatccagaaagacgacggccaatcgaaagcccgaaaaggaggacgaaccgaagaagaggacgcggcaccatggcgacggcacaggcagcgtcggcgtccccacccccacacgcgcgtctcagggacgtcgcccgcgcagcccgcgtaccccagcgccgccaggatcgccgactccgcctgctttccccagtacaccgcctcgctcaggtgtttggaggccaaccaggacagacccattccagcaggcattccaccatttccagggatggccaaaaaaaaaaaaggggagctccggctggaaccgaataaaaccccgttcccccttttgggggaaaaaagggggtccccccctgaaaaaatttgctgggggggggaaaaaagtctcccccccaattggggcgaaaaccccggtttttttctttggggttcaggaaggacccccccccaccttggggcgggggggggagaaaaaaaacccctttttcccaaacgggggggggaattacgcggcctctggggaaaaccccttttttacacaggggtccccggggagat

SEQ ID NO: 48428 - protein, 96 aa, Zea mays
  misc_feature: Ceres CLONE 1457587-F
MAKKKKGELRLEPNKTPFPLLGEKRGSPPEKICWGGEKSLPPNWGENPGFFLWGSGRTPPHLGAGGGEKKPLFPKRGGELRGLWGKPLFYTGVPGE

SEQ ID NO: 48429 - DNA, 706 bp, Zea mays
  misc_feature: Ceres CLONE 1457588-F
  misc_feature: Encodes the peptide sequence at SEQ ID NO. 48430
aaagctggagctccccgcggtggcggccgctctagaactagtggatcccccgggctgcaggaattcgcacgagaccattacctagaacatcctaatcgaaaaaaaccaattccacatctccttcccctccctcccaggctcccaccgaggactctttcccaagacctgctccgagtcctagttcgggagagaggtcgagggaggcagcccataaattccttgcccgcgaaaatttctcctcgcctctctctctacatatctccgcttatctgcccgcggaaatttcttcccgcattggtttggttttccggctcggcaaaggagacggcttttctgtctcccgtgacctacatgatggcgagcacggcgccagcggccgccaccgccgtggcattcggggcagccgccacgccgtggggaccggcgtcggcgtcggcgtctgcggcgctctgcgcgagggtgcctgccgctgccggcggcatgcgtcgctccggggtggccgtgcggtgcgacgccggcgccgacgcccaggtgcgggcggtggccaaggcggccagcgtcgccgcgctcgagcagttcaagatctccgctgaccggtacatgaacgaaaggagtagcatagctgtgataggcctcagtgtgcacacagcaccagtggagatgcgtgaaaaacttgcaattgcagaggaactatggccccgtgctt

SEQ ID NO: 48430 - protein, 117 aa, Zea mays
  misc_feature: Ceres CLONE 1457588-F
  misc_feature: SWISSPROT Homolog: EC 1.2.1.70 Glutamyl-tRNA reductase
MASTAPAAATAVAFGAAATPWGPASASASAALCARVPAAAGGMRRSGVAVRCDAGADAQVRAVAKAASVAALEQFKISADRYMNERSSIAVIGLSVHTAPVEMREKLAIAEELWPRA

SEQ ID NO: 48431 - DNA, 702 bp, Zea mays
  misc_feature: Ceres CLONE 1457589-F
  misc_feature: Encodes the peptide sequence at SEQ ID NO. 48432
  misc_feature (664)..(664): n is a, c, t, g, unknown, or other
aagctggagctccccgcggtggcggccgctctagaactagtggatcccccgggctgcaggaattcgcacgagaccattacctagaacatcctaatcgaaaagaaattggaagtgctttgtattggatgagccttctggacattgttttgagacaaatcgacactacacagttcatgcaatcagctccatggctgggattggtaccaggaaatgatgggcaagtgaagcatgcctactctgataatactccatttaccacactgctcagtgctgccaccagtgcagttgcatcgagtcctgcatgcgcaaatccatcttcatattttgtcatgtcaaagcaggctgaagctgctagcctattgtacaagtcaaatctcaactcagggagcgtgctggagtacgctcttgctttcacaagtgctgccctggatagacattacagcaaatggagtgcaactccaaagacaggtttcattgacataaccacatcgaaggacttctatcgtgtttttagtggtcttcagtatagctacttggaagatagcatgaccaatccttcaaagaaacgagaaatgttgggcgactctgtagcatgggctggttgtactatcatgtacttactggggcagcagctgcatttcgagcttttcgatttctcctaccnaatccctcacgtggcagaaatagaaaccgcaacgtttt

SEQ ID NO: 48432 - protein, 233 aa, Zea mays
  misc_feature: Ceres CLONE 1457589-F
  misc_feature (221)..(221): Xaa is any aa, unknown, or other
AGAPRGGGRSRTSGSPGLQEFARDHYLEHPNRKEIGSALYWMSLLDIVLRQIDTTQFMQSAPWLGLVPGNDGQVKHAYSDNTPFTTLLSAATSAVASSPACANPSSYFVMSKQAEAASLLYKSNLNSGSVLEYALAFTSAALDRHYSKWSATPKTGFIDITTSKDFYRVFSGLQYSYLEDSMTNPSKKREMLGDSVAWAGCTIMYLLGQQLHFELFDFSYXIPHVAEIETATF

SEQ ID NO: 48433 - DNA, 710 bp, Zea mays
  misc_feature: Ceres CLONE 1457593-F
  misc_feature (225)..(225): n is a, c, t, g, unknown, or other
  misc_feature (228)..(228): n is a, c, t, g, unknown, or other
  misc_feature (229)..(229): n is a, c, t, g, unknown, or other
  misc_feature (241)..(241): n is a, c, t, g, unknown, or other
  misc_feature (242)..(242): n is a, c, t, g, unknown, or other
  misc_feature (245)..(245): n is a, c, t, g, unknown, or other
  misc_feature (248)..(248): n is a, c, t, g, unknown, or other
  misc_feature (257)..(257): n is a, c, t, g, unknown, or other
  misc_feature (274)..(274): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (389)..(389): n is a, c, t, g, unknown, or other
  misc_feature (397)..(397): n is a, c, t, g, unknown, or other
  misc_feature (401)..(401): n is a, c, t, g, unknown, or other
  misc_feature (402)..(402): n is a, c, t, g, unknown, or other
  misc_feature (406)..(406): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (485)..(485): n is a, c, t, g, unknown, or other
  misc_feature (494)..(494): n is a, c, t, g, unknown, or other
  misc_feature (495)..(495): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (505)..(505): n is a, c, t, g, unknown, or other
  misc_feature (506)..(506): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (558)..(558): n is a, c, t, g, unknown, or other
  misc_feature (561)..(561): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (594)..(594): n is a, c, t, g, unknown, or other
  misc_feature (595)..(595): n is a, c, t, g, unknown, or other
  misc_feature (602)..(602): n is a, c, t, g, unknown, or other
  misc_feature (603)..(603): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (662)..(662): n is a, c, t, g, unknown, or other
  misc_feature (664)..(664): n is a, c, t, g, unknown, or other
  misc_feature (686)..(686): n is a, c, t, g, unknown, or other
  misc_feature (689)..(689): n is a, c, t, g, unknown, or other
aaagctggagctccccgcggtggcggccgctctagaactagtggatcccccgggctgcaggaattcgcacgagaccattacctagaacatcctaatcgaaaaatctccgcagtgcaaagcgtcaacgcaaaccgaccaagatccagaagcaagaaagtgtctatagcctagccggtgcgcgcgcgagaggaatagccgattatcatcaagctctgagctagcagncgnnaaggaatgaagnncgncgntcggtccgntccccattgaccccaangaaagggcgtcgtcgttcgtggtggcggcaagcatgaagcgcgtggaaggcgctcaagggacccagcggggctgtggccgttggactaccccnnntcccccctccccccctcttntaaaaaancccnncccncgcccgcgcnnncggggggggggnnnnnnncgcgnnncgnnngcggnnnnnnnntggcgcgggggggcggggnnnncgncgcgcgggnngggnnnnggnngcgcgcnnnccccccgccgccccccccacacaaaaaaaaaaaaaggaatatnttntnnnnnngggcgcccggggccccccccccgganncccgctnntttggggggtttnnnnnnnnnnaaacccgccaaacaaaaaaaaacccannnnggggggngnggggggggggaagggggagggntgnagcggggcccccccgcccgcc

SEQ ID NO: 48434 - DNA, 686 bp, Zea mays
  misc_feature: Ceres CLONE 1457595-F
  misc_feature: Encodes the peptide sequence at SEQ ID NO. 48435
aagctggagctccccgcggtggcggccgctctagaactagtggatcccccgggctgcaggaattcgcacgagaccattacctagaacatcctaatcgaaaaaacttaacttcaaacatctactctctagagtaagtgtgtgagtgactgcgatgggaggagacgggggtgatgagccaataattcactttgtactcgttcatggagcctgccacggtgcttggtgttggtatagactcaccactcttcttctgtccgccggattcaaagccaccaccgtcgacctcaccagtgccggcatcaacctcaccgacgctaacaccgtcttcgagttcgaccattataaccgtcctctcttctctctcctctccgatatccctcatcaccacaagatcatactcgtgggacatagcatcggcggagcaagtgtcaccgcagctctctgcaagttctcagacaaaatctccatggccgtttacctcgttgctgacatggttcaacccggaaccacatctcctcctcattcaataatgtctgtgggagaagaggaagacatatgggagtttacatatggtgaaggcgatgataaaccacctactagtgcgcaaatgaaagaagaatatagacggcattatttctatagccaaagtcctcttgaggatgtaattttggcgtctaagctgttgc

SEQ ID NO: 48435 - protein, 178 aa, Zea mays
  misc_feature: Ceres CLONE 1457595-F
  misc_feature: SWISSPROT Homolog: EC 3.1.1.78 Polyneuridine-aldehyde esterase
MGGDGGDEPIIHFVLVHGACHGAWCWYRLTTLLLSAGFKATTVDLTSAGINLTDANTVFEFDHYNRPLFSLLSDIPHHHKIILVGHSIGGASVTAALCKFSDKISMAVYLVADMVQPGTTSPPHSIMSVGEEEDIWEFTYGEGDDKPPTSAQMKEEYRRHYFYSQSPLEDVILASKLL

SEQ ID NO: 48436 - DNA, 653 bp, Zea mays
  misc_feature: Ceres CLONE 1457596-F
  misc_feature: Encodes the peptide sequence at SEQ ID NO. 48437
  misc_feature (223)..(223): n is a, c, t, g, unknown, or other
  misc_feature (231)..(231): n is a, c, t, g, unknown, or other
  misc_feature (233)..(233): n is a, c, t, g, unknown, or other
  misc_feature (234)..(234): n is a, c, t, g, unknown, or other
  misc_feature (346)..(346): n is a, c, t, g, unknown, or other
  misc_feature (356)..(356): n is a, c, t, g, unknown, or other
  misc_feature (373)..(373): n is a, c, t, g, unknown, or other
  misc_feature (374)..(374): n is a, c, t, g, unknown, or other
  misc_feature (388)..(388): n is a, c, t, g, unknown, or other
  misc_feature (389)..(389): n is a, c, t, g, unknown, or other
  misc_feature (514)..(514): n is a, c, t, g, unknown, or other
aaagctggagctccccgcggtggcggccgctctagaactagtggatcccccgggctgcaggaattcgcacgagaccattacctagaacatcctaatcgaaaaaggatccattaacacccctacgtacgcctttcctctggaaacccttctctcgcctgcctctcccccgccgcgccgccacttcccctctcccgtcaactccggcttccgcgcgaggtcgagncttagcgntnnttggagttctcgagacctgctgtgatggcgacagagcaagcggcggagaactacacggtggaggacctcgtggccctgaacccctacaaccccgacatcctcaacgacctcngagaagtttncgtcaatgagcagggtnnctcatctcagaacnnatataacttggatgcaaatctcagccttcttcgcttgtacccagttgagccagaaaggatgaaagcatacagatttgtggcccccacattactgaaattaagggctctgcatgggcaatgccagncccctgaacttcagtttggtgctttatcctttaatcccctgaacctgtgcaaaatgggagaaccaatttcagggtattgataagttcttttccccactaccctagaaaactgcctaggtttcaagtcaaatttttggga

SEQ ID NO: 48437 - protein, 111 aa, Zea mays
  misc_feature: Ceres CLONE 1457596-F
  misc_feature (30)..(30): Xaa is any aa, unknown, or other
  misc_feature (33)..(33): Xaa is any aa, unknown, or other
  misc_feature (39)..(39): Xaa is any aa, unknown, or other
  misc_feature (44)..(44): Xaa is any aa, unknown, or other
  misc_feature (86)..(86): Xaa is any aa, unknown, or other
MATEQAAENYTVEDLVALNPYNPDILNDLXEVXVNEQGXSSQNXYNLDANLSLLRLYPVEPERMKAYRFVAPTLLKLRALHGQCQXPELQFGALSFNPLNLCKMGEPISGY

SEQ ID NO: 48438 - DNA, 733 bp, Zea mays
  misc_feature: Ceres CLONE 1457599-F
  misc_feature: Encodes the peptide sequence at SEQ ID NO. 48439
  misc_feature (309)..(309): n is a, c, t, g, unknown, or other
  misc_feature (345)..(345): n is a, c, t, g, unknown, or other
  misc_feature (372)..(372): n is a, c, t, g, unknown, or other
  misc_feature (375)..(375): n is a, c, t, g, unknown, or other
  misc_feature (378)..(378): n is a, c, t, g, unknown, or other
  misc_feature (481)..(481): n is a, c, t, g, unknown, or other
  misc_feature (574)..(574): n is a, c, t, g, unknown, or other
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccanggggcacgccgagggcgggttcgaagcggcccgccngagctgagaacgggcggttgcagtgcngcngcnactgccagtgcgaccccctgcaactgcggcaaagtgagctaggtgctccaccctgcaggccggccgggaggaactacctaattttaaagcttaataaagtttncggcctcccctggtgtgggtttaaggcaaacaatcaatttgggggcccgggatggccccaaatcaaaataaaaaaaaagggtttaaagggggnttttggccccccccggcgccccggggggccttttggaaaaaatgtttttttttttttgtggcccccacccctaaaggggaaaccagggccccccttgtgtttgttcccccccccctttatttttttttccccccccccctttttgtaaaaaaaaaaaaa

SEQ ID NO: 48439 - protein, 62 aa, Zea mays
  misc_feature: Ceres CLONE 1457599-F
  misc_feature (1)..(60): Pfam Name: Metallothio_2 Pfam Description: Metallothionein
  misc_feature (49)..(49): Xaa is any aa, unknown, or other
  misc_feature (61)..(61): Xaa is any aa, unknown, or other
MSCCGGNCGCGSGCKCGNGCGGCSKMYPDMAEQVTTTTQALIMGVAPSXGHAEGGFEAARXS

SEQ ID NO: 48440 - DNA, 853 bp, Zea mays
  misc_feature: Ceres CLONE 1457605-F
  misc_feature: Encodes the peptide sequence at SEQ ID NO. 48441
  misc_feature (13)..(13): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (509)..(509): n is a, c, t, g, unknown, or other
ttttccccccccntcttggggcggtgcaaagcgcctcagtaacannnccaagatggagctccccgcggaggcggccgctctgtcctagtggatcccccgggctgcaggaattcgcacgagaccattacctagaacatcctaatcggaaaaatcccggacgccacgcgatccgacacatacaaactcacggacgcgcgcgcgggcgcctcccgctgtcccgctagacaaaggaaacaaacgagaggaggccatggcgccgagaacgtcagagaaaaccatggcaccggaggcggccgctgccacgggggtcgcgctcagcggcggcggcggcggtggggccggcggaccgcactacataggcgtgaggaagcgggcgtggggtcggttcgcggcgcagatccgcgacccggcgaagaagaggcgggtgaaaaatcgggagctaccacacgagccgaggatcccccccctgggggggtggggagtgtcgccgtgcggccacaacccccacnccaccaaggccacaaaccaaaatgccccttaacaccgacgtgacttgcccccttctctggcagcgctggttgcgcggagagaaggatagtggctggcactcatttaaggttctttgcagtggcatatcgcgtcagggagtctcgatggcagagggctatgtcttgttcccctcgcagctcgtcctgagagcagggagacttgcgtcagacagacccagtgttgtgtcctataggtccaactcggtcaatgtggtctgtcttgctctagtcaggtacagaggaactccctctttgcgaggccgcccttaggcgctgtttcgcggccacccggcccttccatagcg

SEQ ID NO: 48441 - protein, 96 aa, Zea mays
  misc_feature: Ceres CLONE 1457605-F
  misc_feature (87)..(87): Xaa is any aa, unknown, or other
MAPRTSEKTMAPEAAAATGVALSGGGGGGAGGPHYIGVRKRAWGRFAAQIRDPAKKRRVKNRELPHEPRIPPLGGWGVSPCGHNPHXTKATNQNAP

SEQ ID NO: 48442 - DNA, 712 bp, Zea mays
  misc_feature: Ceres CLONE 1457606-F
  misc_feature: Encodes the peptide sequence at SEQ ID NO. 48443
  misc_feature (712)..(712): n is a, c, t, g, unknown, or other
gctctagaactagtggatcccccgggctgcaggaattcgcacgagaccattacctagaacatcctaatcgaaaaaggagtgaaggaccgaggagggaaacagagaagatggcgacgaagcgcgacaccgagtcggacggcgaaggctccaaccccgtcggtggtggcgcgactccgccgcccctagccgccgcccctgtcgtatgcctcctccgctccgccggggacttcggtggcggcgccttcgttggatccatcttcggatatggacaaggcttgatcaccaagaagggttttaagggttcattcagcaatgcagggtcctctgccaagacttttgcaattctctctggcgttcaaagtttggtttttgtgcttgttgcgaaggctacgtggcaaggatgacattgtcaatgctggtatagctggttgttgtactggccttcgctttgggctttccaggggcgccacaggcatttgctccaaagttgtgcccccttccccgcattctcatgcatcatggaagggcctcaataaccagcaggctgcaatggctcccaccccttgaagggacttgccgcgatgggccgtgcttgaaaaatgtggggttcttgccccccgttcccgccttcccccctattcctggatgcatccggatggctttagtcttcctggcggctttagcgtttagttaaaagcctaaaccaccttan

SEQ ID NO: 48443 - protein, 98 aa, Zea mays
  misc_feature: Ceres CLONE 1457606-F
MATKRDTESDGEGSNPVGGGATPPPLAAAPVVCLLRSAGDFGGGAFVGSIFGYGQGLITKKGFKGSFSNAGSSAKTFAILSGVQSLVFVLVAKATWQG

SEQ ID NO: 48444 - DNA, 482 bp, Zea mays
  misc_feature: Ceres CLONE 1457609-F
  misc_feature: Encodes the peptide sequence at SEQ ID NO. 48445
  misc_feature (296)..(296): n is a, c, t, g, unknown, or other
tccccgcggtggcggccgctctagaatagtggatcccccgggctgcaggaattcgcacgagaccattacctagaacatcctaatcgaaaactcttcgtctccttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagatgccggcggtcacccctgcagcgtgcggatgccgacgggncacgatgggtggtgcggccgccctgagtcgcgggcgggcgatctcggcggcctcgagatggccaactgcccggggggggtcggggggctttttccggggagcccgcgttacgggggcttggaaacccaccggggggaattttgaccccttaaaaaatttccccttgggaaaaaggggttccaagta

SEQ ID NO: 48445 - protein, 51 aa, Zea mays
  misc_feature: Ceres CLONE 1457609-F
MPTGHDGWCGRPESRAGDLGGLEMANCPGGVGGLFPGSPRYGGLETHRGEF

SEQ ID NO: 48446 - DNA, 744 bp, Zea mays
  misc_feature: Ceres CLONE 1457617-F
  misc_feature: Encodes the peptide sequence at SEQ ID NO. 48447
  misc_feature (615)..(615): n is a, c, t, g, unknown, or other
  misc_feature (711)..(711): n is a, c, t, g, unknown, or other
  misc_feature (725)..(725): n is a, c, t, g, unknown, or other
ggcggccgctctagaactagtgatcccccgggctgcaggaattcgcacgagaccattacctagaacatcctaatcgaaaagccacctgctgcagcttctcaaccggataggtagcaccggagcaggtacaacgctgcacaatccccttcgccgccgccaagatggtgaacgttcctaagaccaagaagacgtactgcaagaacaaagagtgcaagaagcacacactccacaaggtgactcagtataagaagggaaaggatagcctgtctgctcagggaaagcgccgttatgaccgcaagcagtcaggatatggtggtcagaccaagcctgtcttccacaagaaggttttcaccccccccaagattgggggggaggtgccatgcccaaaattcaaaccccccctcccagccacgccatccaaaagatagaaggcattttggagatggggtggggacaagaaaggggcaagggcaaatcttctttttctaaagctttttccgccccaccggccttaggtgtttgagttcaaagcgtggggggcctaacaactcgctggctcttataaaacatccccgcccaaatttctcctggtgagataggggacatgtgaaaagngaaaccggtgcctagcgagcccaaaaaccccccagactcctactctctgttcccaaaaaggggtgcgccacactaattgcgaaatagacgaaaacntgttcctcacccgncacatgatatcaacaaaaa

SEQ ID NO: 48447 - protein, 88 aa, Zea mays
  misc_feature: Ceres CLONE 1457617-F
  misc_feature (19)..(88): Pfam Name: Ribosomal_L44 Pfam Description: Ribosomal protein L44
MVNVPKTKKTYCKNKECKKHTLHKVTQYKKGKDSLSAQGKRRYDRKQSGYGGQTKPVFHKKVFTPPKIGGEVPCPKFKPPLPATPSKR

SEQ ID NO: 48448 - DNA, 720 bp, Zea mays
  misc_feature: Ceres CLONE 1457619-F
  misc_feature: Encodes the peptide sequence at SEQ ID NO. 48449
  misc_feature (24)..(24): n is a, c, t, g, unknown, or other
  misc_feature (368)..(368): n is a, c, t, g, unknown, or other
  misc_feature (370)..(370): n is a, c, t, g, unknown, or other
tggagctccccgcggtggcggccngctctagaactagtggatcccccgggctgcaggaattcgcacgagaccattacctagaacatcctaatcgaaaagatgagatttatcttgggatcggctagagaagatcgagtgagaagttgcgcgtgtgaagccatcacaccaattaaagatcgagatcatccatggctagttctctacttcagcagctgctgtctctgctgctgctcctgctgccctctcctcttcgtctccgggagcatctatcaggaaaccatgctgtcagcgccaacaacttccacccatctttctggtagctggggtgagctgcaacgacctggaggcaccctccaccgagagtaccngncgtcggtgcccacttgggcccatgaagggaaaggggtgttcggccttggaaaaaaaatttggaaactgctgtccgggacaacgggaagggttcaggaacaaaaaaacctcttttaaaaccctgcataaaaagaaaacagaaaccccccgggggtaaaaaccggggggcccaattttggtccccaaaaaaccttcccccaaaaaaacccccccaaaaaaaaggggggccccaaaaaaaaaaaacccccctctgggaaaattgggtttcccagaagagaaacccctttttggggcccccccataattattctttttcgccccccccccccgcgccgaaaaaaaataaagttt

SEQ ID NO: 48449 - protein, 40 aa, Zea mays
  misc_feature: Ceres CLONE 1457619-F
  misc_feature (8)..(8): Xaa is any aa, unknown, or other
ELPAVAAXSRTSGSPGLQEFARDHYLEHPNRKDEIYLGIG

SEQ ID NO: 48450 - DNA, 720 bp, Zea mays
  misc_feature: Ceres CLONE 1457620-F
  misc_feature: Encodes the peptide sequence at SEQ ID NO. 48451
  misc_feature (650)..(650): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaaacacaaagaagctccataattaattattgccctttcaattcgccatcggcagccgagcaccatgagctccacaggcggcggcgacgatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcgtcgacaccgtcgcggaggcaccccacatcggctgaggtttaaatctacaaaatgaatgactcggacatgccatgcgtacctgtccgtcgccgaataatggatgtgtgtgtgcttcgttccaataaattgctagtaaaaataatggcatcgtcggtatgcatgaataaaatgtatcagaatgttcatcctttcacgattggatatatgaaaattggatatatgaaaatgtgctcagttgtttggtttcaaaaaaaaaaaaaaaagcttatcgataccgtcgacctcgagggggggccgggtacccantncgccctatagtgagtcgtattacgcgcgctcactgggccgtcgttttacacgtcgtgactgggaaaac

SEQ ID NO: 48451 - protein, 71 aa, Zea mays; identical to SEQ ID NO: 46326
  misc_feature: Ceres CLONE 1457620-F
  misc_feature (12)..(71): Pfam Name: potato_inhibit Pfam Description: Potato inhibitor I family

SEQ ID NO: 48452 - DNA, 705 bp, Zea mays
  misc_feature: Ceres CLONE 1457638-F
  misc_feature: Encodes the peptide sequence at SEQ ID NO. 48453
  misc_feature (535)..(535): n is a, c, t, g, unknown, or other
ggagctccccgcggtggcggccgctctagaactagtggatcccccgggctgcaggaattcgcacgagaccattacctagaacatcctaatcgaaaaatcaccaccatctcacttcatataccactccctaggaggacccagcaacacacacagccgagctttgcttaggcaagatgaacaggaagccaggagactgggactgcagggcgtgccagcacctcaacttcagccgccgagacatatgccagcgctgcagcgagccacgtggagttgctgatcgtggcggcggaggaggaggaggcgactacgccagcttcggtggccgcggtggctcctccttcggcggcggctttggcgctgctggctctgacgtccggcctggtgactggtactgctcctgcggcgcgcacaacttcgccagccgctccagctgctttcagtgctccgcctacaggaggaggccgctgtgaacagtggcgctggcggctttgacggcgacatgtcacgctcacggggctacggcttccgcaagcgngctgctggtgctggtgctggcgctgcccgtactacaaccgccccggttggaaatcggaaactggacctgcccccaatccggaggaacgagccaaacttccccaacagatgaatgcttcaggggcaccccccccgggaccttgggaccctccatgacctaaaaaaacattt

SEQ ID NO: 48453 - protein, 98 aa, Zea mays
  misc_feature: Ceres CLONE 1457638-F
  misc_feature (68)..(96): Pfam Name: zf-RanBP Pfam Description: Zn-finger in Ran binding protein and others
MNRKPGDWDCRACQHLNFSRRDICQRCSEPRGVADRGGGGGGGDYASFGGRGGSSFGGGFGAAGSDVRPGDWYCSCGAHNFASRSSCFQCSAYRRRPL

SEQ ID NO: 48454 - DNA, 728 bp, Zea mays
  misc_feature: Ceres CLONE 1457641-F
  misc_feature: Encodes the peptide sequence at SEQ ID NO. 48455
  misc_feature (459)..(459): n is a, c, t, g, unknown, or other
ggagctccccgcggtggcggccgctctagaactagtggatcccccgggctgcaggaattcgcacgagaccattacctagaacatcctaatcgaaaatcgctcccgtcgcttgacctgtactgtccccacggagatcacgacacgaaccgagcaagaaccgcacgagccgagcccagcagcaggatggcggcggcggcgagcgggaaggcgccgtcgctggtggtggcggcgagcatgggcgcggtggaggcgctcaaggaccaggcgggcctgtgccgctgggactacgcgctgcgctcgctctaccaccgcgccgccgccgcgccccggatccgcgcgctgtccgccgcgctctcggactccgtgtccgtgccggcgggacgcgccccgcgggcgtcgcggccaccgccccccgcggcgccgcgggacgcggacagatgcccaagccctacccactcntgtgctggggccccaactgatcggcgggcggccgccaactgcatgcccggaacttgaaccttacccgccctaaccaaggctggctgggggggggttgcccttaacttcctcctcctggtgttgcccccctccgggggtgggggggggggggttgggctcccccccccccccgattcccccccgggcccccccgcccttgatttgagtgaaaatggaaatgaaaaggctttggaactccccccccccttttgggtccccaacccaaaaac

SEQ ID NO: 48455 - protein, 110 aa, Zea mays
  misc_feature: Ceres CLONE 1457641-F
MAAAASGKAPSLVVAASMGAVEALKDQAGLCRWDYALRSLYHRAAAAPRIRALSAALSDSVSVPAGRAPRASRPPPPAAPRDADRCPSPTHSCAGAPTDRRAAANCMPGT

SEQ ID NO: 48456 - DNA, 717 bp, Zea mays
  misc_feature: Ceres CLONE 1457647-F
  misc_feature: Encodes the peptide sequence at SEQ ID NO. 48457
  misc_feature (405)..(405): n is a, c, t, g, unknown, or other
ggagctccccgcggtggcggccgctctagaactagtggatcccccgggctgcaggaattcgcacgagaccattacctagaacatcctaatcgaaaaacaggctttctccaactctccgccctcgccatggccatgaccgtggcagccgcctggcttccgtcgaccgcctctcgccggagaatcttatcctctccgctccctccgttcgcggcccctatctccatccacatgccacggcgggcgccgcctcccagtcccatccatcgaaagccgcgcctcttcgtcgcctccgcgcagctcgatttctccagagctattcaaacagcatggagggtcggtaacgatgctgtggaggcaggaagtaatcttgtcccaggttcagttccacgaccaattgccaggatnagtgttgcctttgcggctgtgtcagtcgcctttttcccttgtcaaatccattgtgtccactgcattattttgttctggcaatgaatgggcctcctatacctcagctccctgggctttgaaccccaaaggaggcatcccggtcttagccgggataaaccatgggccacccatccgaaggatcccgtttaaaaagccccccaggaaatggggaaaaaaccgttttttacccggggaaaggggcgcttccccccaaagaattaattttctttaaaacccccttttcaacccaaggggtttatattgggtgaatct

SEQ ID NO: 48457 - protein, 120 aa, Zea mays
  misc_feature: Ceres CLONE 1457647-F
  misc_feature (93)..(93): Xaa is any aa, unknown, or other
MAMTVAAAWLPSTASRRRILSSPLPPFAAPISIHMPRRAPPPSPIHRKPRLFVASAQLDFSRAIQTAWRVGNDAVEAGSNLVPGSVPRPIARXSVAFAAVSVAFFPCQIHCVHCIILFWQ

SEQ ID NO: 48458 - DNA, 704 bp, Zea mays
  misc_feature: Ceres CLONE 1457652-F
  misc_feature: Encodes the peptide sequence at SEQ ID NO. 48459
  misc_feature (607)..(607): n is a, c, t, g, unknown, or other
ctccccgcggtggcggccgctctagaactagtggatcccccgggctgcaggaattcgcacgagaccattacctagaacatcctaatcgaaaaacttccacttcgctctgtcctcccatgcgccggattaccactgaccacttcacagtcacagtagtacagagcggcagagtggagaagtagactctaggtgagatggcggccgtggtggcggcggtggaggcaggggtggtggcggtggcaagcgggaggggatgcagcagccggctggtgcggggcctctactggcgccttcgcgcggttctgcggcggctgcggtcggagcgggccaggcgcggccggaggttcagcttccactacgacgcgctcagctacgcgctcaacttcgacgacggccgcgccgcccccgcccccgccccggcccccgccgcggccgacctcgtccttgcccccggcgacaacgacgcgctacggtgaatcggcgtccgacgatccgctgccaagagccagctggggtctcttccttgctccggacgccgcttgcttttttccactctcctgtggtctcgctttttcgataaataggggttgtgtaatggaaaaaaggnaagatggtagggtggtgtcgcctccgcgttctgcgattctttgcattgacgcgcagctagctagctagctagggggattgcgcgggctcccggtgat

SEQ ID NO: 48459 - protein, 93 aa, Zea mays
  misc_feature: Ceres CLONE 1457652-F
MAAVVAAVEAGVVAVASGRGCSSRLVRGLYWRLRAVLRRLRSERARRGRRFSFHYDALSYALNFDDGRAAPAPAPAPAAADLVLAPGDNDALR

SEQ ID NO: 48460 - DNA, 795 bp, Zea mays
  misc_feature: Ceres CLONE 1457804-F
  misc_feature: Encodes the peptide sequence at SEQ ID NO. 48461
  misc_feature (478)..(478): n is a, c, t, g, unknown, or other
ctggagctccccgcggtggcggccgctctagaactagtggatcccccgggctgcaggaattcgtctcacccctaatcgaaaaaccgttgtagcaagttctcccatctagcaacaccataatcgcaggagaatcgctgctccaccagactcggtttcctcttgcttcagcgtcaaaatcatggccgcagctggcaagtcgtcgtcggccatggaggagacggttgcggcgacggccgccgcgcgggggcggcgcgggattgaccggcaggccgtcgacaggggcatcgcctacctgctcatggtggccgccctcgtcgccacctacgcgcttcactagatttcggtctgctccggcgcgggcagacctcacgggaaaaggaggcttttgtgcgcttctgcttcccgcccgccccaacctcttcagagttcccctgcaccaaacttcattcgttcgtcttccaaccttgtattgtatggnagatttggagatggaaatgcatgtgtctgggtgctacatctccataacctggacaagtttggttccttaaactcctttccgggggaataaatcgggaaagaaaaaccatttgttggccaaacaaaccaggtgttccctggtgttccggcaaaaaaaaaaaaaaaaaaagacgccccgaagggccccaatttcccccttaaggggagctgttataaccccccgcctcctgggccgcgcgtttttaccaccccggagcgtggaaaaaccgggggtttacccccaatataaaccccttggagaacaaacccccctttcgc

SEQ ID NO: 48461 - protein, 52 aa, Zea mays
  misc_feature: Ceres CLONE 1457804-F
MAAAGKSSSAMEETVAATAAARGRRGIDRQAVDRGIAYLLMVAALVATYALH

SEQ ID NO: 48462 - DNA, 770 bp, Zea mays
  misc_feature: Ceres CLONE 1457805-F
  misc_feature: Encodes the peptide sequence at SEQ ID NO. 48463
  misc_feature (26)..(26): n is a, c, t, g, unknown, or other
  misc_feature (30)..(30): n is a, c, t, g, unknown, or other
  misc_feature (33)..(33): n is a, c, t, g, unknown, or other
  misc_feature (52)..(52): n is a, c, t, g, unknown, or other
  misc_feature (57)..(57): n is a, c, t, g, unknown, or other
aaaactggagcttccgttcgggaggnttcncanttccctagttgcctcgggnttcangaggtaactaaaagagaattgaaaaattaatcgtcctgatgcagctccaagagagcttttcaaatcacctggttctgtccgaactgctgcctggcttcatagtgaccaaactatattgagttcctgcactgacatgggtggagtaaggctatgggatgtgagaacaggtaaaattgtccaaactcttgaaaccaaggcttctattactagtgcagaagtaagccaggatggcaggttcatcactacagcagatggctcaagtgtaaaattttgggacgcgaatcacttcggccttgtgaaaagctatgatatgtcgtgcaatgtggagtcagcttcacttgaacccaagtctgggagcaaatttgtagctggaggagaagatttgtgggttcatgtattcgatttcttcactgtggaagaaatagcttgtaacaaagggcatcatggaccggtccactgtgtccggtttgcacctggtggtgaatcatacgcatcgggttcagaagatggcaccattaggatctggcagcttagcccagttaatgctgatgacgacaaggccgccaatgcaaatgggaaggcaaatgctggcatgaacgaggttacaaccaaagctcgagggcggcttccacatttcccaaggagggacaggcttggggggtaagaacctccaggtgctttgcttgggggtgcttggtgcgttctttatttcg

SEQ ID NO: 48463 - protein, 176 aa, Zea mays
  misc_feature: Ceres CLONE 1457805-F
  misc_feature (94)..(132): Pfam Name: WD40 Pfam Description: WD domain, G-beta repeat
  misc_feature: SWISSPROT Homolog: EC 2.7.11.7 [Myosin heavy-chain] kinase
MGGVRLWDVRTGKIVQTLETKASITSAEVSQDGRFITTADGSSVKFWDANHFGLVKSYDMSCNVESASLEPKSGSKFVAGGEDLWVHVFDFFTVEEIACNKGHHGPVHCVRFAPGGESYASGSEDGTIRIWQLSPVNADDDKAANANGKANAGMNEVTTKARGRLPHFPRRDRLGG

SEQ ID NO: 48464 - DNA, 755 bp, Zea mays
  misc_feature: Ceres CLONE 1457810-F
  misc_feature: Encodes the peptide sequence at SEQ ID NO. 48465
  misc_feature (351)..(351): n is a, c, t, g, unknown, or other
tggagctccccgcggtggcggccgctctagaactagtggatcccccgggctgcaggaattcgtctcacccctaatcgaaaatcgagggaacatttgaccagatcaagcacgctagcgcaatggtcacagagttgattgtccgcatcagtggtaagccgcctccacaagccaagaacaacccaggtagggggcctggttctcatgccgggggtcctggaagcaacttcaaaaccaaattgtgcgagaacttcaacaaaggctcctgcacctttggagacaggtgccacttcgcccatggcgaaggtgagctgcgcaaacctgctgctgcttgacaggcatgcttattgtggncctgtgtgattaatctgcctgtatggctgaatacaccatgaccaagacagtggcgccagcgcatggtgagtgtgctgagccaatgcctgctgaagaaagcatttcccggggccggatttgatcttaggcggaacaaatcccccaaagggattaaacatggcccgttttttaggatttaaaattgccaattggcccccttttacttcctgttttggcccggggggaaaaaccgccggggggggaaaaacccggccacaaaaaggggcccccccctgggaaaagggtgaccccccctctcccaaaaaaaaatcccgggggggcttttttttttggggaaaaacctccccagagaaaaaaaaggcccttttttatttggaagggggggggcgcccctttttttttgt

SEQ ID NO: 48465 - protein, 70 aa, Zea mays
  misc_feature: Ceres CLONE 1457810-F
  misc_feature (36)..(61): Pfam Name: zf-CCCH Pfam Description: Zinc finger C-x8-C-x5-C-x3-H type (and similar)
MVTELIVRISGKPPPQAKNNPGRGPGSHAGGPGSNFKTKLCENFNKGSCTFGDRCHFAHGEGELRKPAAA

SEQ ID NO: 48466 - DNA, 809 bp, Zea mays
  misc_feature: Ceres CLONE 1457813-F
  misc_feature: Pfam Name: DUF1692 Pfam Description: Protein of unknown function (DUF1692)
aagctggagctccccgcggtggcggccgctctagaactagtggatcccccgggctgcaggaattcgtctcacccctaatcgaaaattaacaaggggaaggttgtaccatccatggatttgtaaatgtgaataaagtagctggcaactttcactttgcccccgggaaaagcttggaccagtcattcaacttcctgcaagacctgttgaacctccaaccagaaacttacaatataagccacaagataaataagctgtcctttggggaagagttcccaggtgtagtcaatcctcttgatggagttgagtggatacaggataactccaatggattaacggggatgtaccagtattttgtaaaggttggtcccaacatctacacagatatcagggggcgcaagaatcactcaaatcagttttctgtgacagagcacttcagaagaggcatttggctatcctagggcttccaccggtggtaaattcctcctacgaattttcaccaatccagggtggattttactggaggaaaaaacgtgcctcccttcccttcggaaagaaaaattgggcttttgttgaagggtttttcccgggggccgggggccaaaaaatcttttcggggacccggggccccgcgccccccaaaaaaaaaaagggccccggaaaattggggaaacccacattttttccgcctatatcgctttgggaccccccgggaaaaacgtgttattttttggtttccgcgcccccccaaaaaggagagaaaatttttcccgtgggggagcccctcggtaccaaaaaaaagcccgcccgcg

SEQ ID NO: 48467 - DNA, 772 bp, Zea mays
  misc_feature: Ceres CLONE 1457814-F
  misc_feature: Encodes the peptide sequence at SEQ ID NO. 48468
  misc_feature (699)..(699): n is a, c, t, g, unknown, or other
  misc_feature (728)..(728): n is a, c, t, g, unknown, or other
  misc_feature (729)..(729): n is a, c, t, g, unknown, or other
  misc_feature (748)..(748): n is a, c, t, g, unknown, or other
  misc_feature (749)..(749): n is a, c, t, g, unknown, or other
aagctggagctccccgcggtggcggccgttctagaactagtggatcccccgggctgcaggaattcgtctcacccctaatcgaaaagtttctaactccggtggctccaccactagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatattacgccttcaatgtgctcgggaaagggtgtgttttcacctatgatgcagtaggttcctatgagagaactggttatagtgctcagggaacgggatctactttgattatgccagtcctggacaaatcactaaaatcaccaagtcctctattgctccctgccagggatgctgtcacaccattgtcggagtcagaggccatcgatctagttaaggatgtgtttgcatctgncactgagagagacatctacactggagacnnagtggaaattgtagtcatnncacaagtcgggactaagcgcgag

SEQ ID NO: 48468 - protein, 208 aa, Zea mays
  misc_feature: Ceres CLONE 1457814-F
  misc_feature (10)..(200): Pfam Name: Proteasome Pfam Description: Proteasome A-type and B-type
  misc_feature: SWISSPROT Homolog: EC 3.4.25.1 Proteasome endopeptidase complex
  misc_feature (184)..(184): Xaa is any aa, unknown, or other
  misc_feature (194)..(194): Xaa is any aa, unknown, or other
  misc_feature (200)..(200): Xaa is any aa, unknown, or other
  misc_feature (201)..(201): Xaa is any aa, unknown, or other
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGKGCVFTYDAVGSYERTGYSAQGTGSTLIMPVLDKSLKSPSPLLLPARDAVTPLSESEAIDLVKDVFASXTERDIYTGDXVEIVVXXQVGTKRE

SEQ ID NO: 48469 - DNA, 759 bp, Zea mays
  misc_feature: Ceres CLONE 1457815-F
aagctggagctccccgcggtggcggccgctctagaactagtggatcccccgggctgcaggaattcgtctcacccctaatcgaaaatttgccctgcagaaattccccctgggcgctggaggcgccaagctcgcgccggtgagcacctcccatggcgtggccatctccctgctgttgccagggccgacgagtccaagtcttgtctctagccttccttgccgactatggctgcccagcagctcgtcacctccctctctagtgcatgccccggctgtcatttccccacgccgagcgtgccctctcgccatcctttgccttgctgctcgcagctgagtttcctactcgtcgcagctcgcgcaccacctgttcgacgttatgcacagtagctgcatgtctcagattatcgcagcagcgagctccttcgccggcgcctgtccacaacagcagtcccgacgcgacactgtgacccttggtgaggcaccttgctgtcctagccgctggatcgagctttgtcccagcccgcagcttgctatcgtcgagtattgggcttgccgtcgatgtcgtgcttgtcatgcgcagcaagaaccacagcgccacgacttgttccagctcgacgagagcagccacatcgtcgtcgacccgtgcccttgtcgtcatgcctcgcgcattccatgctcgacgaaagccccaagctgtggacagcatgcggacatgcgcgacacgagtcggccaggaccgagagatgatgatcgtgcaagtga

SEQ ID NO: 48470 - DNA, 762 bp, Zea mays
  misc_feature: Ceres CLONE 1457817-F
  misc_feature: Translation starting site: 288
  misc_feature: Pfam Name: PsaL Pfam Description: Photosystem I reaction centre subunit XI
ggagctccccgcggtggcggccgctctagaactagtggatcccccgggctgcaggaattcgtctcacccctaatcgaaaaatcgtgatttatgtaacttaaacaccatgtgggtgagtgaatctccaatggtgagccaactaaagagcagcttctcttccacttgaattgctatgcgtctagacgtccctaaagggatctccggcacatatataaagcgacttgcagatggaaagaatcgaataatacgttgtggtaggagctcacaagtatcaggagagactacccatgggaacatcagttcacagcgaccaggactacaaagagccacatactgctgccctgttcaagccattgaaggttgcttcccggtcctactggacagcctacatcactgacttcatccctctcctcctcgtcgtctaaatgaccgtggcacatggcttcctcttaaagagcccatccaacatatgtgcttcagtaagaaacactggtatacgctggttccttcggctccatgatcttcgctcgtgtctgaagcatcctcagcatgtgcctcagaaactacagaatctctgtcatcaatgaacgtgacccttcaattgctcctagtctgacgataactgtgtactacgaagcagcccgaccatcttcagacatctgatgaatcgtgcatagtcaaggggattgctcttcttcagaagcatctctcggtgagacttgaggctaacctgcagctcctagttactgcacattgcatagg

SEQ ID NO: 48471 - DNA, 743 bp, Zea mays
  misc_feature: Ceres CLONE 1457819-F
  misc_feature: Encodes the peptide sequence at SEQ ID NO. 48472
tggagctccccgcggtggcggccgctctagaactagtggatcccccgggctgcaggaattcgtctcacccctaatcgaaaagtgtgtgcgtgcctcgatcgtgtctctctgtctctgcagctccggagaagaggcagcgcgtgccgtcggcgtacaaccgcttcatcaaggacgaaatccaacgcatcaaggctggcaatcccgacatctcgcacagggaggccttcagcgcggcggccaagaactgggcgcactttccacacatccactttggactcatgccagatcaccaggggcccaagaagacaagcctgctacctcaggatcaccagagaagcgacggcggcgggctactaaaggaagggctgtacgctgcggcagccaacatgggggttgctccatactaatattagagtagcaaagctgctacgtactgttagggctctatggactactacgaagctatggacgtgtttggtaggctgcatatgggccggccaggctggtaagatacagcgtacgcttgtttggttgcttgtctctgtatctggtgggctgaggggcggtgtttggttgcctgtatgtctgtgctcacctgcactgcgggatgcaacatctcgctgtgagccaggctgtggagaaacgagtttcatttctgtatctcgggagccaggccctggctagcctgtttggagcgggcaggctccactgcgaaacgaccaaacacgccctatatgtatcta

SEQ ID NO: 48472 - protein, 42 aa, Zea mays
  misc_feature: Ceres CLONE 1457819-F
MPDHQGPKKTSLLPQDHQRSDGGGLLKEGLYAAAANMGVAPY

SEQ ID NO: 48473 - DNA, 916 bp, Zea mays
  misc_feature: Ceres CLONE 1457823-F
  misc_feature (1)..(1): n is a, c, t, g, unknown, or other
  misc_feature (21)..(21): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (55)..(55): n is a, c, t, g, unknown, or other
  misc_feature (64)..(64): n is a, c, t, g, unknown, or other
  misc_feature (477)..(477): n is a, c, t, g, unknown, or other
  misc_feature (478)..(478): n is a, c, t, g, unknown, or other
  misc_feature (495)..(495): n is a, c, t, g, unknown, or other
  misc_feature (570)..(570): n is a, c, t, g, unknown, or other
  misc_feature (619)..(619): n is a, c, t, g, unknown, or other
  misc_feature (872)..(872): n is a, c, t, g, unknown, or other
ncccccccccaacaaacccanacaannnnnnnnnntccccttgtgccgagctggnggtccccgngggggcggccgctctttaatagtgggatcccccgggctgcaggaattcctctcacccctaatcgaaaaatcgcttcagctcggcgtcttcacaaacgccggcgcaaactctcgcccgagcccgacagatctctagttctccataccgtccaccgggcgaccttcacgcccagtctcggtcccttcccaaggcctcccgcgcggttgtttgggaggagaggaggaagacgagggagtgcatctccccccacatcgggcaggtcggcttccccttccgaaacgggtgcggggaactctactggctcgagtccgggatcaacgggcgacaggatcggaatgttttttttttggtagtggtggccccccccggcgggggtatccaggtttgcttctcgcgtggccccccccgcgggnncccaccaccacaccccnaagcaacccccccaccgcgcccggcgacaaactcccacgccggtttatcccccccccacttttttcctctacgancatcccgacacggcggcctcaactcggcgactactccgcccctcccaanccgtggagagtcgctaaattgtcacccccgcacactcccaccttctactgaaccgcacggggttggtctatgtgatatacgcgctcacagactacacgcccctattctcacgtgtttcggccatgtcgagaactaacctcgacgttagtctcccccctcacctctcccttctcccatcaatcatccacttcctcacacgcctaaatacgaccaagcgccacgtaaagcccttaggcactagagcgccggctcnttgactcctccccctgcatccgtccagtagagaacagactgcgg

SEQ ID NO: 48474 - DNA, 727 bp, Zea mays
  misc_feature: Ceres CLONE 1457825-F
  misc_feature: Encodes the peptide sequence at SEQ ID NO. 48475
  misc_feature (552)..(552): n is a, c, t, g, unknown, or other
  misc_feature (587)..(587): n is a, c, t, g, unknown, or other
aaagctggagctccccgcggtggcggccgctctagaactagtggatcccccgggctgcaggaattcgcacgagaccattacctagaacatcctaatcgaaaaaaattcccaaccgccgcacagcaacaccagcggtcggatcgggggagaaacggaagggcaacagcagagcgcgaattcctcagacaaatccaaggtttcgagcacagacacaggcgaaactcgatggcggaggggtccaagccggacgtgccgctgttccagctcctcagcgatcttctccagcaggtggagtcaatgagcaatcaggaagaagtagagctgcgcgctaagattgaagcattaggattagaagtcactaaggtaccagagcagcccgctaatcatctcagcgagctagaaatagctgcagagttggacaagctgtcatcgcggcttgataacgtcgacaagatgatatcatctgccatggcctcagatccagaggtgaagtctcttctgagcagcacatctgatatctggatgccggtcataacagcgtctgccaatganaagcgggggttttgttgggacgagcagcgaaggcngccaggaagagcaggaaatttcaagccatagctggaatagggcttgtaaaaagtttccgtttggggggtttgtaccgaccttatccatgttcattccaactaagggttccatgcccaaaaatttttgggggaaaaaaaaa

SEQ ID NO: 48475 - protein, 130 aa, Zea mays
  misc_feature: Ceres CLONE 1457825-F
  misc_feature (109)..(109): Xaa is any aa, unknown, or other
  misc_feature (121)..(121): Xaa is any aa, unknown, or other
MAEGSKPDVPLFQLLSDLLQQVESMSNQEEVELRAKIEALGLEVTKVPEQPANHLSELEIAAELDKLSSRLDNVDKMISSAMASDPEVKSLLSSTSDIWMPVITASANXKRGFCWDEQRRXPGRAGNFKP

SEQ ID NO: 48476 - DNA, 743 bp, Zea mays
  misc_feature: Ceres CLONE 1457833-F
  misc_feature: Encodes the peptide sequence at SEQ ID NO. 48477
  misc_feature (711)..(711): n is a, c, t, g, unknown, or other
  misc_feature (720)..(720): n is a, c, t, g, unknown, or other
aagctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgccctggcaacatattttgaggctagctaaatatgaaccttttgtctnctaagttgntaaataaagaaaattatctgaca

SEQ ID NO: 48477 - protein, 72 aa, Zea mays; identical to SEQ ID NO: 46899
  misc_feature: Ceres CLONE 1457833-F

SEQ ID NO: 48478 - DNA, 750 bp, Zea mays
  misc_feature: Ceres CLONE 1457837-F
  misc_feature: Encodes the peptide sequence at SEQ ID NO. 48479
  misc_feature (416)..(416): n is a, c, t, g, unknown, or other
  misc_feature (417)..(417): n is a, c, t, g, unknown, or other
  misc_feature (446)..(446): n is a, c, t, g, unknown, or other
  misc_feature (449)..(449): n is a, c, t, g, unknown, or other
  misc_feature (471)..(471): n is a, c, t, g, unknown, or other
  misc_feature (587)..(587): n is a, c, t, g, unknown, or other
aagctggagctccccgcggtggcggccgctctagaactagtggatcccccgggctgcaggaattcgtctcacccctaatcgaaaaaactgtcacggccgcttccagcacgcatcattctcgtctcccgtctcgagagattgcagggggcggcgctcgaagctggaggaagcggacgggttcgcgatggggtccgagggatcctcgggtccggtcgtcgttcccagaaactttaggctgctagaagaactagaacgtggtgagaagggcattggtgatggaactgtgagctatgggatggatgatgctgatgacatatatatgcggtcctggacaggaactataattggtcctcccaatactgttcacgagggacgaatctaccaattaaagctgttttgtgatacagattatccannataaccaccgacagtccgattccagactncgnatcatatgacatgcgtgaaccnagaaactggattgggtactgtgcatttttgttttctacagcgtggcacctgcccagggcaatttacgaatgatattaggcccatttgctagctagcactttttctaagttgaaccnaggcctatttctatgccttgccagtggggaaagggacctaccatggaggacatccctggccagcttaaaaaggaaattggcactcctcaaaaccgcaagctgttccaccctccttgaaggttacgaaaatcaaaaagtttagccaaaaggccttgtcccttta

SEQ ID NO: 48479 - protein, 77 aa, Zea mays
  misc_feature: Ceres CLONE 1457837-F
  misc_feature: SWISSPROT Homolog: EC 6.3.2.19 Ubiquitin--protein ligase
MGSEGSSGPVVVPRNFRLLEELERGEKGIGDGTVSYGMDDADDIYMRSWTGTIIGPPNTVHEGRIYQLKLFCDTDYP

SEQ ID NO: 48480 - DNA, 674 bp, Zea mays
  misc_feature: Ceres CLONE 1457845-F
  misc_feature: Encodes the peptide sequence at SEQ ID NO. 48481
ggagctccccgcggtggcggccgctctagaactagtggatcccccgggctgcaggaattcgcacgagaccattacctagaacatcctaatcgaaaaacggctctacggagggataggtcgctcttcttcctcactgagagaccatgagacgggtcgagacgacagcggcggatgcaccccacgacctccagtgactctcccagtcccaggctcccagccccccttcctcccacctccgcgagaccgcgatggcagtcttgctgtggcggtgcatatgcgggccccaacaatccttcagtaagaatcgaggcgcatccaccccttctcctcttgctggcaggagatccaaatactcgggacaatctgtgaaagcaatgcccatgcgtttgttaacggttggaaacaacaggtctcgggggacacaactccttgttgaagaatacaaggagaagctcggtcactattgcgagttcgaggacactcttatcaggtccaacccaaagcttacaagtgatgtaaaggtgcaaagttgaagcagaagaccacggctatgaatgccgccaccctccggtctggacgaattttttgaatttggcccggggaaaaaaaaccgggaggggggtgctttttcccccaaaaaaaactttttttcttttttgtggggggccgccccc

SEQ ID NO: 48481 - protein, 94 aa, Zea mays
  misc_feature: Ceres CLONE 1457845-F
MAVLLWRCICGPQQSFSKNRGASTPSPLAGRRSKYSGQSVKAMPMRLLTVGNNRSRGTQLLVEEYKEKLGHYCEFEDTLIRSNPKLTSDVKVQS

SEQ ID NO: 48482 - DNA, 794 bp, Zea mays
  misc_feature: Ceres CLONE 1457854-F
  misc_feature (417)..(417): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
ggagctccccgcggtggcggccgctctagaactagtggatcccccgggctgcaggaattcgtctcacccctaatcgaaaaaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccaaagctaaanctgttgagtactatgctaagctgaagagctgcatccacatcatgttgtggaccgcgaaggaagcttctttatcggacaggctcccttgtcaccgacccaatcaggcacccccccaaccggggaataaccctgggtttggctttgcatgaaaaccaccctggggttgccaaagccaattccaaccaagaaaaaaaggggctttaaaccaagtgcccccccaaaaattggggcttttaagggcgaaacccctaaaaaaaaaaaaaaggggaccttctgagtcccgcgtcgcgaagnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 48483 - DNA, 634 bp, Zea mays
  misc_feature: Ceres CLONE 1457855-F
  misc_feature: Encodes the peptide sequence at SEQ ID NO. 48484
  misc_feature (258)..(258): n is a, c, t, g, unknown, or other
  misc_feature (325)..(325): n is a, c, t, g, unknown, or other
  misc_feature (367)..(367): n is a, c, t, g, unknown, or other
  misc_feature (422)..(422): n is a, c, t, g, unknown, or other
ctccccgcggtggcggccgctctagaactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagactcgcagatggccggcctcaggatgaagttcgtcgccgtcgccgccatggccgccngcgctcgtggcgtccgccgcagccgccgaggcccccgccccggctcccgcgtccgacgccgcggccngcgtaccccctcgcgcggcctccctcgcgccgcggcttcggntactctctgctagatcgcgctggaacgtggttctgctcaaatatgatcgtctgtnctgcgcgcggagtcagctcgtggtcgtggtgtctctggtgaggtgtcgccggcttgtgtgattaatgaatccgccccgccgcccccaaaaagaagtgtcccctggtggtggaacttgcttcaccccccccgtttgtccgggaaataaggaacacccggggggttttggggtaaccggggaggtttttttggcccaaaaaaaaaaaaaaacct

SEQ ID NO: 48484 - protein, 56 aa, Zea mays
  misc_feature: Ceres CLONE 1457855-F
  misc_feature (17)..(17): Xaa is any aa, unknown, or other
  misc_feature (39)..(39): Xaa is any aa, unknown, or other
  misc_feature (53)..(53): Xaa is any aa, unknown, or other
MAGLRMKFVAVAAMAAXARGVRRSRRGPRPGSRVRRRGXRTPSRGLPRAAASXTLC

SEQ ID NO: 48485 - DNA, 553 bp, Zea mays
  misc_feature: Ceres CLONE 1457856-F
  misc_feature: Encodes the peptide sequence at SEQ ID NO. 48486
  misc_feature (268)..(268): n is a, c, t, g, unknown, or other
agagctggagctccccgcggtggcggccgctctagaactagtggatcccccgggctgcaggaattcgcacgagaccattacctagaacatcctaatcgaaaaaccaaaccggagcacttcggaggccggacccggcgagaagcgaccgaccgcagccagctcacgtctccctcttcatccaccatgctgagggtcgcgggcaggcgcctctcgtccgctctcgcctggcgccccgccgccgccgcctcaggctcccggggccctctcngcggtacactacccggccgcgacgacgacaacccacgcgactgcaggggcgcgtttcgccatcgaatcttcctttctttccccgctggcccaagggtttttctgcaaaaacctcttgctcccaagaaaacaagaaagggggggtttacccaaattccccaaaaatttggggaggctgggaagaaaacccccggggaaaaaaccggggtttgggagagtaaaaacccgggggccccccccccccggggggacccccccaaagggggggttttttcccccttttgtg

SEQ ID NO: 48486 - protein, 123 aa, Zea mays
  misc_feature: Ceres CLONE 1457856-F
  misc_feature (29)..(29): Xaa is any aa, unknown, or other
MLRVAGRRLSSALAWRPAAAASGSRGPLXGTLPGRDDDNPRDCRGAFRHRIFLSFPAGPRVFLQKPLAPKKTRKGGFTQIPQKFGEAGKKTPGEKTGVWESKNPGAPPPRGDPPKGGVFSPFC

SEQ ID NO: 48487 - DNA, 730 bp, Zea mays
  misc_feature: Ceres CLONE 1457860-F
  misc_feature: Encodes the peptide sequence at SEQ ID NO. 48488
  misc_feature (540)..(540): n is a, c, t, g, unknown, or other
  misc_feature (584)..(584): n is a, c, t, g, unknown, or other
aaagctggagctccccgcggtggcggccgctctagaactagtggatcccccgggctgcaggaattcgcacgagaccattacctagaacatcctaatcgaaaaaacaacttgggcgcggccggattcgtataggttagcagcacacagtagcaagctcgcgatctgtgcgcccaccatcaccaccaccgccgggaggagaggaccgaccgaccgaccgaagatgcggatgagctgcaacggctgccgcgtcctgcgcaagggctgcagcgacgcctgcaccatccgcccctgcctgcagtggatcgacagccccgaggcgcaggcaaacgccaccgtcttcctcgccaagttctacggccgcgcggggctgctcaacctgctggccgccgcgcccgacgacgccgcccgcccggccgtcttccgctccctgctctacgaggcgtgcggccgcatcgtcaaccccgtctacggctccgtcggcctgctctggtcgcgccggtggcagagctgcgtcgacgccgtcgaggccgtgctcaaggncgaccccgtcgtgcaggtcgacgccggctccgaggcggcgccgnccccggcgccgctgctcggcgccagcagggcaagccgcgccgccgggccggctacgatatccgccacgtcgcccagggattccgaaaccccttcgccgccgccgacctccttcgggggtcggggggggggggcggcccccaagagg

SEQ ID NO: 48488 - protein, 170 aa, Zea mays
  misc_feature: Ceres CLONE 1457860-F
  misc_feature (4)..(110): Pfam Name: DUF260 Pfam Description: Protein of unknown function DUF260
  misc_feature (107)..(107): Xaa is any aa, unknown, or other
  misc_feature (122)..(122): Xaa is any aa, unknown, or other
MRMSCNGCRVLRKGCSDACTIRPCLQWIDSPEAQANATVFLAKFYGRAGLLNLLAAAPDDAARPAVFRSLLYEACGRIVNPVYGSVGLLWSRRWQSCVDAVEAVLKXDPVVQVDAGSEAAPXPAPLLGASRASRAAGPATISATSPRDSETPSPPPTSFGGRGGGAAPKR

SEQ ID NO: 48489 - DNA, 712 bp, Zea mays
  misc_feature: Ceres CLONE 1457861-F
  misc_feature: Encodes the peptide sequence at SEQ ID NO. 48490
aaagctggagctccccgcggtggcggccgctctagaactagtggatcccccgggctgcaggaattcgcacgagaccattacctagaacatcctaatcgaaaaacagactcgcactgcactcgtccaatccagggaggctgggaaggatcagggatccatccaccgttctgtcttctcaggtcgacaggaggccagaccaggtgcgcgcgtccgtgtcggcgatgagcgcgggcgggagccgggcgcggcagaacgcgatgcgctcaggggtggtggtgctgggcgccgtggccttcggctacctctccttccgcgtcggcttcaagccctacctcgaccaggctcaggaggccatcgactccgcccgcgaccccgaccctgaccccgccaccaccgccgcgagggacgcgtccgacgatcccggcgccggtcgcccagggggagacctcgggccgtccaaggacccggccgtcgtactgcgcgactgaggcccggtgcgggcgtttggttgcgccattttggcaaacaccttgtacgcgggcccttgcttcgactgttttggtagtatgggccaccctgtgtgagatcttcttccctgctgctttgaagtttgaactggtttctgtgtgatgcccacataaagcttcctgttcgatcaaaaaaaaaaaaaaaaaagcttatcgataccgtcgacctcgagggggggcccggt

SEQ ID NO: 48490 - protein, 88 aa, Zea mays
  misc_feature: Ceres CLONE 1457861-F
MSAGGSRARQNAMRSGVVVLGAVAFGYLSFRVGFKPYLDQAQEAIDSARDPDPDPATTAARDASDDPGAGRPGGDLGPSKDPAVVLRD

SEQ ID NO: 48491 - DNA, 789 bp, Zea mays
  misc_feature: Ceres CLONE 1457864-F
  misc_feature: Encodes the peptide sequence at SEQ ID NO. 48492
agagctggagctccccgcggtggcggccgctctataactagtggatcccccgggctgcaggaattcgcacgagaccattacctagaacatcctaatcgaaaaactcgccgcctcctccctactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatccctcagcagcgcctcaaggtaccaccggcgctcaaccagttcacccgcaccctccacagaacctcgctacgaacctgttttagatgccttctcaagtaccgggctggagaacaaggttccaaaagggaaaggtttcttaaaaaggcctaactttaaaattaaggaaaactttttattccaaaaaaccaattttttggaaaaattgcccttacccgggggctttccccttttgaaaaaaaaagggttccctttttgtttcccccccccaagagggaaccccaaacaaatttttgggtgggccctccccccccggggagaaaaagagggccccctttttctttttttataaaaaaaggtctccctttgttttttttttttctacaaaaaaaagagccctcttttttttttcccccctaataagaaaaa

SEQ ID NO: 48492 - protein, 111 aa, Zea mays
  misc_feature: Ceres CLONE 1457864-F
MAPKRGGRAPVPAKKKTDKVTNPLFEKRPKQFGIGGALPPKKDLHRFVKWPKVVRIQRQRRIPQQRLKVPPALNQFTRTLHRTSLRTCFRCLLKYRAGEQGSKRERFLKKA

SEQ ID NO: 48493 - DNA, 730 bp, Zea mays
  misc_feature: Ceres CLONE 1457877-F
  misc_feature: Encodes the peptide sequence at SEQ ID NO. 48494
tggagctccccgcggtggcggccgctctagaactagtggatcccccgggctgcaggaattcgtctcacccctaatcgaaaaacgtgtcgatgcagtccgtgactgcaatagaacatcctggccaacaccggtgagcgaagagaaacgattccatagtcgaagcgtagatcgcagcggagcagaggcatggatggaaagagctttagcaacgaacagcaagcccaacaaaagaacccagacgcagtgacaaacagtgttccgagccaaggccaggagcccttgaacacgtttccagattcagacgatggaaacacgaacaccggtccgttgaatggccatgcagcagctcatgtgaacatggaagctgccatctctacggaggacgtcatacgggctggcgggttcggagcgaaggatgacattggcagcctcctcccgacggcaattgattccaccgattttgaggcctcgctgcgggatgcccgtggtttcgagggcgagaaagcggcgccgtcgcatcctggactagggtggaagggggagaaagctgatggtggaaccaaactggcagatgtggcggagcagtgatcacgctttcctcttctgtagcccagctccagccttcagaaaaccttgttttctgccacgtgtgtctggagagctgccctgcgtatgaactttctttgtcacagtgttttgtgtgacacataacattctgtgtatgaacatg

SEQ ID NO: 48494 - protein, 133 aa, Zea mays
  misc_feature: Ceres CLONE 1457877-F
MDGKSFSNEQQAQQKNPDAVTNSVPSQGQEPLNTFPDSDDGNTNTGPLNGHAAAHVNMEAAISTEDVIRAGGFGAKDDIGSLLPTAIDSTDFEASLRDARGFEGEKAAPSHPGLGWKGEKADGGTKLADVAEQ

SEQ ID NO: 48495 - DNA, 725 bp, Zea mays
  misc_feature: Ceres CLONE 1457882-F
  misc_feature: Encodes the peptide sequence at SEQ ID NO. 48496
ggagctccccgcggtggcggccgctctagaactagtggatcccccgggctgcaggaattcgtctcacccctaatcgaaaattttttggttcgataaacccaaagccacagtctgacagtcggtcgcgtcactagggtttctctcctcctgctcctcgccgccgcgatgagcgccaccaggccggaccaccggcggcaccagtcgccgttcctgcgggacctctcgtccccgatatcctcgtccttccgcatgcccccggcgtccgtgcgccgcgaggcccatgcctccaccccgccgccgcctcccccgctgctctccctctatgacctgtcccgccactccccctctccgccgccctacacgcctccgcaggcagccatgtccccttcgcctcctccccctcgcgggggcctcttctccaccccgcaacgctccaacggctccccctccccggcggcgtggtggtccccctcgagggaggagaaggcgagggatggttccccggtcgacggattcgtgcatcatcagcagtccccggggacggcctccgcacagcatccgcagcagcagcagcagcatgtggcgctgatcacgctgcctccgcccagggatgtcacgcgcccggagatgcctagggattcggtgctctccactggacgggtcgactaggatgaatgtgtcaccgtttttggagccgtcatgatgcgcagatagcgctggccaat

SEQ ID NO: 48496 - protein, 96 aa, Zea mays
  misc_feature: Ceres CLONE 1457882-F
MSPSPPPPRGGLFSTPQRSNGSPSPAAWWSPSREEKARDGSPVDGFVHHQQSPGTASAQHPQQQQQHVALITLPPPRDVTRPEMPRDSVLSTGRVD

SEQ ID NO: 48497 - DNA, 654 bp, Zea mays
  misc_feature: Ceres CLONE 1457883-F
  misc_feature (193)..(193): n is a, c, t, g, unknown, or other
  misc_feature (201)..(201): n is a, c, t, g, unknown, or other
  misc_feature (204)..(204): n is a, c, t, g, unknown, or other
  misc_feature (205)..(205): n is a, c, t, g, unknown, or other
  misc_feature (262)..(262): n is a, c, t, g, unknown, or other
  misc_feature (264)..(264): n is a, c, t, g, unknown, or other
tggcggccgctctagaactagtggatcccccgggctgcaggaattcgtctcacccctaatcgaaaagcattccctctgagcgccgccactccctgacatcgagaccggctgcccgaccccggtccggcgatccctctgcacccctttctttgcgctgccagccccaatctctcgcatccctgtcaaccatggncgcgtcancanngcgaaggcgcgtgcgcgcgctgtcccaaaagagcaggacatacagatgatgctcgcngncgacgtccaccttcgcaaccagaaactgcgatttcaaaaaggaccggtatgtccttaaacggtcgaccgacgggattttaattattaaacctgggaaaaaaagggaaaaaactcccacccccgggcaagagtttttggtgccttttgaaaaccccaaaaaaaattttttgttaagtgaaaaccccccctaaggggaaagggggttgttcatagaacccccccaaaaaaagggcccccaattgaattgtggggggggagaacccccggggaccttttcaaaaaattccccaaaaacctttttttaaaaaccaccccccgcgctcctttttttagggccaggggggaggccccccccccacaaaaaaatcttctccttgaggaaaaacaacc

SEQ ID NO: 48498 - DNA, 789 bp, Zea mays
  misc_feature: Ceres CLONE 1457888-F
  misc_feature: Encodes the peptide sequence at SEQ ID NO. 48499
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccacgcgacctcttttttttcctaggaacgtacattgtcatttttggaagcttctgaaagcatggcgtgcgcgtggactatgaatgtatgagtcactcccaaactaactggttgagtacaatgctagctgaggaactgctttccctctcgggggggaaccgcagggaaggttcttttttggaaaagcctctttgtccccaaaaaattagggccccccccagcgggggaaaacccggggttggggtttggaagaaaaacacccggggttttccaaaagcctctttcaaccaaaaaacaagagtttttaacacccgggtcccccccccccaaaaaaatttgcgctttttttatatgccggaaaaatccctttaaaaaaaaaaaaaaaaaaaaaggggggggggcccccctcccccataagaggggagaaaacacccccccccgccgcgctgtttttttatccgcggggagggggaaaaa

SEQ ID NO: 48499 - protein, 72 aa, Zea mays; identical to SEQ ID NO: 46180
  misc_feature: Ceres CLONE 1457888-F

SEQ ID NO: 48500 - DNA, 764 bp, Zea mays
  misc_feature: Ceres CLONE 1457889-F
  misc_feature: Encodes the peptide sequence at SEQ ID NO. 48501
ggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggccaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaaagttgtaaataaagaaaattatctgacaaaaaaaaaaaaaaaaacgagacgctc

SEQ ID NO: 48501 - protein, 72 aa, Zea mays
  misc_feature: Ceres CLONE 1457889-F
MGKTPVRMKAVVYALSPFQQKVMPGLWKDITTKIHHKATENWISATLLLTPVVGTYQYAMWYKEQEKLSHRY

SEQ ID NO: 48502 - DNA, 767 bp, Zea mays
  misc_feature: Ceres CLONE 1457890-F
  misc_feature: Encodes the peptide sequence at SEQ ID NO. 48503
  misc_feature (158)..(158): n is a, c, t, g, unknown, or other
  misc_feature (159)..(159): n is a, c, t, g, unknown, or other
  misc_feature (172)..(172): n is a, c, t, g, unknown, or other
  misc_feature (174)..(174): n is a, c, t, g, unknown, or other
  misc_feature (176)..(176): n is a, c, t, g, unknown, or other
  misc_feature (177)..(177): n is a, c, t, g, unknown, or other
  misc_feature (180)..(180): n is a, c, t, g, unknown, or other
  misc_feature (181)..(181): n is a, c, t, g, unknown, or other
  misc_feature (184)..(184): n is a, c, t, g, unknown, or other
  misc_feature (352)..(352): n is a, c, t, g, unknown, or other
  misc_feature (436)..(436): n is a, c, t, g, unknown, or other
aaagctggagctccccgcggtggcggccgctctagaactagtggatcccccgggctgcaggaattcgtctcacccctaatcgaaaacggccgtcatcaagagcctgcacccgagctggtcccccgcggcggtgaagtcggcgatcatgacgtcgtcgnngacgcggcggacncnanncgnncgnggcgtgcccatcaaggacgagcagtaccggcgggcgagcttctacagcatgggcgccgggtacgtgaacccgtcccgcgccgtggacccggggctggtgtacgacctcggcgccggcgactacgtcgcctacctctgcggcctgggcatcggggacgggcgcgtgaangagaatacggggcgccgcgtcgccctgcgcggcaagcggctgaagcccatcacccgagcggagctccactaccccgtccctggntggtgaaactgctgttccgcccggtcaccgtcccgccgacccgtgaccaatgtcgggaaaggccaactccatttccaggggccgtgggttgaattgcccaacaaggcccttggcccgtggtgttggggccccccaaccttcggtttcccaaggtgtaaaacaaaagggggaatttccccctaacgtgggcggggaaaggggccccccgcccccccgggggtttaaaggggaacctaaaagggggtggagagggaaccacattccccccccccccctttttataccccccgaaaagagccccccggaggggtttttctccccccctttaggg

SEQ ID NO: 48503 - protein, 98 aa, Zea mays
  misc_feature: Ceres CLONE 1457890-F
  misc_feature: SWISSPROT Homolog: EC 3.4.21.25 Cucumisin
  misc_feature (5)..(5): Xaa is any aa, unknown, or other
  misc_feature (10)..(10): Xaa is any aa, unknown, or other
  misc_feature (11)..(11): Xaa is any aa, unknown, or other
  misc_feature (12)..(12): Xaa is any aa, unknown, or other
  misc_feature (69)..(69): Xaa is any aa, unknown, or other
MTSSXTRRTXXXRGVPIKDEQYRRASFYSMGAGYVNPSRAVDPGLVYDLGAGDYVAYLCGLGIGDGRVXENTGRRVALRGKRLKPITRAELHYPVPGW

SEQ ID NO: 48504 - DNA, 731 bp, Zea mays
  misc_feature: Ceres CLONE 1457891-F
  misc_feature: Encodes the peptide sequence at SEQ ID NO. 48505
  misc_feature (479)..(479): n is a, c, t, g, unknown, or other
  misc_feature (512)..(512): n is a, c, t, g, unknown, or other
  misc_feature (521)..(521): n is a, c, t, g, unknown, or other
  misc_feature (574)..(574): n is a, c, t, g, unknown, or other
aagctggagctccccgcggtggcggccgctctagaactagtggatcccccgggctgcaggaattcgcacgagaccattacctggaacatcctaatcgaaaaatatttctaaaccaggtgagaagcagaaacctctggagaaagatgctggagagaagaccatagcctggttggacaagctgaggaatgcgaatgggtcattgccaacttccaagatccgtctcaacatgcaacgtgttatgcaaaataatgctgctgtgttccgtacacaagaaacacttgaagaaggttgtgaactgattagcaaaacatgggaaagtttccatgatgtgaagctcagtgaccgaagtctcatttggaactctgacttgatagagaccctggaactggaaaatctgttgataaacgcatgcataactatgtattcggcagaggctcggaaagaaagcagaagagctcatgctcgtgaagattcacgancagagatgacgagaagtggatgaaacactcccntgggatatnggaggaacgagagggtcgattggcatacaggccattgcccatggaaacattgnacgatgaaagtaagtcattccgccaaaaagcccggggcttatgaccgattccagcctaacccctcgggaattcctggatagggtttaaaaaaacaaatgggctttcccgggggaaaaacaaacccggaaattgggccccccatttcggggggttcgg

SEQ ID NO: 48505 - protein, 36 aa, Zea mays
  misc_feature: Ceres CLONE 1457891-F
KLELPAVAAALELVDPPGCRNSHETITWNILIEKYF

SEQ ID NO: 48506 - DNA, 731 bp, Zea mays; identical to SEQ ID NO: 48504
  misc_feature: Ceres CLONE 1457891-F2
  misc_feature: Pfam Name: Succ_DH_flav_C Pfam Description: Fumarate reductase/succinate dehydrogenase flavoprotein C-terminal domain
  misc_feature: SWISSPROT Homolog: EC 1.3.5.1 Succinate dehydrogenase (ubiquinone)
  misc_feature (479)..(479): n is a, c, t, g, unknown, or other
  misc_feature (512)..(512): n is a, c, t, g, unknown, or other
  misc_feature (521)..(521): n is a, c, t, g, unknown, or other
  misc_feature (574)..(574): n is a, c, t, g, unknown, or other

SEQ ID NO: 48507 - DNA, 735 bp, Zea mays
  misc_feature: Ceres CLONE 1457893-F
  misc_feature: Encodes the peptide sequence at SEQ ID NO. 48508
aagctggagctccccgcggtggcggccgctctagaactagtggatcccccgggctgcaggaattcgcacgagaccattacctagaacatcctaatcgaaaactttgtattcgtcttgctccagccgccgtcggatcggatccgatccaaagcaagcagcagcagccggctcctcctccgcctcccgcagcagccacaccccgtccgtcaccagaggaagaggaggaggatgtcgggatcgaaggtgtacacccttgaggaggtggccaagcacaacaccaaggacgactgctggctcgtcatcggcggcaaggtgtacaatgtgaccaagtttctggaggaccaccctggaggtgatgatgtcctgctgtcttccactgccaaggatgctaccgatgaattcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccggaagtcgtcatcaagatcctccagtttttggtccccctggcaatactgggcctgggctgttgcttgtaaggacctaccccaagtcggaattgggctcggcctcttgaccaagttagggggggttgccattttggcccaaaatccccttgtcaaaaatttgggctttttggggccaaggggtttaattaattggaa

SEQ ID NO: 48508 - protein, 126 aa, Zea mays
  misc_feature: Ceres CLONE 1457893-F
  misc_feature (6)..(80): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MSGSKVYTLEEVAKHNTKDDCWLVIGGKVYNVTKFLEDHPGGDDVLLSSTAKDATDEFEDVGHSTTARAMMDEYLVGEIDAATIPSKVKYTPPKQPHYNQDKTPEVVIKILQFLVPLAILGLGCCL

SEQ ID NO: 48509 - DNA, 707 bp, Zea mays
  misc_feature: Ceres CLONE 1457897-F
  misc_feature: Encodes the peptide sequence at SEQ ID NO. 48510
aaagctggagctccccgcggtggcggccgctctagaactagtggatcccccgggctgcaggaattcgcacgagaccattacctagaacatcctaatcgaaaaaccaatcgcccacaagcgctcgcaggagaggtcgaaaccctagcttttgcggcggcggcgagagaagatgatctacgacgtgaactcccccctcttccgttccttcctcagccagaagggcggcgccgacaagaggaaaatggaggagcataaaccaaaggagcagaggcccaaggctaacgagaacaagcctgtgatgaacgaatgaatatctccagaagctttgttcaatgtgcaaccaagtccgatgtccgtttgctctggtcagcttaaaaccaacgcttccaataatcctatattggtgacttagtttccccttatagtgttatttgctcggcttgaacatggcaacggaaatgaaacttgaactacctatggtactgtcatcaatttgagactcccatggttgacaacttttgtgcagctctcctgttacagccgtcgtggttggtacagaattgtgggatgcgtcatgttttcatgcttgcttgcttcacattcttgccctattgtaatgattgagcaagcagtatctactgtaggtcataggacggatcttcggccgttgcatagcatcgaaatccgtagctctgtttgttgcatgg

SEQ ID NO: 48510 - protein, 46 aa, Zea mays; identical to SEQ ID NO: 7044
  misc_feature: Ceres CLONE 1457897-F
  misc_feature (1)..(46): Pfam Name: Wound_ind Pfam Description: Wound-inducible basic protein family

SEQ ID NO: 48511 - DNA, 753 bp, Zea mays
  misc_feature: Ceres CLONE 1457898-F
  misc_feature: Encodes the peptide sequence at SEQ ID NO. 48512
aaagctggagctccccgcggtggcggccgctctagaactagtggatcccccgggctgcaggaattcgcacgagaccattacctagaacatcctaatcgaaaaaagacttcgtcgtcaccaacaaaaagcagaaaaaaacagagagtagtagactacgacagcgtccgtcgaaccggagggtcgtaggcagacgccaaaatgaggaagaagctcggcacccggttcctcgcggctcgaatcatagagataatgcaagcagatgatgatgttggagagattgcattagcagtgactgttttagtctcgacggctctttgattgtttttagcagatttcattgaccggacttatgaaattactcttcaaggtggagcaaagacctggaattcttccacctgaggaatgtgggaaaggtacagttctttttgtttcctaaggaattttcaacaggggtcccaaattttgggggggttattcctggggaaaaaaaaaagtttccctttaaaaaaaaatttaagggggggccccccaaagagggtgaaccgttttttaaaaagggtttaaaaaaggaaaaaaccccccccagagagtgggggggggcaaaaaaaaaggggtttccccccccccaaaaaaagggggggggtgtctctttttttgaaaaaaaccctttttttttaataaggggtattcccccggggggggggtctttcttaatattgtggggggaaatttttccccccaccccctcccccc

SEQ ID NO: 48512 - protein, 39 aa, Zea mays
  misc_feature: Ceres CLONE 1457898-F
  misc_feature: SWISSPROT Homolog: EC 2.7.7.7 DNA-directed DNA polymerase
  misc_feature: The sequence is a functional homolog of SEQ ID NO 32 in US patent 7288695
MRKKLGTRFLAARIIEIMQADDDVGEIALAVTVLVSTAL

SEQ ID NO: 48513 - DNA, 710 bp, Zea mays
  misc_feature: Ceres CLONE 1457903-F
  misc_feature: Encodes the peptide sequence at SEQ ID NO. 48514
cagagctggagctccccgcggtggcggccgctctagaactagtggatcccccgggctgcaggaattcgcacgagaccattacctagaacatcctaatcgaaaaatcagctattcttctcttctcctggacaactcaagctcaaaacccaaaatcgaccttgtcgacccggatccgagctaggcacccgcacgaccacccgcctcctgccggtcaccgggacctagcatcgccgggcggcggcgggggaggggaaggtaggcgatgaggaaacgtgagcgggagaatccgtgcgggatctgcgggcactaccacaagtacgaggagggggaggtatgcggggtgtgcggccaccgctggaaaccgtcggacggggagggcgccccgtcgaggcacgagtccgccttccccacagaggtgctcaaggacttcctcttcctcgggagctacgacaacgcctcacgctccgaggtcctcaggacgctcagtatctcccacatccctaatactgtgcctgaatgccacaatctgtacaagaatcattcacatatcacagtctttcacgggacaggcctttggattttgatgaggcaaaccgtatctagagaattgtggaagaagaaaatcgcggggtcctggttcatgcatgactggaaaaacaggtctgcctgctttggtgcagctttcttgataaatctaaaagggggaactt

SEQ ID NO: 48514 - protein, 149 aa, Zea mays
  misc_feature: Ceres CLONE 1457903-F
MRKRERENPCGICGHYHKYEEGEVCGVCGHRWKPSDGEGAPSRHESAFPTEVLKDFLFLGSYDNASRSEVLRTLSISHIPNTVPECHNLYKNHSHITVFHGTGLWILMRQTVSRELWKKKIAGSWFMHDWKNRSACFGAAFLINLKGGT

SEQ ID NO: 48515 - DNA, 798 bp, Zea mays
  misc_feature: Ceres CLONE 1457905-F
  misc_feature: Encodes the peptide sequence at SEQ ID NO. 48516
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (16)..(16): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (128)..(128): n is a, c, t, g, unknown, or other
  misc_feature (362)..(362): n is a, c, t, g, unknown, or other
  misc_feature (515)..(515): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
taaaaccnnngtatanttatggtgnngnnngttttnnnnnnaatttnnnnnnnnnnnnttaaannnnttcagactggagctccccgcggtggcggccgctctagaactagtggatcccccgggctgcnaggaattcgcacgagaccattacctagaacatcctaatcgaaaacctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttggagaagaaggccttctaccctcagggccttgaaagctttttgaacgtgnaaaaggtcctttggctgaaaaacacttaaccccaattttgcccctccaaggccttttttctcggggccccggggggaaacaaaaaatttcttggggccctggggggggcccaggggttttggggagggcaaaaaaaccccctccccccccctntnnnnggnnnccaaaaaaaattggggggccccccccccccccccgggtttttttatgagccccgccccccccccgggggggggggaattttttttgggttacattttggggggggggggagtcttttttttgtgggggcggcccccccctttggggggggggtttcaaaaagaggggggtgtgtgggggtggtgggccccccccccgcgccccctcttttttatggtgaaaaaaaacaaccacccccccctccctttgtttgttttaaaaagaaaaaaaaaag

SEQ ID NO: 48516 - protein, 35 aa, Zea mays
  misc_feature: Ceres CLONE 1457905-F
  misc_feature: SWISSPROT Homolog: EC 2.7.4.6 Nucleoside-diphosphate kinase
MESTFIMIKPDGVQRGLIGEIISRFGEEGLLPSGP

SEQ ID NO: 48517 - DNA, 1635 bp, Zea mays
  misc_feature: Ceres CLONE 1457906
  misc_feature: Encodes the peptide sequence at SEQ ID NO. 48518
aatacaacacctccaccgcttctcaactcccctctgcgccctcgcctcttctcttttgtttttacctgctgcggaatgcggtccacgactatggatcttcgagagattacttaaaaaaacacacacacacaaatcttgcagcagcctccacacctgggattctcctccatagcgtgtgccgtcagccgtgtactactggcctccacggctccacccgcctttggttggattcctgttgccgcttcctcctcccgtgatcggccgcattgcgctgagggattctcgttcgctttttcccgacgccgcctgcggcagcggtactatttactgctccgctctttcggcggtttcttcgtctgctgccttcccagtttgctagctcttatccggaatggatgccggagcggggggagctatatgagtgattccttctccttcccgtctcttggattgcctccgttttggttctttggtgggcggccatggcgaacggcggcgagcaatcggcgatcacggcggccgtggagcggggccgcgtgagcggcgtctcccggcggctcgcgggggaggagagctccgacaacgacgacgaggggagccagcgcttctcggacgccgaggatcggtcctggcactctcactcgcgccaaggctccgccttggagttggaggactgtatctccacgtccgcgcccatcagccgcgacgccggcgccgccagtgccggcggcggggacacggccacggccacggccacggctgagcgcgccaggaagtcgggcgtgtcggagtgctcgctggacggcgtcgtcgacctggaggccgggctggctgagatcgtcaaggccagcccggacaaggccgagaggaactgccgcatctgccacctcggcctcgacagcgcctccgccgagtccggcgccggcatcgtgctcggctgctcctgcaaggacgacctctcgcgtgcccacaagcagtgcgccgagacctggttcaagatcagaggcaacaagatctgcgaaatctgtggctcaaccgcatgcaacgtggcaggtttctgtgatgcggagttcatcgagcagtggaatgaatcaagcaacactgcatctgcccaggcaacagccactgagcctcgtagattttggcaagggcaccggttcctcaacttcctcctcgcttgcatggtatttgcatttgttatatcctggctcttccacttcaatgttcctggatgagtactattggtgcagattgttcttaataaaagctccaaaaccacagaggaagcatggggaagtttcagaattcaaactggctgagcatgagaaaacaactggagatggacaagagttgctttggtgaaatgaagggtagtgttaattctgcagggaggaaggggaaagctggcattctgtaatattggttgagtggtggtgaatgaggagtggaacttattttcgattgcgtcatgcttccatgatttattgatttgtgtaccttctggttaagtagattattagatattcttgtcttctagcttagttggttatattctttgtggtggaatacatctatccaggtcggacattagcttaaaaaaaaaaaaaaaaaaaaaaaaagaaaaaaaaaaaaaaa

SEQ ID NO: 48518 - protein, 250 aa, Zea mays
  misc_feature: Ceres CLONE 1457906
  misc_feature (131)..(182): Pfam Name: zf-C3HC4 Pfam Description: Zinc finger, C3HC4 type (RING finger)
MANGGEQSAITAAVERGRVSGVSRRLAGEESSDNDDEGSQRFSDAEDRSWHSHSRQGSALELEDCISTSAPISRDAGAASAGGGDTATATATAERARKSGVSECSLDGVVDLEAGLAEIVKASPDKAERNCRICHLGLDSASAESGAGIVLGCSCKDDLSRAHKQCAETWFKIRGNKICEICGSTACNVAGFCDAEFIEQWNESSNTASAQATATEPRRFWQGHRFLNFLLACMVFAFVISWLFHFNVPG

SEQ ID NO: 48519 - DNA, 756 bp, Zea mays
  misc_feature: Ceres CLONE 1457912-F
  misc_feature: Encodes the peptide sequence at SEQ ID NO. 48520
  misc_feature (418)..(418): n is a, c, t, g, unknown, or other
aaagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcacccccaanctaaactgtttgagtactatgctaagctgaggagctgcattcacatcatgtggtggagcgcgagggaagcttctttatcggacagcctcacttgtcaccgacgcaatcaggcacccccccaagccgtggactacgctgggtttgggctttggcatgagaacgaccgctgtgtttgtcataagtcatatcgtaactagagaaccaaggagctttaatatccacaatgtacccccatcctacagaactatggatgcctccttgaccataggcgcggaaaaagcccttcctaaaaaaaaaaaaaaaaaacgagacccctcgaggacccaaattccccccta

SEQ ID NO: 48520 - protein, 73 aa, Zea mays; identical to SEQ ID NO: 46214
  misc_feature: Ceres CLONE 1457912-F

SEQ ID NO: 48521 - DNA, 775 bp, Zea mays
  misc_feature: Ceres CLONE 1457913-F
  misc_feature: Encodes the peptide sequence at SEQ ID NO. 48522
  misc_feature (375)..(375): n is a, c, t, g, unknown, or other
ccaagctggagctcaccgcggtggcggccgctctagactagtggatcccccgggctgcaggaattcgtctcacccctaatcgaaaactcggtccctcctctgcttcacacagaccagtgcgcgctcaattcccccctctagcgcctccaccgcaccaaaccggtccaacgggacctatgctctagcctcagagcaaaccaccgcctgaattgggcggcaattgggggaggattcgcggcaggcagggcgcggatccgttggcgggatgattgcggctgtcaacagagtgccggcgggctggggcgaggatgagatgtccgtgctgccgcggcacaccaaggtggtggtcaccggcaacaaccgcaccaagtcggngctcctgggattgcacggggtcgtgaagaaagccgtcggcctcggaggatggcattggctggtccttactaatggaatagaggtaaagctgcagcggaatgctttaagtgtgatagaacctccgactggcaacgaggatgatgataaatttgattgtgaaaacatgcagtggattagttcagatatggcctcccgatgatgcactatcaccaaagccacagcggtccacggagcaagcagcataagggttttccacagaaaatccatcagccgttcaatgtcatgtgaactcccactccaagaacgtctgttttcatcttccctcaagagcctccacccaaaagttggaccctaaccaagctagaaactgaactgcccctgctgagaaaattggccgtcc

SEQ ID NO: 48522 - protein, 102 aa, Zea mays
  misc_feature: Ceres CLONE 1457913-F
  misc_feature (37)..(37): Xaa is any aa, unknown, or other
MIAAVNRVPAGWGEDEMSVLPRHTKVVVTGNNRTKSXLLGLHGVVKKAVGLGGWHWLVLTNGIEVKLQRNALSVIEPPTGNEDDDKFDCENMQWISSDMASR

SEQ ID NO: 48523 - DNA, 833 bp, Zea mays
  misc_feature: Ceres CLONE 1457915-F
  misc_feature: Encodes the peptide sequence at SEQ ID NO. 48524
  misc_feature (431)..(431): n is a, c, t, g, unknown, or other
  misc_feature (434)..(434): n is a, c, t, g, unknown, or other
  misc_feature (436)..(436): n is a, c, t, g, unknown, or other
atagctggagctccccgcggtggcggccgctctagactagtggatcccccgggctgcaggaattcgtctcacccctaatcgaaaaactcgcgtccgcccccgccgccgcctttcgtcccagcccctaaaccattctccattcctctcatcagtttagcacaatggcactggctaataagcttggtggtctgctcaagaaagccacaagttcaaatctgtctgtctaccaagcaatcagatgcatgtcatccaagctctttgttggaggggattcttatcaaactgatgatcacagtcctcaggaacgagtttgccaaatatgggcaaagtcattgaagctaggaatatcattgaccgtgaattctggaaggttagaagttttggcttttgaaattaaaagttttttaaagaagcccccacccccccccccnccntngaatggaaaaaccctcaatggaaggaaacaaaagggtaaaacccttctaaaaaaaaaaaaagaggggtttttaggggccgggggggcttatggggccgggggcctcggggggggagggaagaaaatagggggtgggggacgggggaattgggggggagggaatcattggcgggtgggtgtatctttcttttaaatatatagggatgctttttatggatgggacagcgctacaagcgcagaggggtagtcaataacagctatccctcaccgtaacggaccacctctcttacttgagtttcgggagatacgcgcatagatctgatactatcctcctcctcgatacccagttatctgccgtccgcccctcatctctgttgtggtcctgcctcagctaccc

SEQ ID NO: 48524 - protein, 155 aa, Zea mays
  misc_feature: Ceres CLONE 1457915-F
  misc_feature (92)..(92): Xaa is any aa, unknown, or other
MALANKLGGLLKKATSSNLSVYQAIRCMSSKLFVGGDSYQTDDHSPQERVCQIWAKSLKLGISLTVNSGRLEVLAFEIKSFLKKPPPPPPPXNGKTLNGRKQKGKTLLKKKKEGFLGAGGAYGAGGLGGGGKKIGGGGRGNWGGGNHWRVGVSFF

SEQ ID NO: 48525 - DNA, 752 bp, Zea mays
  misc_feature: Ceres CLONE 1457916-F
  misc_feature: Encodes the peptide sequence at SEQ ID NO. 48526
  misc_feature (752)..(752): n is a, c, t, g, unknown, or other
tagctggagctccccgcggtggcggccgctctagaactagtggatcccccgggctgcaggaattcgtctcacccctaatcgaaaaattccccaatccccgtgtcgcctgtgcccctctgccacctcgccgtcggcatgacaacagggtcgaccccgggttcggccccctctcagagaaaacgaaattctaccaaggattccgttgccctgtacgcggtgcaatgctataagtgctacaaatggagtacggttccaaaagaagaatttgagacgcttcgtgaaaacttcactaaggatccatggttctgcagcagacgaccagacagctcttgtgaagacgatgctgacattgagtacgacagcagccgcatttgggttttggacaagcccaacataccaaagcctccaccagagacggagaggctagtggttatgaggggcgactacagcaaaatggacacatattatgtcatgcccaatgggaagcgtgcaaggtgtgctggtgatgtggataagtttctggaggcaaatcggagtacaaagaccgcatatctgcttcggatttcagctttgcgccaccaaggtttgtgaggagactgtttctcacacccctgcctggcaaagctgccaaagccagaggcaggagaaggcagaggcacaaaaatgatgatactcccacggtggcttgtgttatgttaaatgatagtccgctcaagacatgccccatcctatctagtgtggacttgtctatn

SEQ ID NO: 48526 - protein, 151 aa, Zea mays
  misc_feature: Ceres CLONE 1457916-F
  misc_feature (25)..(73): Pfam Name: zf-CW Pfam Description: CW-type Zinc Finger
MTTGSTPGSAPSQRKRNSTKDSVALYAVQCYKCYKWSTVPKEEFETLRENFTKDPWFCSRRPDSSCEDDADIEYDSSRIWVLDKPNIPKPPPETERLVVMRGDYSKMDTYYVMPNGKRARCAGDVDKFLEANRSTKTAYLLRISALRHQGL

SEQ ID NO: 48527 - DNA, 779 bp, Zea mays
  misc_feature: Ceres CLONE 1457917-F
  misc_feature: Encodes the peptide sequence at SEQ ID NO. 48528
aaagctggagctccccgcggtggcggccgctctagaactagtggatcccccgggctgcaggaattcgtctcacccctaatcgaaaacactacatcttctttgtcttgaacctctacgccagtgtcaccgtggttgagagtttgatgatggccattgcaagtgtcatacccaatttcctcatgggcatcatcataggagctggaattcagggaatattcatgcttgtctccggatacttcagacttccatatgacatcccgaaggttttctggagataccccatgcagtacatcagcttccattactgggcactacagggccaatgccagaatgacatggacggtctcctattcgacaacccataccggaccagccgaagatccctggggagttcatcctgaagtacatcttccacatcaatgtgcaccggtcgaagtggatcgacctgtcggtcatcttcagcatgatcttcatctaccgcctgcttgtcttcatcatgatcaaggttgaacgaagacgtgatgccctggatcccgggcctacctcgcgaggaaaaaggcttcaaaaaaggtgcctgccatcgggaaaaccccttccctgaaaggctattttgggaacgcgaacttggccctaacaaaggctaaaaaaaaaaacggggggtgttcggggaacccaaaaagagggctcccccccggttttgggggaatttttttttgggccaaaaaaccgggaaaattttaacccttgggaaacaaaaaaaaaaaaaaagccccctgcgc

SEQ ID NO: 48528 - protein, 85 aa, Zea mays
  misc_feature: Ceres CLONE 1457917-F
MMAIASVIPNFLMGIIIGAGIQGIFMLVSGYFRLPYDIPKVFWRYPMQYISFHYWALQGQCQNDMDGLLFDNPYRTSRRSLGSSS

SEQ ID NO: 48529 - DNA, 771 bp, Zea mays
  misc_feature: Ceres CLONE 1457919-F
  misc_feature: Encodes the peptide sequence at SEQ ID NO. 48530
  misc_feature (271)..(271): n is a, c, t, g, unknown, or other
  misc_feature (380)..(380): n is a, c, t, g, unknown, or other
  misc_feature (381)..(381): n is a, c, t, g, unknown, or other
  misc_feature (411)..(411): n is a, c, t, g, unknown, or other
  misc_feature (453)..(453): n is a, c, t, g, unknown, or other
  misc_feature (460)..(460): n is a, c, t, g, unknown, or other
atagctggagctccccgcggtggcggccgctctagatcccgtggatcccccgggctgcaggaatttgtctcacccctaatcgaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtgnagaggtcgtttgctgagaagcactacgccgatctcgcctccaagcccttcttccagggcctcgtggactacatcatctctggccctgtggtggccatggtctgggaggnnaagagcgtcgtcacaactggccgcaagatnatgggcgccagttcccccctggcttctgagcccggcaccatncccggcnactttgctgtcaacattgacaagaatgtcattcatggaagtgacaccattgagagtgctaataaggagattgccctgtggttccccgagggccctgctgattggcagagctaccagcacccctggatcaaccaaaagtaaacatggaaagtttcccatcaaaccttgacagcccaaagaaacatgtcaccctttgttgttttaccaagggtttcaaaaagattatgatctgtatccttgagaactttaattctaatggacgcaatctccctccctttggcaaggttattgcgttggggaaaaatataaaaa

SEQ ID NO: 48530 - protein, 149 aa, Zea mays
  misc_feature: Ceres CLONE 1457919-F
  misc_feature (2)..(134): Pfam Name: NDK Pfam Description: Nucleoside diphosphate kinase
  misc_feature: SWISSPROT Homolog: EC 2.7.4.6 Nucleoside-diphosphate kinase
  misc_feature (41)..(41): Xaa is any aa, unknown, or other
  misc_feature (77)..(77): Xaa is any aa, unknown, or other
  misc_feature (87)..(87): Xaa is any aa, unknown, or other
  misc_feature (101)..(101): Xaa is any aa, unknown, or other
  misc_feature (104)..(104): Xaa is any aa, unknown, or other
MESTFIMIKPDGVQRGLIGEIISRFEKKGFYLKALKLVNVXRSFAEKHYADLASKPFFQGLVDYIISGPVVAMVWEXKSVVTTGRKXMGASSPLASEPGTXPGXFAVNIDKNVIHGSDTIESANKEIALWFPEGPADWQSYQHPWINQK

SEQ ID NO: 48531 - DNA, 746 bp, Zea mays
  misc_feature: Ceres CLONE 1457920-F
  misc_feature: Encodes the peptide sequence at SEQ ID NO. 48532
aagctggagctccccgcggtggcggccgctctagaactagtggatcccccgggctgcaggaattcgtctcacccctaatcgaaaaagagaaacacctctgagcattctaaagctcatagccctctccttccagagcatttcacatcgctctcatctccacctgcttgcatccagcgcctcgtcactctgcaaaacaacagcacatacctccaaaggatgagccgcagcaacaggaagagctctaggggccttgacctgaaactgaacctctcacttcctgcaacaggggactcctccaggagggcgatggctgatgaggagtcatccccgagctcctgcctatcgtcagagaacgagcatggcctgcagtggtccaacagccctgaggccacatccatggtacttgctgcctgccctccctgctacatctacgtcatgcatccacaagatgaccctcggagcccccagtgcaagagccctgttctccttgactttctgcaggacaacaccaactgctgtaagaacaacagtaatcatagctgcaggaggagcatgaggcgatgagctatatggttccatacgcggcacgacatcaagaagaaaagttatatgaagtcctaggtccagtaattctatatgcctagtcatttcttcagtggatctgtgatatatccattctaaacttgcgaagctagcaccgtgcgttagtatcacaattttgatatatccccgataccccgactgag

SEQ ID NO: 48532 - protein, 115 aa, Zea mays
  misc_feature: Ceres CLONE 1457920-F
MSRSNRKSSRGLDLKLNLSLPATGDSSRRAMADEESSPSSCLSSENEHGLQWSNSPEATSMVLAACPPCYIYVMHPQDDPRSPQCKSPVLLDFLQDNTNCCKNNSNHSCRRSMRR

SEQ ID NO: 48533 - DNA, 812 bp, Zea mays
  misc_feature: Ceres CLONE 1457921-F
  misc_feature: Encodes the peptide sequence at SEQ ID NO. 48534
  misc_feature (195)..(195): n is a, c, t, g, unknown, or other
  misc_feature (271)..(271): n is a, c, t, g, unknown, or other
  misc_feature (382)..(382): n is a, c, t, g, unknown, or other
  misc_feature (420)..(420): n is a, c, t, g, unknown, or other
  misc_feature (426)..(426): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (445)..(445): n is a, c, t, g, unknown, or other
  misc_feature (451)..(451): n is a, c, t, g, unknown, or other
  misc_feature (461)..(461): n is a, c, t, g, unknown, or other
  misc_feature (648)..(648): n is a, c, t, g, unknown, or other
atagctggagctccccgcggtggcggccgctctagatctagtggatcccccgggctgcaggaattcgtctcacccctaatcgaaaaacgtccaaaaaccaaccaaagcacacacacactctggccggccaccacgccctcctctgcctccgctgacgccgagggcgcccgcagcaaacgcaaaagaggctcgtcngccgcatgcgcatccgacggcagcgaccagcagggcccgtcctcccactggctgacgccgcgcgcgggggaggcanacgccaccaagctcctccaggcgctgcgcctcgcggcgcgcggcactggcacacccacctgcaccgcttccgccccaagagtgcgcgatgggggtttttgtggtgttgtanaagaggggcgggggtgggtcgttgttgtataatatgtnccgtanccccccnnnaannnaaaanaaaaanaaaaaataanacaccccccccccccccccccaacacacaagcaccaccgagaccgcggtattgggctgtaacaagaaaacacgcgacgccgccgcaatgtgctggtggggaggtgcaacctgcgcgtgctctaacccagccccggtgggaccctcccccacaagctaacgtccatctgagtggaccgtcgaccgagntcccctccatccaacctagcaatgtctacaaagcggcaaaggctgcgggtctctatagcaggttccgactctcacacgttatccatatcaatagcgcccggttctaggtatgtataggtcttgtgcgctggcgcagcgtgcgagtcgctctcttattgtggtgg

SEQ ID NO: 48534 - protein, 137 aa, Zea mays
  misc_feature: Ceres CLONE 1457921-F
  misc_feature (91)..(91): Xaa is any aa, unknown, or other
  misc_feature (128)..(128): Xaa is any aa, unknown, or other
IAGAPRGGGRSRSSGSPGLQEFVSPLIEKRPKTNQSTHTLWPATTPSSASADAEGARSKRKRGSSAACASDGSDQQGPSSHWLTPRAGEAXATKLLQALRLAARGTGTPTCTASAPRVRDGGFCGVVXEGRGWVVVV

SEQ ID NO: 48535 - DNA, 766 bp, Zea mays
  misc_feature: Ceres CLONE 1457922-F
  misc_feature: Encodes the peptide sequence at SEQ ID NO. 48536
atagctggagctcaccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaaactgttgagtactatgctaagctgaggagctgcattcacatcatgtggtgaagcgcgagggaggcttctttatcggacagctcacttgtcaccgacgcaatcaggcaccccccccagccgtggactaccctgggttttgcctttggccatagaaccgcccgctgtgttttgcctaaagccataaccgaacctagaaaaaccaagtaccttttaaatcccaatggatccccccccctccagaaactttgagagcccctcttgaaaataggccccagaaaaaacccctcttctaaaaaaaaaaaaaaaaaaaaccgggcccccccgagagaccccccaattcccc

SEQ ID NO: 48536 - protein, 73 aa, Zea mays
  misc_feature: Ceres CLONE 1457922-F
IAGAHRGGGRSRTSGSPGLQEFVSPLIENKWERQRFGLQGGFVTNPLAEPNISSAGKTMVTHEGRKKDKTLQK

SEQ ID NO: 48537 - DNA, 724 bp, Zea mays
  misc_feature: Ceres CLONE 1457923-F
  misc_feature: Encodes the peptide sequence at SEQ ID NO. 48538
  misc_feature (495)..(495): n is a, c, t, g, unknown, or other
  misc_feature (724)..(724): n is a, c, t, g, unknown, or other
aaagctggagctccccgcggtggcggccgctctagaactagtggatcccccgggctgcaggaattcgtctcacccctaatcgaaaactcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactngtgactcctacgaaagtggaaaactggctagacttctaaacatcggagtcaaagacgaccctttgagtgacatgctacatcggtcagcctgttcgtttggtttcaatcccgtaccggcttctactacttccaaaatgggttttgccccaagggaatacgcctacaacagcctaaaatagctgaatttatcccgaagggaaaagcccaacctgtctcttgtgttttggtn

SEQ ID NO: 48538 - protein, 173 aa, Zea mays
  misc_feature: Ceres CLONE 1457923-F
  misc_feature (44)..(108): Pfam Name: Glutaredoxin Pfam Description: Glutaredoxin
  misc_feature: SWISSPROT Homolog: EC 1.11.1.15 Peroxiredoxin
  misc_feature (115)..(115): Xaa is any aa, unknown, or other
MVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTXDSYESGKLARLLNIGVKDDPLSDMLHRSACSFGFNPVPASTTSKMGFAPREYAYNSLK

SEQ ID NO: 48539 - DNA, 736 bp, Zea mays
  misc_feature: Ceres CLONE 1457928-F
atagctggagctccccgcggtggcggccgctctagatctagtggatcccccgggctgcaggaattcgtctcacccctaatcgaaaacaatggcgagaggcagacgtttgggctatggggtgggtgtgtcacagacccattatccgagacgagcatttcatctgcatgcaaaacaatggttactcatgaacgtcggatgaacgataaaagtttacaaaagtgaagggtgggttagatatgatgaagacattctgttccaagcatgaactgctcgagtttgcttatatcatgaagacgctgaattctctattcgacgagacctctttttctctaagaaagaacataggcttttagactcttctgaatatgcctgaccggactaggattgttgagtccccgaaccccacctttaaggcaaaatttcttaaaagcgaataaatctggggggagggaaagaaggtttttaatgaaaaaattttgggaaggatttgggaccctccaaaccggcccttgggggtagaattggaaaaaacccccctgttttttttaaaatcttcccctttaaaacccggggatataaaaccttttccccccccccagaaattttgggcgcctttataaaagggggagaactttctttaaagaaaaaaaaaagcgaggggggggggccccccccccccgggtgtttgtagaggcccctctccccctttttttttttttgggaaaaaaacaccccc

SEQ ID NO: 48540 - DNA, 728 bp, Zea mays
  misc_feature: Ceres CLONE 1457929-F
  misc_feature: Encodes the peptide sequence at SEQ ID NO. 48541
aaagctggagctccccgcggtggcggccgctctagaactagtggatcccccgggctgcaggaattcgtctcacccctaatcgaaaagtcgatctttgcatggcagcagcagctggctccaaggggcgggcgatcgctgaaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtgttcggcccggcggcggtggaccccaagctggccgctgggtggcgcgcggacgccggcgcggatgctgcaggaggcacggtgctggaccagaaggtgtggtttccgcccgctcgaggacgtcgagaagccgcccccccgcgcgtgagccgcgcggcgctgctaggccagcccacactgctgctccctcataaaaaagggcgccggaaaaccctggcaatgccaggccctctgctccgggccggcggggctgggctccccgccttttcccctccaatttttaccccctcaaaggggggccttgaaaccaggggggggtttggccaaaacccaaaaaaaacggggccccctaaaaaacacacctactcggggtggggtgctcaaaagactgggtgtgaaatcaccccccgggtc

SEQ ID NO: 48541 - protein, 210 aa, Zea mays
  misc_feature: Ceres CLONE 1457929-F
MAAAAGSKGRAIAESFVSRVLAGKAASPRRAVHASAYDKNLEDQVRPAFVPDDVIGSAGSPDKYWSPHPKTGVFGPAAVDPKLAAGWRADAGADAAGGTVLDQKVWFPPARGRREAAPPRVSRAALLGQPTLLLPHKKGRRKTLAMPGPLLRAGGAGLPAFSPPIFTPSKGGLETRGGFGQNPKKTGPPKKHTYSGWGAQKTGCEITPRV

SEQ ID NO: 48542 - DNA, 754 bp, Zea mays
  misc_feature: Ceres CLONE 1457930-F
  misc_feature: Encodes the peptide sequence at SEQ ID NO. 48543
  misc_feature (680)..(680): n is a, c, t, g, unknown, or other
atagctggagctccccgcggtggcggccgctctagaactagtggatcccccgggctgcaggaattcgtctcacccctaatcgaaaaactataaaatgccctcgcggcctcacctccattattgccatccatcacatcctctcccaccttactcaagctagtgcgagcatagcaatggggttcgcccggaagagtggagttgcagcagtaggggtttggtggctcctcctgctcgccggcgtgctgttgcctttggcggcggcatttggccggcacgccgatgccggcaacgacatgtgcgacatcaagtgccagcatcacagcgacccggccaggaggcagcagtgcgtggatgagtgccatagccgggagcaccatcaccctagcagagagttttgcgagatgaagtgccagcaccaccaggaccctgcaaggaaagagatctgcgtacagcagtgcatgagctatggtctcagccaccgtgcgagtgccagtgttgttgatgagggtgaaaagcgcttccatggctgggaaacgacggtggccggaggaatcctcgaggcggtgtgacgacgtacgacgttatataacagtacgtcataattaataaaataagctacacccgcgtttcccttatatatatgtcttgctatgcatagagatatcatgggcaaggcatangaataaagtgcgtgcgatatgcatgtacgtgcatgttcgtagtaatcttacagagattacgcagaaatttttat

SEQ ID NO: 48543 - protein, 131 aa, Zea mays; identical to SEQ ID NO: 16978
  misc_feature: Ceres CLONE 1457930-F

SEQ ID NO: 48544 - DNA, 738 bp, Zea mays
  misc_feature: Ceres CLONE 1457932-F
  misc_feature: Encodes the peptide sequence at SEQ ID NO. 48545
  misc_feature (377)..(377): n is a, c, t, g, unknown, or other
  misc_feature (398)..(398): n is a, c, t, g, unknown, or other
agaagctggagctcaccgcggtggcggccgctctataactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttgtgaaagnatggcgtgcgcgtgaactatnaatgtatgagtcacccccacaccccaactgtttgagtactatgctaagctgaggagctgcattcacatcatgtggtggagcgcgagggaggcttctttatcggacagcctcacttgtcaccgacgcaatcaggcacccccccaagccgtggactaccctgggtttggctttggcatgagaaccaccgctgtgtttgtcataagtcatatcgtaactagaaaaacaagtagctttataatcacaatgtatcaccctccctacaaaactatgggatgcgtcttgtacataaccccgaaaaaagcgcttctcaacaacaaaaaaaaaaaccaacacgttcgag

SEQ ID NO: 48545 - protein, 73 aa, Zea mays
  misc_feature: Ceres CLONE 1457932-F
EAGAHRGGGRSITSGSPGLQEFVSPLIENKWERQRFGLQGGFVTNPLAEPNISSAGKTMVTHEGRKKDKTLQK

SEQ ID NO: 48546 - DNA, 745 bp, Zea mays
  misc_feature: Ceres CLONE 1457935-F
  misc_feature (375)..(375): n is a, c, t, g, unknown, or other
aaagctggagctccccgcggtggcggccgctctttcctagtggatcccccgggctgcaggatttcgtctcacccctaatcgaaaaatcacttatcatccccatccgcacctctctccatctccctgctcctccgcctccttcttgatccaggcaagccagggatcgccatgtcagactcggaggagcaccacttctaatcgaaggccgacgccggagcgtccaagacctacccgcagcaggctggcaccggcggtaagaacggcttcatcgtcatcaagaaccgcccctgcaaggttgtggaggtttctacctcaaagactggtaagcatggccatgccaaatgccactttgttgccatagacatattcaacggnaaaaacctcgatgatattgttcattcgtcacacaaccgcaacattcctgatgtgaaccgtactgagtaccatctgattgatatatcataggatggatttgtgagccttcttacttatcatggacacactcatgatgatcttagactctcaactgatgatactcttgtggctcacatcaacgaacggtttgaaagcggccaggatcttgttgtgactgcccagtctgattcggggaggagcaaaccttctcgctgaaagatgtgggccccaggaacatcctgccttggatagtgtttctcaaatctaaatcgaacaacgagtgttttagggattgctactcagacatctgttgggaatgcactggattttg

SEQ ID NO: 48547 - DNA, 776 bp, Zea mays
  misc_feature: Ceres CLONE 1457936-F
  misc_feature: Encodes the peptide sequence at SEQ ID NO. 48548
  misc_feature (266)..(266): n is a, c, t, g, unknown, or other
  misc_feature (367)..(367): n is a, c, t, g, unknown, or other
  misc_feature (370)..(370): n is a, c, t, g, unknown, or other
atagctggagctcaccgcggtggcggccgctctagaactagtggatcccccgggctgcaggaattcgtctcacccctaatcgaaaactctctcacacacacagtcacacacacaccgtcctccctccttggtccttggctccccttgctaccttgccttcacagatctcccgctccccaacagaactgtcacgtctcgacgcccgggggccgtggtattacggctcgtcgcggctcggcggtggtggcgcgcagctgaccggatcnagcagcggatggacggcggcggcgggctgggcggcctgcggtggaccgcggaagaggcgtcgacgatcggaggcatcgccacggtgtcgctgctgcactcnttnatacccacgcactggctccccttctccatcgtcgcgcgcgctcacccctcgccgctctcccgcacccttctcgtcactgcatttggaggtgttcttcatgttgtttctacggctcttcttgggataactgcagttactatgggaaatactataagctggcgaagaaacagtgcataaacttgccttcgctgttgctgaatttttcttggacaaagttatattcttctttgttggccttaagaaaaaggggtcatagccatgcccataaatcatccaatggaaaaaaatggcaatcccccgggctttgtacttggttcctggattaatcactcttggggcaaaaacctctctcaaattttctcttgctgtttgggccacctcctctctccaataaatgaatcattgg

SEQ ID NO: 48548 - protein, 90 aa, Zea mays
  misc_feature: Ceres CLONE 1457936-F
  misc_feature (32)..(32): Xaa is any aa, unknown, or other
MDGGGGLGGLRWTAEEASTIGGIATVSLLHSXIPTHWLPFSIVARAHPSPLSRTLLVTAFGGVLHVVSTALLGITAVTMGNTISWRRNSA

SEQ ID NO: 48549 - DNA, 901 bp, Zea mays
  misc_feature: Ceres CLONE 1457942-F
  misc_feature: Encodes the peptide sequence at SEQ ID NO. 48550
  misc_feature (436)..(436): n is a, c, t, g, unknown, or other
  misc_feature (437)..(437): n is a, c, t, g, unknown, or other
aaactggagctccccgcggtggcggccgctctagaactagtggatcccccgggctgcaggaattcgtctcacccctaatcgaaaaaaaaacctaacaaaacccccacgccgcaatcaaataaataaataaaaacacgccgccaccatctccggcgatgtcgcgcttcgggcgctccgggcagccggagaaccgcgaatctttctccctcctcgtcctcaacgtctccttccgcactacggctgacgacctcttcccgctcttcgatcgctacggcaaggtcttaaacatctacatcccgcccgaccccaggactggggatccgcgagggttcccggtccggaaggaccattgggaagggggagggggagggggcgccccccgggctttgatgggaatgaggtttgatggggaaccgaacctgtcccccccaaaaannaaaaaataggaccccaagggctaaaaagaatttactagggggtccaacatccccgagaaaaaatctccaaacgccaaggggggcctgctgtgggaaaacggcccatttcccaagagccaagagcccacctcttttgagatagggttttgaggaggggagttctactcgcgggtgagagacgcttctttgggagggcgctcacccctcgagccagaaggatgggggggagggatataatgagctgggcggccggcccacacacagcggggtggtcagcacctgctcaccacaagacgcgtgtaccatctctcctctccacgcttttactttcaccgtccgcttccacctttgagtcccccggcgtccccccccgaacatgtaacattgcccgccctgtagcatgagatgtgtgggcctcccaccgccgaggggggcctcctcggcgagtcatgtcgctaccaggg

SEQ ID NO: 48550 - protein, 96 aa, Zea mays
  misc_feature: Ceres CLONE 1457942-F
  misc_feature (94)..(94): Xaa is any aa, unknown, or other
MSRFGRSGQPENRESFSLLVLNVSFRTTADDLFPLFDRYGKVLNIYIPPDPRTGDPRGFPVRKDHWEGGGGGGAPRALMGMRFDGEPNLSPPKXKK

SEQ ID NO: 48551 - DNA, 721 bp, Zea mays
  misc_feature: Ceres CLONE 1457945-F
  misc_feature: Encodes the peptide sequence at SEQ ID NO. 48552
aaagctggagctccccgcggtggcggccgctctagaactagtggatcccccgggctgcaggaattcgcacgagaccattacctagaacatcctaatcgaaaaaaacccgtagcgtctctgatctctctcgtgactcccggtccggaggagcacaggcatggagctggagcagaagccgccgccgccgccggcggggtactggagcggcgtggcgggcgggcgcccctgcgacgcgtgcgccgcgcggccggcgcggctgcactgccgcgcggacggcgcgttcctgtgccccggctgcgacgcgcgggcgcacggcgccgggtcgcggcacgcgcgcgcgtggctgtgcgaggtctgcgagcacgcccccgccgccgtcacctgccgcgccgacgccgccgcgctctgcgccgcctgcgacgccgacatccactccgccaactcgctcgcgcgccgccacgagcgcctccccgtggcgcccttgctcggcgcgctctccgacgcgccggcgccgcagcacttcccctccgcggcggcggcagcgggggaagaagcgtcggcggcggaggaggaggacgggagcgacgaggccgaggcggcgtcgtggctgctccccgagcccgacaacagccacgaggacagcgccgccgccgactcattcttcgcggagccggacgcgtacctcggcgtcgacctggacttcgcgcggtgcgtggacggc

SEQ ID NO: 48552 - protein, 188 aa, Zea mays
  misc_feature: Ceres CLONE 1457945-F
  misc_feature (64)..(106): Pfam Name: zf-B_box Pfam Description: B-box zinc finger
  misc_feature (19)..(63): Pfam Name: zf-B_box Pfam Description: B-box zinc finger
MELEQKPPPPPAGYWSGVAGGRPCDACAARPARLHCRADGAFLCPGCDARAHGAGSRHARAWLCEVCEHAPAAVTCRADAAALCAACDADIHSANSLARRHERLPVAPLLGALSDAPAPQHFPSAAAAAGEEASAAEEEDGSDEAEAASWLLPEPDNSHEDSAAADSFFAEPDAYLGVDLDFARCVDG

SEQ ID NO: 48553 - DNA, 775 bp, Zea mays
  misc_feature: Ceres CLONE 1457945-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
nnnngggcgattgggtaccgggccccccctcgaggtcgacggtatcgataagcttttttttttttttttttggatggtaatgtacaaggacgagtggattaatttacagtgatgtcggaggaccgacaagggttgcagtagctccacgcgaaacgcgactgttgagttcgtccatcgaacagctacacaccgttattcatgctacacgtagctcgcgttcagaatttcagatcaaaagagaacaaaacggagctcaagttcagagtggacagagctggcaaaaacctaaggaaagaagtcgtcgtcgccgggcagccgactctctcctcaacacaaggacgggacgacgccgtccgacgacgccgacgctgaccccgcgggcgagaagcacgccggcttcctcgtgctccagcgcgtcgtcgtcctccgagcaccgcttggcgaagcggcccttgacgcgcggccgcgtctcggcgtacgccttgcgggacgcgtagcggatggtcttgtcgaaccgccggatcttccgcttctcacggtaccgcatcagccgcgcctcccgcgtcttccccctgctcaacgccaactcagaggacgacagcacctgcacgatctccacagggaataaaaaaggggaacaatgcttttcgagggatacgggaaataccatgcgtggtacaaataaacctaattgagcggaggtactaagggctttaacgctcgtgggttcattgcagtgttttgggggggggttaataaaaaagcctgccccggc

SEQ ID NO: 48554 - DNA, 737 bp, Zea mays
  misc_feature: Ceres CLONE 1457947-F
tggagctccccgcggtggcggccgctctagaactagtggatcccccgggctgcaggaattcgcacgagaccattacctagaacatcctaatcgaaaaaacgaccttctctaggaagttagctgccccagctaacttcctacgacctactctaggatgttatcttttagcttttgaccagtcaaacgagccgctaacttcctagagtatatgtacaacctctaggaagttaagtaacttcctatgactttactctaggaagtaatatttttatcctaatctacgaatttaacgttatctttccatcgttcatcctttcttctccaacacccgtcgctctcttctccaactcgaagatgtcggccgccaccgccctgcttcatcgaggcccaagacccgatctctgtccctgataaagaaaccaaacaacaacctagcagtcttccttcacttctctgcttccgacctcgtagcgaatcagatcggggggctagggttccggtgcgcctctacaactggacgcgaggctaggctgggcatggagggaatcgtcacggcctgaaagaggtcccggccggagacgacgaacggggttgcagccgccgggaagcgctacaaagatcagtgtggacgcctctctggccggttgcataatcgacaagggtggggtcaacactaagcagagttacaggcgtcaagctatccatccgcgaccacgagtctaaccccaacctaaaga

SEQ ID NO: 48555 - DNA, 796 bp, Zea mays
  misc_feature: Ceres CLONE 1457949-F
  misc_feature: Translation starting site: 183
  misc_feature: SWISSPROT Homolog: EC 2.7.12.2 Mitogen-activated protein kinase kinase
atagctggagctccccgcggtggcggccgctctagaactagtggatcccccgggctgcaggaattcgcacgagaccattacctagaacatcctaatcgaaaaacacactcgctttcttcggttcttcctcctcgagcagccacttccgtctctaaccctacagcgactacgagagcgaggccatgaaggggaagaagccggtcaaggagctcaagctcaccgtgccggcgcaggagaccccggtagacaagttcctgacggcaagtggcacgttcaaggatggtgagctgaggctcaatcagagcggcttgcggcttatctctgaggaaaacggggatgaagatgaatctacaaagctgaaggtggaagatgtgcaattatcaatggatgatcttgagatgattgaagccaccacccttcggaagcggcggtgttgtccagctagagaggcacaaatggatgggcacattatttgccttacagggtattcaaatgaccattcccgactcctgtcgtagacaaattttacaggagctcagaataaaccaagcaacacagaggcctcatatagttatgtgccgtcaatctttttaccccgatggctgaagacatctttgttccttgagtagtgcacccccgatccttttgcagacccttgtatatcaggtgcaccaatttgtctgaaatcctaaccttcgccggtgtttgtaacccacggtcttgccagggctccatcgaatgggttatcgcccaccagtgaccacattttcgggccgcgctttcctatgctcttttt

SEQ ID NO: 48556 - DNA, 728 bp, Zea mays
  misc_feature: Ceres CLONE 1457950-F
  misc_feature: Encodes the peptide sequence at SEQ ID NO. 48557
  misc_feature (489)..(489): n is a, c, t, g, unknown, or other
aaagctggagctccccgcggtggcggccgctctagaactagtggatcccccgggctgcaggaattcgcacgagaccattacctagaacatcctaatcgaaaaaccaaaccaaatcacctgttcccgcgacctcctccccggcgtacctccagtctccagagatccacacgaccacaccgacccaccaccatctgcatcggcaatggacgccgcgccacccaccataaccaagtccccgccgtccctggttccaccagcggggcccactcccggtggttccctcccgctctcctccatcgacaagaccgccgccgtccgtgtctccgtcgacttcatcccagtcttccccgcccctacgtcggggaaggaggactggagcccctcatctgcgatcgcggccatgcgcgagggctttgccagggcgctcgtggcgtactaccttatcgcccggcgcatcgccgaccccgtgcctggtgagcctgaaatgantgcacgggggaagggttgtgtttcgggaagctgaggcaagctgctccttcaaggaggcgcgaaacctcaggcgccgctggggattccaaaggagaatttgttcccgttcccccgggcgggggtgccgtggaagaacaccctgtgctccccaagggtaaaaatttccagggggggggttttcctgggggaatttttccccccccttggggttccaggggagggttgtgcgcaatttttag

SEQ ID NO: 48557 - protein, 106 aa, Zea mays
  misc_feature: Ceres CLONE 1457950-F
  misc_feature: SWISSPROT Homolog: EC 2.3.1.162 Taxadien-5-alpha-ol O-acetyltransferase
  misc_feature (96)..(96): Xaa is any aa, unknown, or other
MDAAPPTITKSPPSLVPPAGPTPGGSLPLSSIDKTAAVRVSVDFIPVFPAPTSGKEDWSPSSAIAAMREGFARALVAYYLIARRIADPVPGEPEMXARGKGCVSGS

SEQ ID NO: 48558 - DNA, 762 bp, Zea mays
  misc_feature: Ceres CLONE 1457952-F
  misc_feature (421)..(421): n is a, c, t, g, unknown, or other
  misc_feature (762)..(762): n is a, c, t, g, unknown, or other
aaagctggagctccccgcggtggcggccgctctagaactagtggatcccccgggctgcaggaattcgcacgagaccattacctagaacatcctaatcgaaaaactgctgtcctcgagaaagggccatgggcttaaggagtacccacagatttcgatgctagagtcacctggatgacccgtagcgggaatcatcttgccccacactcttgagtggaaccgacagtatatgactactctctttgacctctgacatgctgagatgccttgcagacattctatgtggtcttgaagctctgagctccataatcaacgacagactaatcctttatgatccatgcggacgcctatattaaccgggattctgtgtggttgacataactaattgttctttccaacacacattttttctcgccccccaccncacccatcgggcctggggtaatgctgaatatatgggttccgccacagctatgggccttttggttaccccggtcttaggacccaatatctaaattaagcaccttggacttaacctgggtttccaattaacaaaaaataccttttgaactgaaacttcctccccctattttaagggcccgggccccaccgccttttgggtgttctcccccaaaaattttcccacttttttaatttgcctttcacactccccccggaaaaaaaaatattcctcttttatttccgataaccccattttttatatttcgcccctaaacaaaagcggtgttccccccattttccgtn

SEQ ID NO: 48559 - DNA, 885 bp, Zea mays
  misc_feature: Ceres CLONE 1457952-R
ccgattgggtaccgggccccccctcgaggtcgacggtatcgataagcttttttttttttttttttgaaaaacccttttaccccatttcttaccccaccactttttgcaaacccctctccgtttagtactttctacgatacaaacctctttttttccccgatgggttggggaccgcctaacaaaacaaaaagccaacccggatgaccaaacttctcaaaaggccaaccccgaaaaccggggggttcggctaggggccctactcagggaaaatgtcccaatcctaacaagacccagctaaaaaggttaacccctgtaaaaagggggcctgggaccggcccaatctgcaggttctgcccccccgtttgccaaccccaacggggccccagggaaaaggaaaactttcttgcgataacacccgggaaaaacccaacatagcaggttttcaaggcccccccccaatggcggaagacccggtacaaaataagcagaaaaaacttccccctcccaaaaaaaaactttttagctccagccccaggcttttggaaccccaatctctgaaacaggggcaacccaaaatcggggtcctccaaaaatctgggctgttatccctaatccagtgttgcgtccgaaaccccttttaaaaactacaaaaaattccccgcgaattcccccaaatggaagggagcgtccccgggaccctttcacttttgtctgcgcggggttcctgggccaccggggttgttggtgggaaaatttgggataaccccgcaaaaaccccccccccccaaaaattaaaaatataaggggcccccaaaaaccgggggtacccccatggggccccataggcctttaccctagcccctaattatccccggctttggcccc

SEQ ID NO: 48560 - DNA, 756 bp, Zea mays
  misc_feature: Ceres CLONE 1457954-F
  misc_feature: Encodes the peptide sequence at SEQ ID NO. 48561
  misc_feature (756)..(756): n is a, c, t, g, unknown, or other
aagctggagctcaccgcggtggcggccgctctagaactagtggatcccccgggctgcaggaattcgcacgagaccattacctagaacatcctaatcgaaaaatgtccttcaactccaccaacaggtgatgcccccggcttaattgaatgggctctcttctcaccaggactggcatcctgccatggctccaggccaagatcgttgatcccgtgctgcaggtcatcagaaggggagcagaacccaagcaactggccttctctgctgccctcggtgtcacgattgggatctttccgatatgtgggaccactgttattcttggtgctgttgttgtagcaatgttgggaagtcgttgcaatgctgttactcttatggttctaaatttggccgccactccaattgaactaagcttgatcgtccctttcttgcgtttgggtgaagccgtcactggcagcgggcacttccccttgacagccgacgcattgaagaatgttctcaccggtcatgcctcaaaggatgtgctaatgagcatcgtccatgcgatgctgggttggcttattgctgcaccaattgtactggtcgtgctgtacgccgtttcgttcccttgtttcaaggtcctggtcaacaggtttggtggtattccttcgagccccaggaccccaatcaaagcggtgtagccagtgcctggccggatcctctgcagttacatccgtggacatagctgcagatgtgtcgctgacatccggggccggccgtggn

SEQ ID NO: 48561 - protein, 175 aa, Zea mays
  misc_feature: Ceres CLONE 1457954-F
MGSLLTRTGILPWLQAKIVDPVLQVIRRGAEPKQLAFSAALGVTIGIFPICGTTVILGAVVVAMLGSRCNAVTLMVLNLAATPIELSLIVPFLRLGEAVTGSGHFPLTADALKNVLTGHASKDVLMSIVHAMLGWLIAAPIVLVVLYAVSFPCFKVLVNRFGGIPSSPRTPIKAV

SEQ ID NO: 48562 - DNA, 725 bp, Zea mays
  misc_feature: Ceres CLONE 1457956-F
  misc_feature: Encodes the peptide sequence at SEQ ID NO. 48563
  misc_feature (486)..(486): n is a, c, t, g, unknown, or other
aagctggagctccccgcggtggcggccgctctagaactagtggatcccccgggctgcaggaattcgcacgagaccattacctagaacatcctaatcgaaaactccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggcccgcagatcattggcgccaccacccccctggcttctgagcccggcaccatcgtggcgactttgctgtcnacatggcagggttgtcatcctgggaaggacagcattgaaatggtaataagggaaatgccctgggtgtccccaaaggccctgcgaattggaaagccccccgccccctggtttccccaaaaataaactggaaaggttccctccaacccttgagacccaaaaaacgggccccctttgtggtttaaaatgttttcaaaaaaattaaatttttttttggacacctttttggggggcaatttttt

SEQ ID NO: 48563 - protein, 147 aa, Zea mays
  misc_feature: Ceres CLONE 1457956-F
  misc_feature (2)..(134): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVVAMVWEGKSVVTTGPQIIGATTPLASEPGTIVATLLSTWQGCHPGKDSIEMVIREMPWVSPKALRIGKPPAPWFPQK

SEQ ID NO: 48564 - DNA, 728 bp, Zea mays
  misc_feature: Ceres CLONE 1457962-F
  misc_feature: Translation starting site: 295
  misc_feature (664)..(664): n is a, c, t, g, unknown, or other
aagctggagctccccgcggtggcggccgctctagaactagtggatcccccgggctgcaggaattcgcacgagaccattacctagaacatcctaatcaaaggagcagggcaggggttgcgtctcagttcctggttgtgttgttgtaagctcccaggtttcttctcttcgcgtgagctagctagactagagtgggatcgcgaggaagaaggatgtcgtgctgcggaggaaactgcgggtgcggcagcggatgcaagtgcggcagcgggtgcggagggtgcaagatgtaccccggacatggctgagcaggtgaccaccaccaccaccatcatgggtgttgcaccatccaagggcgggttcgaaggcggccgccggaagctgagaacggcgggtgcaagtgcggcgccgccagctgcaccctgcgacccctgcaccctgcaagtgaggaatgacccgggtgcagcatgcaggccgtgacgaatggaggaaagtaaatcggaaggaccacccttcagtatctcctagctaaatcaagctctgagagtatgttgtagcagcgtcgtctgtgtttgccgccatgcgtagctagctagctagtggtggtaaacgaataattgtcctgttcttcttcctcctccgcccctgccagtgtttgcgtcgtgtgggnccggccgggtgcatgcacagcaccaggccatgcccgcttgctatgtaagtgctcgagccagtac

SEQ ID NO: 48565 - DNA, 880 bp, Zea mays
  misc_feature: Ceres CLONE 1457972-F
  misc_feature: Encodes the peptide sequence at SEQ ID NO. 48566
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (475)..(475): n is a, c, t, g, unknown, or other
  misc_feature (476)..(476): n is a, c, t, g, unknown, or other
  misc_feature (478)..(478): n is a, c, t, g, unknown, or other
  misc_feature (528)..(528): n is a, c, t, g, unknown, or other
caatttgtaaacccccaaaaacccaaaannncncnnnnnnccaaaactggcgctccccgcggtggcggccgctctatttctagtggatcccccgggctgcaggaattcgcacgagaccattacctagaacatcctaatcgaaaaacatactacctctatctgcaatgcaaactcctattagcttgcaagcaaaagacatacgaaatgagaaggttaaagttttgcgctccatgaagccattgcgactagaagatgtggtaataggacaggataaaagtcatacaaagggtggtattgcatacggtggatacactgaacataagacggtgcccaaggggagtctgactccaacatttgctgcagctgccctttttataaataacgctagatgggagggagttgcctttggtaggaagggctggaaaaggtttggatacttaacaggttgagattagacccccctgtgctcccccannanaggaaaatataataaaggagtactgttgggaaccggaccctggaacaagnaaactaaatgaaacttgtgtatacgtggggcaatgcttgatgaaggggattttaccgttgaggagtagggagacaaagatttccttggggtcgtgggctttggagcactcgtatgaagggaacagatcggagaggcttttctccatggcgtgcaaggggaaccccgacaggaggatatccagaatggcaaatctataaggcttcccggcttcgggcgtgaagtgataggagatgcgaagggttcttgtatcctggttggaacaacctgggacgcgggcaagggggagttcttcaaaggctccttcctggaggggactggggacagaagggggatgggccctcgcaggtatgg

SEQ ID NO: 48566 - protein, 94 aa, Zea mays
  misc_feature: Ceres CLONE 1457972-F
  misc_feature: SWISSPROT Homolog: EC 1.1.1.49 Glucose-6-phosphate 1-dehydrogenase
MQTPISLQAKDIRNEKVKVLRSMKPLRLEDVVIGQDKSHTKGGIAYGGYTEHKTVPKGSLTPTFAAAALFINNARWEGVAFGRKGWKRFGYLTG

SEQ ID NO: 48567 - DNA, 720 bp, Zea mays
  misc_feature: Ceres CLONE 1457973-F
  misc_feature: Encodes the peptide sequence at SEQ ID NO. 48568
aaagctggagctccccgcggtggcggccgctctagaactagtggatcccccgggctgcaggaattcgcacgagaccattacctagaacatcctaatcgaaaaacgcgcttcctctcgccctcgctcctccgccgccgccgccgccgcatcaagcccccgccccgccgtcgcctgaggtagacaccaatccgccgccatggggcgtatgcacagccgcgggaagggtatctcatcgtcggcgcttccctacaagaggacgcctcctacctggctcaagaccgctgcctccgacgtggaggagatgatcacaaaggcagcgaagaagggacagatgccgtcgcagatcggcgtcctgctcccgtgacagcacggtatcccccttggtcagagcgtcaccggcagcaagatcctcccgcatcctcaggcccatgggctggcacaagaatcccccaggacctggacttctcatcaagaaggcgggggccaataggagcccctttggaaggacgggaaggacaaaacctctaaattgggtccattcttggggaagaaggaaccccccccttgccggttataaaaggggaaaaagaaatttccccccccctggaaattgaaacaaccccgggggaccctttgggggccaaaagggggatccccccaacaccttttccaaaaaaaaaattggggaaggttttatattcccccccccgaaaaaagaaa

SEQ ID NO: 48568 - protein, 55 aa, Zea mays
  misc_feature: Ceres CLONE 1457973-F
  misc_feature (1)..(54): Pfam Name: Ribosomal_S13_N Pfam Description: Ribosomal S13/S15 N-terminal domain
MGRMHSRGKGISSSALPYKRTPPTWLKTAASDVEEMITKAAKKGQMPSQIGVLLP

SEQ ID NO: 48569 - DNA, 824 bp, Zea mays
  misc_feature: Ceres CLONE 1457975-F
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (420)..(420): n is a, c, t, g, unknown, or other
  misc_feature (433)..(433): n is a, c, t, g, unknown, or other
ccccacataaaaaaaaaaaaaaaaaaaannncaccaccaaacccaatgctggagctccccgcggtggcggccgctctttactagtggatcccccgggctgcaggattcgcacgagaccattacctagaacatcctaatcgaaaataaacccctctgatctccctctcgcgccgccgccaccatgtcgccgccgcagccaccacacccggtgccccgagagacggtggccagcgctgtcgcttccctgacaacgtggatgaacaagcgcgctgcggaggcgcgcccgaacctcctcgccgacgagcgcgacgacatcgtggtcctccagctctcgctacgccgcatccccgcctcgcgcagcaccaagccgcgcctcctcccgatgccacatcccgttgttgggcacgaaggcgactccgnctgcgtcatctcngacgaccgcaccaagtcagcgaaccccttccgcctccgacctccacgcgtccatgtcgctccaccgtttccccgtctccgaggtcatcccgctctctacgctccgcacggattaccgcccgtacgagtctcggcgcccgtctcgcaagcctcccacgacctcttcatcgccaaacgcgccatcctcccccctgctgacaagcgtcctcgggaagaggattctactccccccaaaaggccccccattggagtcgaattctaccccgcaacagaaggcccgaacaaaggcccgcagggaatcttggatctcgcttattgagaccctggagagccatgcacaccgctgaaaggaaataaagtgactaagtcagtgactcgttaaaaggaataag

SEQ ID NO: 48570 - DNA, 769 bp, Zea mays
  misc_feature: Ceres CLONE 1457976-F
  misc_feature: Translation starting site: 181
  misc_feature (256)..(256): n is a, c, t, g, unknown, or other
  misc_feature (402)..(402): n is a, c, t, g, unknown, or other
  misc_feature (423)..(423): n is a, c, t, g, unknown, or other
  misc_feature (454)..(454): n is a, c, t, g, unknown, or other
  misc_feature (467)..(467): n is a, c, t, g, unknown, or other
ggagctccccgcggtggcggccgctctatactagtggatcccccgggctgcaggaattcgcacgagaccattacctagaacatcctaatcgaaaaatatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcncctacaccaagccggggcgcgggctgatcaaggtgaacggcgtcccgattgagctcatcaggccggagatgctccgcctcaaggccttcgagcccatcctgttgggggggcgctccacgttcaaggacatctacatgaggatccgngccccacaccacgacaacacntcgcagatctacaccattcgccacgccatcnccaaggggctcgnaacctacataccagaagtacgtccacgaggccaccaagaacgaggtcaaggacattcttcaccaggtacgaccgcacccttctcatcctccaaccccaggcgctgcgagccgaaaagttcggttggtcgcggcgcccgccccagggtccaagaatccctaccgttgagccgctcgactggcccccctttgccgtaccaatgccctgggttcccccaacttgacagatcgaatgcccgaccccgtgggcataagttttccaatgatccggagctcctaatgatggccccattccctgtagggg

SEQ ID NO: 48571 - DNA, 779 bp, Zea mays
  misc_feature: Ceres CLONE 1457980-F
  misc_feature: Encodes the peptide sequence at SEQ ID NO. 48572
  misc_feature (34)..(34): n is a, c, t, g, unknown, or other
gggctgcaggaattcgcacgagaccattacctanaacatcctaatcgaaaaaagacggatcgagactacgacgccgatcctagctagctctcccgtttctgctcgcaagtcacacacagctccggtagatccgcccctcgcctcttggctccaggaagagattagcttcagacggcagggatcgatactagcaagcaagcatggcgcacgacttgtgcgaggacttggagctcgtcgccgacgacggcggcttcgatgactactactgggacgacgacttccatttccacgacgacgacggcttctccgcttcccctatgaaccccgccagcgttggtgccgccccgccaggagaataagtcaaacaaacaccgccgaaatttccagccttccgaactaaaagaagggcgaccacactcccggggaaacccctgggaaaaggctcaactccccccaggaaccagtttccgtcgggaagaaggctccaaagagacaagaaacttcccagaaacctcccagagggcccacaagggggcccctaactaaccggaaaccgctaacgcgggggggaaaggaagggaaccattttcaacaattttcctctgaaaaaacaaaaggcctccaattcacaacaaagggtgttctcccggggggcggttcacatcgggagctctcccccccccacaacctttaaaaaaaagtttttcaccagaaaaatgaaaacgccttttttttacccgccggattatttaaatagctcttgtctctccctcatcccc

SEQ ID NO: 48572 - protein, 52 aa, Zea mays
  misc_feature: Ceres CLONE 1457980-F
MAHDLCEDLELVADDGGFDDYYWDDDFHFHDDDGFSASPMNPASVGAAPPGE

SEQ ID NO: 48573 - DNA, 757 bp, Zea mays
  misc_feature: Ceres CLONE 1457985-F
  misc_feature: Encodes the peptide sequence at SEQ ID NO. 48574
ggagctccccgcggtggcggccgctctagaactagtggatcccccgggctgcaggaattcgcacgagaccattacctagaacatcctaatcgaaaagttggtacaatactagaaccgaataagctgaagaatgcacatcgcactgcttgttttagggagaatatgtactgatctgtttcatgtcttcgttatactacccagcaagaatgtgaggaactagcgcagaaggtaactgacctgaccgtcgtcaacggcacgctcagatcagaactcgacgagcttaagaaggcctgtgaagacatggaagcagagaattcacagctaattggtgaactggagcagtccgaggcgcctagcgttgtgacgactctgagcatccagattgacacaacgaaggcgcatcatagaagcagtgaccaccatggtaataaaaacaacactggtagcaatgggtagtggtagttttggagtgtggcatccgtgagctaggctttttacctctaggtgaggcagaaagatgagatgaggtggttaatatttagctgcaccatcgcccatcgtcatcagtccttgttgttctccttgggacatcatctgtgccttctctttacctgctcacaagcaatctgataccaacagagtctacggcctgtgtatattagccatgtatgatgtgtatgcgagatgtgggcgaacgaactgctttgtaatatcagactaccagttgtgggcttgtgcctgcctgtacagcaatggt

SEQ ID NO: 48574 - protein, 51 aa, Zea mays
  misc_feature: Ceres CLONE 1457985-F
MEAENSQLIGELEQSEAPSVVTTLSIQIDTTKAHHRSSDHHGNKNNTGSNG

SEQ ID NO: 48575 - DNA, 966 bp, Zea mays
  misc_feature: Ceres CLONE 1457995
  misc_feature: Encodes the peptide sequence at SEQ ID NO. 48576
atcgatgggcaactgccaggcggcggagacggcgacggtgctgatccagcacccgggcggcggccgcacggagcgcgcctactgggcgctctcggcgggggccgtcatggcggcgaacccgggccactacgtcgcggccgtcatcaccgtcccgcagccgggcggcgcgggagacgacggagctgcctctgcctctgccgccgcgcccgtgaagcacctcaagctgctccgccccgacgacacgctcctgctcggccgcgtctaccgcctcgtcagcttcgaagaggtgctgcgggagttcgcgtcgaagcggcacgtgaagctgagccgcgtgacggtccgggccaaggacgaaggcgaggacgtgaagccggcgcccaagcatcgccgccgtcgcgccagcggcggcggagagcgtaaggaatcggagcggtcactcgccaaggtcatggggcagacggaggagcagctggtgccggaggcaggcccggcctcgggccccgcccccagctcctccaagcaaggggacgccgacacgccggccggcctcgacgccgacctggaggcgctcctgcagccgcacggggcgttgctcggccgccgagccggccggcagtggaggcccgcgctgcagagcatcgccgaaggcgaagggtaaaggggggcggggcggcgggcgccaccagctcgaccgttcggtccgcggtcggtgagcagccgagctccgtcgtctccgtctccgtgcaaggtcaactgcaacttgcgaggctgacagcgtattgtaaaataagttcattgttagcgcgcccgactggtgtccagatgtgtagcggcagcagttggctaagcatagcactagactagtatagtagtatccatgcatggatttgatggtgtgtttgtaataaggtaagtagtatacggtatcgcataaaatctttatcctgttcaaaaaaaaaaaaaaaa

SEQ ID NO: 48576 - protein, 217 aa, Zea mays
  misc_feature: Ceres CLONE 1457995
MGNCQAAETATVLIQHPGGGRTERAYWALSAGAVMAANPGHYVAAVITVPQPGGAGDDGAASASAAAPVKHLKLLRPDDTLLLGRVYRLVSFEEVLREFASKRHVKLSRVTVRAKDEGEDVKPAPKHRRRRASGGGERKESERSLAKVMGQTEEQLVPEAGPASGPAPSSSKQGDADTPAGLDADLEALLQPHGALLGRRAGRQWRPALQSIAEGEG

SEQ ID NO: 48577 - DNA, 762 bp, Zea mays
  misc_feature: Ceres CLONE 1457996-F
  misc_feature: Translation starting site: 280
  misc_feature: SWISSPROT Homolog: EC 1.6.5.3 NADH dehydrogenase (ubiquinone)
  misc_feature (361)..(361): n is a, c, t, g, unknown, or other
  misc_feature (362)..(362): n is a, c, t, g, unknown, or other
  misc_feature (381)..(381): n is a, c, t, g, unknown, or other
ggagctccccgcggtggcggccgctctagaactagtggatcccccgggctgcaggaattcgcacgagaccattacctagaacatcctaatcgaaaactacgcttctgcctcctcctccacgaggtgaggaaaccctagcgactgaccatggcgttgctcccgcgcaccgcacggttggccttcctctctaccccgcggtcgtactccgccgccgccgctgccgctgcgggcgcctccccgacctccccagcgccatacgggggcgcgcccccaccggcgatgtcgaagacggccgagttcgtggtctccaaggttgatgacctgatgaactgggcgcgtaagggctcgatttggcccatgnnacttcggctcgcctgctgncgcgtcgagatgatgcacgccggcccccccgctacgacttcgacggttcggcgtcatcttccgtccctcgccgcgcccgtccgattgcatgatcgtcgcccggaccctcaccaccaaatggctccagccctccccaggtttagaaccaatgcctgacctaaatgtttatttcaaggggcaacttggccaccgggggggaaaccaccttaccccactccgtgtaccggaatggaccttaatccccgggaaattccacccccgggggcccccacgtgtaagccccctttaggggtttttcccccaaaaaaaaccacgggctagggttcctttctggggaaaaaaaaaaaaggttctgttgttccccttaaacgtttttttaac

SEQ ID NO: 48578 - DNA, 968 bp, Zea mays
  misc_feature: Ceres CLONE 1458000-F
  misc_feature: Encodes the peptide sequence at SEQ ID NO. 48579
  misc_feature (27)..(27): n is a, c, t, g, unknown, or other
  misc_feature (28)..(28): n is a, c, t, g, unknown, or other
  misc_feature (34)..(34): n is a, c, t, g, unknown, or other
  misc_feature (422)..(422): n is a, c, t, g, unknown, or other
  misc_feature (510)..(510): n is a, c, t, g, unknown, or other
ggaccgcccccccacccacccatcacnnaaaaancccccaaatttatactggagctccccgcggtggcggccgctctttactagtgcatcccccgggctgcaggatttcgcacgagaccattacctagaacatcctaatcgaaaatctacgttctactcccactcgcggtcgcggtagccggcggcggcggcggacgaaagcaggcaggccatggcgtcgtcgtcgtcgtcgaccccggcggccgtccgcgagatgcataaggatctcgaggtccaggccaacgccctcggcaagatccagagagacatcgccaagaaccaccaggtccgcaagcagtacaccatccaggtcggcgagaacgagctcgtcctccagggacctggagcctgctcaaccgatgggggcctaggttgttaacaanagaacaaaaccgggggccgcgccagccatggatttttgcgtcccccccctcgcgggttgatgactcccccccccctcccccaaaaaanaaaaaaaaaaaaaatggaaatttgaatgtgttagtgtttggtgtaaaaagacctcgggcggagaaaaagaccaaaacaccccataaggaaggaaaatcggtaaacattcccaaagctttgctcggtagtaagggaattaggtggcttgtgtgccacaagcgtttccaggggtctcaacacaaacactgatttgcgtgctgaggttggaaaatgttaggcgcctccaggggctccaatgctcctccttgtgttgagccgccacaattgtacgcgccccggagggtgtttttatatgtgtctgcggcgaagagaaccgacgggggcaatagatgtgtttacggggcaggccccacactgacaagaccaccaggtcactacacggcggccctcgtcaggtatagacgcggcgctgtttcctcgattacgtccccgcgcgttgcgactctggggtcctcttg

SEQ ID NO: 48579 - protein, 68 aa, Zea mays
  misc_feature: Ceres CLONE 1458000-F
MASSSSSTPAAVREMHKDLEVQANALGKIQRDIAKNHQVRKQYTIQVGENELVLQGPGACSTDGGLGC

SEQ ID NO: 48580 - DNA, 778 bp, Zea mays
  misc_feature: Ceres CLONE 1458001-F
  misc_feature: Encodes the peptide sequence at SEQ ID NO. 48581
  misc_feature (632)..(632): n is a, c, t, g, unknown, or other
  misc_feature (682)..(682): n is a, c, t, g, unknown, or other
  misc_feature (778)..(778): n is a, c, t, g, unknown, or other
aaactggagctccccgcggtggcggccgctctagaactagtggatcccccgggctgcaggaattcgcacgagaccattacctagaacatcctaatcgaaaaatctccaatctcctcgccccccacggacctgaaccgagaaccgttaccgccgccgcctctcgcctagccgccggagaagcgccgctcgctcaggaggacagccatggcgccggagccggaggatgatattatgaacgagaagaatccccgcccgctcgacgaggatgacatcgcgctcctcaaaacctatggactggggccgtattcgaccagcattaagaaggtcgagaaggagatcaaggaaatggccaagaaaatcaacgacctctgtgggataaaggagtctgatacagggctggctccacctagccaccgggatttggtttcagataagcagatgatgcaagaagaacaaccgttacaagtagcaagatgtacaaagattataagccctaatacggatgatgccaaatatgttataaatgtaaaacaaattgcaaagtttgtggtcggattgggagataaggtctctccaactgatatcgaggaagggatgagggttggtgttgatcgcaacaagtaccagattcnaatccctcttcccacaaaaattgacccaagtgttaccatgatgactgtgnagggaaagccagatgtgacgtacaatgatgtcggtggctggcaggagcaaaatgaagaaatgcgtgaagttgttgacttcctatgcttccccaaan

SEQ ID NO: 48581 - protein, 191 aa, Zea mays
  misc_feature: Ceres CLONE 1458001-F
  misc_feature (143)..(143): Xaa is any aa, unknown, or other
  misc_feature (160)..(160): Xaa is any aa, unknown, or other
MAPEPEDDIMNEKNPRPLDEDDIALLKTYGLGPYSTSIKKVEKEIKEMAKKINDLCGIKESDTGLAPPSHRDLVSDKQMMQEEQPLQVARCTKIISPNTDDAKYVINVKQIAKFVVGLGDKVSPTDIEEGMRVGVDRNKYQIXIPLPTKIDPSVTMMTVXGKPDVTYNDVGGWQEQNEEMREVVDFLCFPK

SEQ ID NO: 48582 - DNA, 774 bp, Zea mays
  misc_feature: Ceres CLONE 1458004-F
  misc_feature: Encodes the peptide sequence at SEQ ID NO. 48583
cgcggtggcggccgctctatattcaatggatcccccgggctgcaggaattctcacgagaccattacctagaacatcctaatcgaaaaatcagaatcagaccaccacacgcccgaggcccgactgcaagcgcctgagcccaagacccatggccatggccgccgccaccgtcgcagcgtcactgcccgtggcgcaagggctcgggaagcccctctgcgccggcagcaacgcgccgtcgctccgggccgtcgcgggcgcgccccgtcgtcggtcggccaggaccaggatggccgtcgtccgggcgtccgcgcaaaagcagcactcggccaaggagtgggcggccgcggctgccgtggcggtggtgctggtgctaccttaggtcgcggaggccgcgccggggatttccccccctgctggaacttcctcctcagcatcccctccagcggggtcgggctcatcaccatcaacagaaccgaagtcgactgttctaacttcaatcccgtcacgcgaggttgaactgcaagcgtcgtcttgagctgttgtattgctcctatgtactgtaattcctatccaccctctgcttccccttgtgaaaaccgcttacatgcctgaatgctgtaaacttcctttacaaaaattaaaaagaaatatcgattaccctcccacctcctagggggggccccgagatctccatttcgccctaaaaaatgatacctatttactcccgcgctcactaggtgcgttcttttaaccttcctccggcaactgtgtaaaaa

SEQ ID NO: 48583 - protein, 76 aa, Zea mays
  misc_feature: Ceres CLONE 1458004-F
MAMAAATVAASLPVAQGLGKPLCAGSNAPSLRAVAGAPRRRSARTRMAVVRASAQKQHSAKEWAAAAAVAVVLVLP

SEQ ID NO: 48584 - DNA, 714 bp, Zea mays
  misc_feature: Ceres CLONE 1458007-F
  misc_feature: Encodes the peptide sequence at SEQ ID NO. 48585
  misc_feature (537)..(537): n is a, c, t, g, unknown, or other
ggagctccccgcggtggcggccgctctagaactagtggatcccccgggctgcaggaattcgcacgagaccattacctagaacatcctaatcgaaaaaataatgtccttattttggagctcgcgccgcccgccgcccgccgccgcgcccgaacgcagccatcgattccccatttctttcccgcctcctcactcccgcctcttctactcccaaaatcccaaaaccctagctcgctaacgaccccaggcagacgcgccgtcctcccctcccccatggcgctcaagcagaaggacaccgacgccgccgccaccgccaccggtaccaagaagcgccgccgcgtcttcttctccgacaccgatgctggtgttgaggcaaatgagtgtatgaaagtgtttctagtatgggatccaggcgaggtgagctctgtagactgcactgctattcagccatttgacctaaacattttttttggggaagatgaaaaatttttggttacaaaaactaaaataaatgtggggataatgcgaaatctttcagtnaaatgcgaaggttcctttgccaaaccttggtggggggaaagaataaaaaattaaagccggtttccaaactttttggaaaaaattggaaaaaaagagaattcccgccacttttccagggggggaaatttccaaactcgcgggaaaaggggggggcctaaacgggggggcccaaaaaac

SEQ ID NO: 48585 - protein, 106 aa, Zea mays
  misc_feature: Ceres CLONE 1458007-F
  misc_feature: SWISSPROT Homolog: EC 2.3.1.48 Histone acetyltransferase
MALKQKDTDAAATATGTKKRRRVFFSDTDAGVEANECMKVFLVWDPGEVSSVDCTAIQPFDLNIFFGEDEKFLVTKTKINVGIMRNLSVKCEGSFAKPWWGERIKN

SEQ ID NO: 48586 - DNA, 711 bp, Zea mays
  misc_feature: Ceres CLONE 1458010-F
  misc_feature: Encodes the peptide sequence at SEQ ID NO. 48587
ctccccgcggtggcggccgctctagaactagtggatcccccgggctgcaggaattcgcacgagaccattacctagaacatcctaatcgaaaaataacattagcaaggcgatatataagaggaaggaaagaacatacgccgccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaaggggttgcacccggagatctaccaggacgcgaaggtgtactgcaacagccagctggtgctggtgacggggggcaccaagccggagtacacggtggacgtgtgctccggaaaccacccctactacgtcggcgacacctcggcgctcgtggtcatggacagccagatcgagaagttccgcaagaagtgcggccacatcaaggagtactggcccgaggaccattggagggagatgcacccagacggcgacccggagttcgagcccgagggggacaactgattgatggctccccgtcttcctcacccggtgcgagtgcaccggtccagtttacatttgccctcttgaatggaattgagactctgtctgttcgcattgctctccaggtgttcggttcatgttcggaatgaaaatgtacaatta

SEQ ID NO: 48587 - protein, 130 aa, Zea mays
  misc_feature: Ceres CLONE 1458010-F
  misc_feature (36)..(104): Pfam Name: Ribosomal_L31 Pfam Description: Ribosomal protein L31
MTLSLSTSFLPIPAAARTTARTLRSVVPSQGMRCSMRKKGLHPEIYQDAKVYCNSQLVLVTGGTKPEYTVDVCSGNHPYYVGDTSALVVMDSQIEKFRKKCGHIKEYWPEDHWREMHPDGDPEFEPEGDN

SEQ ID NO: 48588 - DNA, 708 bp, Zea mays
  misc_feature: Ceres CLONE 1458013-F
  misc_feature: Encodes the peptide sequence at SEQ ID NO. 48589
  misc_feature (513)..(513): n is a, c, t, g, unknown, or other
  misc_feature (564)..(564): n is a, c, t, g, unknown, or other
aagctggagctccccgcggtggcggccgctctagaactagtggatcccccgggctgcaggaattcgcacgagaccattacctagaacatcctaatcgaaaaacctcccccattttcgccgccccctccgatctcgccgttctcgtctccttccgttggattagggctcttcatctgttcgccgcacttcgtcagtcgcccatggcggatgaggaggtcactgatccaaaggcgctcctagaggatcgttcaaaggctaagtgtgtgtcgcagtggtacgattatcagaaatgtgttaaaaggattgaggacgatgagactgggcacaagcactgtaccggtcagtactttgattactggaaatgtgttgacaagaatgttgcagagaaactctttgagatgttaaaatgacaaattttccctccatttatcccactaaagttggtaataattgtaccacttgtgaggcctatagactattaaggcacttaatatttgtcagagacttttgccntctgggaacacaaattttcactgccagtttgcatttctttctgctactagnattgacccagcaggtttccttcattgctgaaaaaatccatgaatattcccagatggggctgagcttaaaaaaaaaaaaaaagttttcgatccctcacctcagggggggcccggacccaatccccctaagggagccattccccgc

SEQ ID NO: 48589 - protein, 69 aa, Zea mays
  misc_feature: Ceres CLONE 1458013-F
  misc_feature (7)..(69): Pfam Name: UCR_hinge Pfam Description: Ubiquinol-cytochrome C reductase hinge protein
MADEEVTDPKALLEDRSKAKCVSQWYDYQKCVKRIEDDETGHKHCTGQYFDYWKCVDKNVAEKLFEMLK

SEQ ID NO: 48590 - DNA, 897 bp, Zea mays
  misc_feature: Ceres CLONE 1458020-F
  misc_feature: Encodes the peptide sequence at SEQ ID NO. 48591
aatagctggagctccccgcggtggcggccgctctataactagtggatcccccgggctgcaggaattcgcacgagaccattacctagaacatcctaatcgaaaaataaaccactccacactccccctctcctagtctgctctccacactcccgctctcctgctactctgctccgtgatctggtctggtgagatcggggaataggaccatatactctgcaagcacatggcggactggggccccggggtggtgggcgaggtgttgaacgagccggcccccccgggcctgctctgggagctgcttgccccccatacgtacaacgatttacgcggaatcccgagaaacggtacaggccctctaggggccaaggatgaagaaaacccccgccgcctgcacggtgccccaccatgtcgggttgtgatccccccccggggccccacccaccaaaagaatggtactggaacccacaaactcctctttggccagtgtgccttctacaccgcacccatgctccgtcgttcacactaacccagcaaccccacgccacggaggacgcatctacttcctattttagcttgagtacccactgagcgggggatggcattgcatctagcacaacctagagctgtctaccgactctctggaggtctgggctccccccaaagtcgctctggagggaatacatgtacagaccaccgggccccaccccctcgatcactgctatttatataacttgtgcagcacccgcacctggtgcgcgcactgatcgaaaccttagtcaaatatgaggacttactgcctccaccattcattttgcgcgtgtgcgtgaggagcactcatattggccatgaataccaccccatcatgcttgtgccggacccagcactaaaagtcttcat

SEQ ID NO: 48591 - protein, 100 aa, Zea mays
  misc_feature: Ceres CLONE 1458020-F
MADWGPGVVGEVLNEPAPPGLLWELLAPHTYNDLRGIPRNGTGPLGAKDEENPRRLHGAPPCRVVIPPRGPTHQKNGTGTHKLLFGQCAFYTAPMLRRSH

SEQ ID NO: 48592 - DNA, 697 bp, Zea mays
  misc_feature: Ceres CLONE 1458023-F
  misc_feature: Translation starting site: 111
  misc_feature: SWISSPROT Homolog: EC 3.2.1.23 Beta-galactosidase
  misc_feature (215)..(215): n is a, c, t, g, unknown, or other
  misc_feature (246)..(246): n is a, c, t, g, unknown, or other
  misc_feature (326)..(326): n is a, c, t, g, unknown, or other
  misc_feature (328)..(328): n is a, c, t, g, unknown, or other
  misc_feature (361)..(361): n is a, c, t, g, unknown, or other
  misc_feature (362)..(362): n is a, c, t, g, unknown, or other
  misc_feature (366)..(366): n is a, c, t, g, unknown, or other
  misc_feature (367)..(367): n is a, c, t, g, unknown, or other
  misc_feature (375)..(375): n is a, c, t, g, unknown, or other
  misc_feature (376)..(376): n is a, c, t, g, unknown, or other
  misc_feature (390)..(390): n is a, c, t, g, unknown, or other
cgggctgcaggatttcgcacgagaccattacctagaacatcctaatcaaaaaagttctgatctgcttctccagtctccacacaacagagcagaaggcagcacgggcgctgatggcgatgggggaggcgctgcgggcggctgccgctgacgcggtggtgacattcctgtgggtgctgtgcgtctccacgctgggggcctcgacgacggcggtgacntcctacctgaggctgcagggcgtccacttcncgctcctggttatcgataccgtcaacctcgagggggggcccggtacccaattcgccctatagtgagtcgtattatgagancncactggccgtcgttttacaacgtcgtgattcannacannccccccgnnacccaacttaaacnccttgcaacacatccccctttcgccagctggcgtaatagcgaagaggcccgcaccgatcgcccttcccaacagttgcgcaccctgaatggcgaatggaaattgtaagcgttaatattttgataaaattcgcgttaaatttttgctaaatcaactcatttttttaaccacaaagcccaaatccggcaaacccccttatcaatccaaagaatagccccagatacgggtcgaacgttgtttccacgtttggaacaagagtccactatttaaaaaaccgtggacctcccacgtccaagggcataagaactt

SEQ ID NO: 48593 - DNA, 717 bp, Zea mays
  misc_feature: Ceres CLONE 1458027-F
  misc_feature: Encodes the peptide sequence at SEQ ID NO. 48594
  misc_feature (573)..(573): n is a, c, t, g, unknown, or other
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgtcntgtcctcccctggcctcctggggcgcttctggcgagcagtgtgttgtgttgtgtgggtgccgcacgctagcaggctagccatgtgccctgctgtgttgtgtcaccatccatctataatcttatccataccccaccttttgtgtg

SEQ ID NO: 48594 - protein, 82 aa, Zea mays; identical to SEQ ID NO: 43085
  misc_feature: Ceres CLONE 1458027-F
  misc_feature (1)..(80): Pfam Name: Metallothio_2 Pfam Description: Metallothionein

SEQ ID NO: 48595 - DNA, 789 bp, Zea mays
  misc_feature: Ceres CLONE 1458032-F
  misc_feature: Translation starting site: 149
  misc_feature: Pfam Name: DUF1195 Pfam Description: Protein of unknown function (DUF1195)
  misc_feature (419)..(419): n is a, c, t, g, unknown, or other
ctggagctccccgcggtggcggccgctctagaactagtggatcccccgggctgcaggaattcgcacgagaccattacctagaacatcctaatcgaaaaactcccgtcggtggattccatgtccaaccgcgtcgccggaggccggaaccatgaagcctgtcagtgtcgccgaacacaacaaccaccagcctcgcctgcactcccccacgccggcgtcggcgaccaagatctcgatccccatctcttcgagcgaggcggcgctgttcgggaagggtaggtacaaggtgtgggccctcgcggccatcgcgctcctagcgctctggtccatgttcgccgcctccgtcacgctgcgcttgtcctccgtcgatctcgccaccacgttcggggacgcgagcgattcgttcatcgcccaccctcgancccctggagatggaacaaagagaaaagctagtgcccccgatgtgggatgtgtacccacccccagaatatcctgtacggctaccacggttctggcaagaaaccattttaaggctgcaaataaagaacctggctgggaaaaaaaccccttacacacggatggccctatttccgaaaaattgcccccaagggaaacccaaggcgctggaggtgaaccctcctcccaaatgggttttggaaatccaagagaaccgccccaaatttttgaaagggggaaactggcccctctaagggaaaaaccttaaaaaggggcccccccccctctaaaaagagttttaaatctcccccccctccccccccaaatttagaggaa

SEQ ID NO: 48596 - DNA, 750 bp, Zea mays
  misc_feature: Ceres CLONE 1458033-F
  misc_feature: Encodes the peptide sequence at SEQ ID NO. 48597
ggagctccccgcggtggcggccgctctagaactagtggatcccccgggctgcaggaattcgcacgagaccattacctagaacatcctaatcgaaaaacgatgccgttgcgcacctcttctctctcgccgccccgagacccccacgcttccctctccgcccccgaactgtggcgcctccccccgccgccgcagcgatgccactcgcggcagagcccgacgacgctcatgaggaaagggagaatcagcagctgctaattacgacgaagggagggcccgggcttgagggactggtggtggggagctactgccacgatgtgctaatccggggcgggcgcatagtgggggagacgctcggcggggctgcggccttcgtgtccaacgtgctcgacgccgcttcgccccagggccccccgctcaacgagacatccccttttgtcgttgtggcccagggtgggtcacgactttcatctacgcccgcgcgccggcgttcggcgcggaatccgcttctggtttggtcgtccccaaccacttcttcccaggccaagttctgggaaaaccgccccttggggaaagccccccaacgggaactccggggggggggccccctgaaaaccaatttaaccccccgaaattttcgaaacggccgttttccctaaaggctttttttttgggggttcccgggggagggttccccgaaaaacccacaaaaaaaataaaggtctcccccaccggggctctggaaaccccaaa

SEQ ID NO: 48597 - protein, 153 aa, Zea mays
  misc_feature: Ceres CLONE 1458033-F
MPLAAEPDDAHEERENQQLLITTKGGPGLEGLVVGSYCHDVLIRGGRIVGETLGGAAAFVSNVLDAASPQGPPLNETSPFVVVAQGGSRLSSTPARRRSARNPLLVWSSPTTSSQAKFWENRPLGKAPQRELRGGGPLKTNLTPRNFRNGRFP

SEQ ID NO: 48598 - DNA, 737 bp, Zea mays
  misc_feature: Ceres CLONE 1458036-F
  misc_feature: Encodes the peptide sequence at SEQ ID NO. 48599
  misc_feature (367)..(367): n is a, c, t, g, unknown, or other
  misc_feature (383)..(383): n is a, c, t, g, unknown, or other
  misc_feature (562)..(562): n is a, c, t, g, unknown, or other
aaagctggagctccccgcggtggcggccgctctagaactagtggatcccccgggctgcaggaattcgcacgagaccattacctagaacatcctaatcgaaaagtaaaccccgctgttctttgccggagcaccccctccccgtctccagccccagtctcggtccccccggacttcgatatcttcggagaccgcctgcatgctcaaatcgtagacactctgggtaggcgcaaggtggagatccgtccgggcacggatcaatttcttcgttcgctggtactcaggctctaatatttttacaaaatcgatggaaagttctaaatctcctcagtcatcaaaaaacagtcggaatgtggtgccttctgatagncatcgctcccgatttngacatgacggtttttgttcagaaactgcatcaaatcaaaatgtttgtgttccactctgaagcagcagatgacctgggagaaaaccgtttgcagaagtcaatgatacaaaggggatttcccttcaatggaagcatccctggccaaggggcctaatgttttaaatgggagctttttccacnaaagaaaaatcccaaaaaattccggaacgttttaacaggaactttttttatccaaaaacctccggaggggacctgttatacctgccgggccccaaaaaattttccgggggggtcccggttttggttttttaaacccccattttgcccccccccttgggggggagagggatataaa

SEQ ID NO: 48599 - protein, 49 aa, Zea mays
  misc_feature: Ceres CLONE 1458036-F
MTVFVQKLHQIKMFVFHSEAADDLGENRLQKSMIQRGFPFNGSIPGQGA

SEQ ID NO: 48600 - DNA, 794 bp, Zea mays
  misc_feature: Ceres CLONE 1458037-F
  misc_feature: Encodes the peptide sequence at SEQ ID NO. 48601
  misc_feature (298)..(298): n is a, c, t, g, unknown, or other
  misc_feature (342)..(342): n is a, c, t, g, unknown, or other
  misc_feature (343)..(343): n is a, c, t, g, unknown, or other
  misc_feature (351)..(351): n is a, c, t, g, unknown, or other
  misc_feature (405)..(405): n is a, c, t, g, unknown, or other
  misc_feature (428)..(428): n is a, c, t, g, unknown, or other
aagctggagctccccgcggtggcggccgctctagaactagtggatcccccgggctgcaggaattcgcacgagaccattacctagaacatcctaatcgaaaagatttgggaaagaaagcaaaagaaacgaaactagagggtagaacacgacggtgtccggcgtccgtaaaaaaggaggagaggaggccagggaggcgggggcagcaagaatggcgtgctccaccggtctctgcttcttggcgtcgattcctcctctctcagcctcttggtcttctggctcctcctgcttcctcatgatncagcgtgtgtcctctgctccgtcctttgtcagatggacgatccnnatacagcnattgggacatacattatattcgaagaagccacgtcctgggcctttgctagtgcnaatgccccaccaggccaaaaaancctcaggtgaaaatggtgggatggttgatccctggaaggctaacggctaacttgttaacaaatggcaaaatttgggcgcaaaaaaaacttaaaaaggcccctaaacaaaaacaaacagggggattggggaggtaaaaacccccccgtggttttgtctggggggccccaaaaggaaaaagacttttggggccccttcggggaatttcagcgcttttttctttttttttggggaaaaaccccggcccggggggggaattttttttcccccccccccccgaggggggtctttcccacctttttttggggccccccctatttttgtgggcgccccccccggggggggaaacccccccccttttttttttt

SEQ ID NO: 48601 - protein, 89 aa, Zea mays
  misc_feature: Ceres CLONE 1458037-F
  misc_feature (30)..(30): Xaa is any aa, unknown, or other
  misc_feature (45)..(45): Xaa is any aa, unknown, or other
  misc_feature (48)..(48): Xaa is any aa, unknown, or other
  misc_feature (66)..(66): Xaa is any aa, unknown, or other
  misc_feature (74)..(74): Xaa is any aa, unknown, or other
MACSTGLCFLASIPPLSASWSSGSSCFLMXQRVSSAPSFVRWTIXIQXLGHTLYSKKPRPGPLLVXMPHQAKKXSGENGGMVDPWKANG

SEQ ID NO: 48602 - DNA, 770 bp, Zea mays
  misc_feature: Ceres CLONE 1458040-F
  misc_feature: Encodes the peptide sequence at SEQ ID NO. 48603
  misc_feature (372)..(372): n is a, c, t, g, unknown, or other
  misc_feature (375)..(375): n is a, c, t, g, unknown, or other
  misc_feature (414)..(414): n is a, c, t, g, unknown, or other
  misc_feature (770)..(770): n is a, c, t, g, unknown, or other
ctggagctccccgcggtggcggccgctctagaactagtggatcccccgggctgcaggaattcgcacgagaccattacctagaacatcctaatcgaaaactatcgccagttcgccacctcctttgctctcgcctcgcgcgcgctcccccccgcgcatcgtgccgttcgccaccgcaccgcgccgatggaggtcgccgccgtgcccagatccgccgcggcctgccgtgcggcgcccctgctcccggccgtccgagccgctgcgtgccacctggccctgccccggcgcgcgttctccgcatccgtcacggcggcaccggcgccgcgccgcctcgccgctcgtcgcgctgcggatggtgacagcgtggagtatgcnccngaggcggtccccattgagaaaaggttccctccccccccnagcgtcatggacatcaaccagatccgcgagatcctcccccacaggttcccattccttttggttgatagagtaattgaatacaaagctggagaatatgcagtggggatcaagaatgttacaataaattgataattttcttcccgggacatttttcctgaacgccccataattgcccgggtgtccctcattggtcgaggctattggccccaggttggggggtcctgggtgatgcctgcaaacccgaaatttgggttggatcctcaaaaaaaaactttttttttccgccgggcaattgacaaaccttcccgtttcagggaagccaagtggaattggccgggcgagatacactggtaccn

SEQ ID NO: 48603 - protein, 119 aa, Zea mays
  misc_feature: Ceres CLONE 1458040-F
MEVAAVPRSAAACRAAPLLPAVRAAACHLALPRRAFSASVTAAPAPRRLAARRAADGDSVEYAPEAVPIEKRFPPPPSVMDINQIREILPHRFPFLLVDRVIEYKAGEYAVGIKNVTIN

SEQ ID NO: 48604 - DNA, 779 bp, Zea mays
  misc_feature: Ceres CLONE 1458043-F
  misc_feature: Encodes the peptide sequence at SEQ ID NO. 48605
  misc_feature (197)..(197): n is a, c, t, g, unknown, or other
  misc_feature (198)..(198): n is a, c, t, g, unknown, or other
  misc_feature (362)..(362): n is a, c, t, g, unknown, or other
  misc_feature (397)..(397): n is a, c, t, g, unknown, or other
  misc_feature (406)..(406): n is a, c, t, g, unknown, or other
ctccccgcggtggcggccgctctagaactagtggatcccccgggctgcaggaattcgcacgagaccattacctagaacatcctaatcgaaaaaaaaaccctcgcttcgcccccaacgtttgctcacccagaccaagatgctccgccgcgccgcccctacgtcggctgcactctgccgccgcgcgctctctaccacgnnccatcctcttcccgcaccgcggcggaaaccgcggcggtctcctctgagttgaactccgtcctcctccgctcgctcaaggagcactacctcgaggtctgcaagatgacgccgccgcccaaggtcagcccgcccaagccccttcacatcgtcaaaggcgccctggnacagccgtcgggccccgtgctgcgccgcgaatacngcgaagacngaaaggagatctccatctccgtcggcagggtcgccaacatcctgcccgccggccccgactctgattcgaacgggtaccggcaagggccgtgggattaaccgggtcattaaccagttcccccttccagttaaatttttcaacccgggaaaaggaaatcaatgcatttccttgtgggtgttaaccggaaaccttggggaaccttttggtccgcccccaaaaaaaaaaaccccccccttttggggggatatttttctcaagggaaaaccccggggcgttttttccaaaatgaaaaaaaaggtgggggagatcttctttttttaaagacccgcggaaaaaaaaaaaaccctttttttttcccccgggtgttgtggaa

SEQ ID NO: 48605 - protein, 67 aa, Zea mays
  misc_feature: Ceres CLONE 1458043-F
  misc_feature (21)..(21): Xaa is any aa, unknown, or other
  misc_feature (33)..(33): Xaa is any aa, unknown, or other
  misc_feature (36)..(36): Xaa is any aa, unknown, or other
MTPPPKVSPPKPLHIVKGALXQPSGPVLRREYXEDXKEISISVGRVANILPAGPDSDSNGYRQGPWD

SEQ ID NO: 48606 - DNA, 811 bp, Zea mays
  misc_feature: Ceres CLONE 1458047-F
  misc_feature: Encodes the peptide sequence at SEQ ID NO. 48607
  misc_feature (368)..(368): n is a, c, t, g, unknown, or other
  misc_feature (416)..(416): n is a, c, t, g, unknown, or other
  misc_feature (424)..(424): n is a, c, t, g, unknown, or other
  misc_feature (760)..(760): n is a, c, t, g, unknown, or other
tggagctccccgcggtggcggccgctctataactagtggatcccccgggctgcaggaattcgcacgagaccattacctagaacatcctaatcgaaaagcaccaagctaacatttagttgcaaaggagcgctaggaagaagaagcaacgagccatggcctccggtggcccgaaacccaaactggcctacatcatcttgtacgtgagggacgtggagaaggctgcctccttctacgacgccgccttcggctacaccgtccgccgcctcgaccagttccgcaagtgggcggagctggagagcggggcgacgaccatcgcgttcacgccgctgcaccagcgggagacggacgagctgtcgggggcggtgaanctgccggactcgtcggccgccggccggggtttccgtgcaccccccccntccctacncggaagtcgacgcccggtacaaccccgccgtggacaaacgggccgtggccctggaacgccccgggagaaaaggcccgggggcccaaagttcgggtttcctggcgggaatgggaaaggaaaattcgggggccatccccgagctaccggggaaaaaataatcccatttcggtggggtccccccttcaataaaatcgataagccctttcccccaggagggccccgaaaaaaaacccgctctacgcggggccacaaaaaaaaaaaaacccttgggccccacaaaataattttgtggagataaaagcccccgcgcaaaaataaattgggaccccggggganacttgatataaaaaaaacgcctccctctcccctctgttcacaaaaaaaaac

SEQ ID NO: 48607 - protein, 189 aa, Zea mays
  misc_feature: Ceres CLONE 1458047-F
  misc_feature (72)..(72): Xaa is any aa, unknown, or other
  misc_feature (91)..(91): Xaa is any aa, unknown, or other
MASGGPKPKLAYIILYVRDVEKAASFYDAAFGYTVRRLDQFRKWAELESGATTIAFTPLHQRETDELSGAVXLPDSSAAGRGFRAPPPSLXGSRRPVQPRRGQTGRGPGTPREKRPGGPKFGFPGGNGKGKFGGHPRATGEKIIPFRWGPPFNKIDKPFPPGGPRKKTRSTRGHKKKKTLGPHKIILWR

SEQ ID NO: 48608 - DNA, 783 bp, Zea mays
  misc_feature: Ceres CLONE 1458048-F
  misc_feature (392)..(392): n is a, c, t, g, unknown, or other
  misc_feature (431)..(431): n is a, c, t, g, unknown, or other
  misc_feature (452)..(452): n is a, c, t, g, unknown, or other
  misc_feature (492)..(492): n is a, c, t, g, unknown, or other
  misc_feature (698)..(698): n is a, c, t, g, unknown, or other
  misc_feature (783)..(783): n is a, c, t, g, unknown, or other
caagctggagctccccgcggtggcggccgctctagaactagtggatcccccgggctgcaggaattcgcacgagaccattacctagaacatcctaatcgaaaaagaaaggacgctcctccccacccccatccccgcccccgcgggctcggcgggttgcgttgctgaggtgcggtgatttctacatgagacgcggggtcgcgggggcacagatggaggcagtaggaggccgccgctggatcttgtggagctggcccgcaccgagatagatcatgagttcgagaagggcttgtccgcctcccggtttcctgaatggctgctggttatggagtgaaggggtgcctcggctactgtagatgtgtttcagggttgttccaactttaagtattgggaanccaattatgttgttaaaccccccccgggggacccccaanaaccttcgccccgttacactntaagaataaaagtttttttcaagggattatagttttatcngctgtagggaagtagggtggttacccgcccgcgtggcaccccgcacccacggccaagccgcccgcatagatatgtgcgcggctattgtcttgttaccaaaaatttatattcgcaatcccagacaaaaagcccggatcagggggaggttatttgtcgcagccgggagaggcggttttggttccgctattttttgtatatgcgggggntattgaatatgggtggtttgatcaaaatattaatgaagccccggaatatttctcgcgtgtatacgagaggatattttaaaggaan

SEQ ID NO: 48609 - DNA, 737 bp, Zea mays
  misc_feature: Ceres CLONE 1458050-F
  misc_feature: Encodes the peptide sequence at SEQ ID NO. 48610
  misc_feature (603)..(603): n is a, c, t, g, unknown, or other
  misc_feature (653)..(653): n is a, c, t, g, unknown, or other
  misc_feature (693)..(693): n is a, c, t, g, unknown, or other
  misc_feature (701)..(701): n is a, c, t, g, unknown, or other
  misc_feature (702)..(702): n is a, c, t, g, unknown, or other
  misc_feature (719)..(719): n is a, c, t, g, unknown, or other
  misc_feature (720)..(720): n is a, c, t, g, unknown, or other
  misc_feature (727)..(727): n is a, c, t, g, unknown, or other
  misc_feature (729)..(729): n is a, c, t, g, unknown, or other
  misc_feature (730)..(730): n is a, c, t, g, unknown, or other
acccgcggtggcggccgctctagaactagtggatcccccgggctgcaggaattcgcacgagaccattacctagaacatcctaatcgaaaatccgcctcggcttgtccccaccaacccgcagctcgctcccaccaaacccacacccgaacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagtgtccagaagaagaactccaatccagtgtggaacgaagtactgcagctctcagtaacacatcctacgaagccagtgcaccttgaagtttttgatgaagacaagttcacagcagacgacagcatgggtgttgctgagatcaacattactgacatctacgatgctgcgaagctggacctgaagcacgcctctgatgggacaaggatcaagacgatctaccctgtcggagtaaactaccttggcggcgagagccatgttcagtggaaggatggcaaggtggtccaggactttgatctgaagctgaagaangtcgagagtagcctgatttgtgtgcagctggagtgggttcatgttcctgncgtgaagctgtgaaggccttgtctgaatgaaggctgatgnacctgcanntgctgtgtccctggttnngatgttngnntgtaaca

SEQ ID NO: 48610 - protein, 171 aa, Zea mays
  misc_feature: Ceres CLONE 1458050-F
  misc_feature (13)..(94): Pfam Name: C2 Pfam Description: C2 domain
  misc_feature: SWISSPROT Homolog: EC 3.1.4.4 Phospholipase D
  misc_feature (151)..(151): Xaa is any aa, unknown, or other
  misc_feature (168)..(168): Xaa is any aa, unknown, or other
MASASKEEVIGKLNVRVVRGNNLVIADPLTHTSDPYVVLQYGAQKVKTSVQKKNSNPVWNEVLQLSVTHPTKPVHLEVFDEDKFTADDSMGVAEINITDIYDAAKLDLKHASDGTRIKTIYPVGVNYLGGESHVQWKDGKVVQDFDLKLKXVESSLICVQLEWVHVPXVKL

SEQ ID NO: 48611 - DNA, 758 bp, Zea mays
  misc_feature: Ceres CLONE 1458051-F
  misc_feature: Encodes the peptide sequence at SEQ ID NO. 48612
ctccccgcggtggcggccgctctagaactagtggatcccccgggctgcaggaattcgcacgagaccattacctagaacatcctaatcgaaaaagccccaccaggaggcacgagccggccccacctctcagccccaattccatctcctccgattcgaaatgtcttcctcatcatccgatctcgtcctctacaacctcgtccccgctccccaaaccctaaaccctcccccaccacacgtcaccgccgcccctgatctctccatctccaccgccgtcgcggcggcgccagaacccgtcatccgcggccgggttcgccgcccggtgggctcctccgccgaccgccacgccaaggtcgccggccgcggccgccgggtccgcatcccggccatggtggcggcgcgcgtcttccagctcacgcgtgaactcggacaccgcaccgacggagagaccatcgagtggttgctgcgccaggccgagccttccataatcgccgccaccggcaccggtgtcacgaccgatgaggcgcccccgtctctcgtccccgtcgcccccatcgcgtcctcagtgtcccttacgccggtcccgtactacaccgcgctcctcatggcaccaccgcccaccgccaatgagtcccctgttcgctctgcatccgtatctggcactgttgcggataacaactagctagggggaaaagacgtatcaatgcagttagctaaagtaagttagggttaggggttatatgtgggcaatggggcaggct

SEQ ID NO: 48612 - protein, 97 aa, Zea mays
  misc_feature: Ceres CLONE 1458051-F
  misc_feature (1)..(91): Pfam Name: TCP Pfam Description: TCP family transcription factor
MVAARVFQLTRELGHRTDGETIEWLLRQAEPSIIAATGTGVTTDEAPPSLVPVAPIASSVSLTPVPYYTALLMAPPPTANESPVRSASVSGTVADNN

SEQ ID NO: 48613 - DNA, 786 bp, Zea mays
  misc_feature: Ceres CLONE 1458055-F
  misc_feature: Encodes the peptide sequence at SEQ ID NO. 48614
  misc_feature (454)..(454): n is a, c, t, g, unknown, or other
  misc_feature (463)..(463): n is a, c, t, g, unknown, or other
tggagctccccgcggtggcggccgctctagaactagtggatcccccgggctgcaggaattcgcacgagaccattacctagaacatcctaatcgaaaagaaactcactggctccctctcctcccccagtccgcggcgctcgctccgttcacctcggccgcggcgaccttcgaggcgacgagacgatgctgcggctctcccgcttcctcccctccgcctgcaggaggggttttgatctaaaagaatctctttggagtggttcattgacattccaacaagctgtttccactgcagcaacaaatcttgatgggaacttgtctggcaaaaagtttgcaagttataccgtgttcaagggaaaagctgcactttctatacatcctatactggcaagtttcagcaaattagaatccggaccaccccaagtgagcaaaaatggatcagtaatgctgaccttcnttcctgctngttgacaaggaagtatgactatacaaagaaacagctctttgccctgccacctactgaagtttggaagcctgaaaatcttgggcccgctgaaacccggggaattttccggggcccctccgtgaatcccggtatgggagggacggggaaaaaacccctggccaaccccccccgttggggaggaagggggaaacttttgtaaaaaaaccccttgggaacccgggaaaaagaaacaaagaaatttttttccccccacaaaaaaagaggagattgtgtggggccccccaccctctctgttttttctcgccccacataggggggggggg

SEQ ID NO: 48614 - protein, 93 aa, Zea mays
  misc_feature: Ceres CLONE 1458055-F
  misc_feature (91)..(91): Xaa is any aa, unknown, or other
MLRLSRFLPSACRRGFDLKESLWSGSLTFQQAVSTAATNLDGNLSGKKFASYTVFKGKAALSIHPILASFSKLESGPPQVSKNGSVMLTFXPA

SEQ ID NO: 48615 - DNA, 754 bp, Zea mays
  misc_feature: Ceres CLONE 1458057-F
  misc_feature: Encodes the peptide sequence at SEQ ID NO. 48616
aaagctggagctccccgcggtggcggccgctctataactagtggatcccccgggctgcaggaattcgcacgagaccattacctagaacatcctaatcgaaaaaaaccagtagccactactccatccaccacaccacgagcgcgcgataaccctaactagcttcaggtagtagcgagagccaatggactccagcagcttcctccctgccgccggcacagagaatggcttatcaataccgtcgacctcgagggggggcccggtacccaattcgccctaaagggagtcatattacgcgcgctcactgaccagagttctacaacgccgtgactggcaaaaccctggagatacccaacttaatcaccttgaaggatggaaccaatacgccagctggcgtaatagcgaagaggcccgcaccgatcgcccttcccaacatttgcacatcctgaatggcgaatgtaaattgtaagcgttaatatattgttaaaattcgcgttaaatttttgtttaaaccgctcatctttttgcccaaatgaccaaaagtcggccaatcccttatcattcaaataaataaaccgagatagggttgaagtggtgttacccttttgcaaacacgaatcccgctctttagagaaacattgcatctcccgcctgtcaaagggcgcaaaaaaacctttttattcgaggggcgaatggccccaactggccttgcaaccattccctcccaaaaatcaaggtgttatttggaggggacaag

SEQ ID NO: 48616 - protein, 31 aa, Zea mays
  misc_feature: Ceres CLONE 1458057-F
MDSSSFLPAAGTENGLSIPSTSRGGPVPNSP

SEQ ID NO: 48617 - DNA, 702 bp, Zea mays
  misc_feature: Ceres CLONE 1458058-F
  misc_feature: Encodes the peptide sequence at SEQ ID NO. 48618
  misc_feature (365)..(365): n is a, c, t, g, unknown, or other
  misc_feature (376)..(376): n is a, c, t, g, unknown, or other
  misc_feature (378)..(378): n is a, c, t, g, unknown, or other
  misc_feature (432)..(432): n is a, c, t, g, unknown, or other
  misc_feature (441)..(441): n is a, c, t, g, unknown, or other
  misc_feature (587)..(587): n is a, c, t, g, unknown, or other
  misc_feature (671)..(671): n is a, c, t, g, unknown, or other
agagctggagctccaccgcggtggcggccgctctagaactagtggatcccccgggctgcaggaattcgcacgagaccattacctagaacatcctaatcgaaaaagtagctacggagtaccattcatcatcagagctagcaagctcaaagaaaactgagctcgtgtgtagtgagcagcgagtgagtgactggtgagtggtgaccatttcaagaacagcgccgcagcagggagctaattcgttcgttcatcgtcgcatcatcagtttgatccttcgaccccatagcttcctgcatcttcgagctcgtcactaaacaaccatgggaggaggcacgctggagtacctgtcggatctgctgggcggcggnggtcggggccngnacaagaagaggaagcacttccagacggtggagctcaaggtgcgcatggactgcnacggctgcnagatgaaagtcaggaacgcgctctccagcatgaaaggggtgcactccgtggagatcaaccgcaagcagtacaaggtgacggtgcaggggtacgtggagccgcacaaggtggtcaagcgggtgcaggccacggggaagaaagacaanatctggccctacctgccctacagcctcgtcgcgaacccttacgccgcgccggcctacgacaagaaagcgcccgcccgggctacnttgcgcagggtcgacccccgtcatggcccct

SEQ ID NO: 48618 - protein, 128 aa, Zea mays
  misc_feature: Ceres CLONE 1458058-F
  misc_feature (31)..(91): Pfam Name: HMA Pfam Description: Heavy-metal-associated domain
  misc_feature: SWISSPROT Homolog: EC 3.6.3.4 Copper-exporting ATPase
  misc_feature (20)..(20): Xaa is any aa, unknown, or other
  misc_feature (21)..(21): Xaa is any aa, unknown, or other
  misc_feature (39)..(39): Xaa is any aa, unknown, or other
  misc_feature (42)..(42): Xaa is any aa, unknown, or other
  misc_feature (90)..(90): Xaa is any aa, unknown, or other
MGGGTLEYLSDLLGGGGRGXXKKRKHFQTVELKVRMDCXGCXMKVRNALSSMKGVHSVEINRKQYKVTVQGYVEPHKVVKRVQATGKKDXIWPYLPYSLVANPYAAPAYDKKAPARATLRRVDPRHGP

SEQ ID NO: 48619 - DNA, 773 bp, Zea mays
  misc_feature: Ceres CLONE 1458059-F
aaagctggagctccccgcggtggcggccgctctacaactagtggatcccccgggctgcaggaattcgcacgagaccattacctagaacatcctaaccgaaaaaaacttttctgtccggtcatggctttcccaactgcagcagctgttttgcttaatgagaacatgcagattcataaagggttgatgcaccaagtgccaaaccactgaaatcatcagccaaacctgagagaaaggctcttcaggatgtgtctaacattcctaaaggcactgctttaaagaacagatccacagtcaaagaggggtccgccttgaaagaaaggcctgcactccacaatgtgtctaacaacctcaaaaagaggtccatcctgaaaaaccaggcctcctctttcagatgtgttttaaaaccgccaaccccaaggccatcctggaaaaaaaattctgccctggggtacccttgaacctattaaaaaccccagggaaaattttttgctaaaaaccaaaaaaaccaaaggggggccaaaaaaagggcttaaggattggaatggaggccccttccctttcccggaaaagatttcccaaaaatttggaaaaaaaatttgccaacccacaccttttccaaaaaaaaagtgtggaaaaccttccccccccctttgtggggggggggcccaaaagagaaatagggcctatagaaatttatggggtcttttagggtccccaattttttcccaaaaaacacaagagaattgggtgccggaccaacaaaaatttttcta

SEQ ID NO: 48620 - DNA, 730 bp, Zea mays
  misc_feature: Ceres CLONE 1458060-F
  misc_feature: Encodes the peptide sequence at SEQ ID NO. 48621
acccgcggtggcggccgctctagaactagtggatcccccgggctgcaggaattcgcacgagaccattacctagaacatcctaatcgaaaaacgcggaaaccctagcagctcaacaccctcgaggtacctccattcgcagtcggccgtgtcctcggagccgcgggagatggcggatcaggagacagtagctgtggttgaggcacctaccccggttctaggggaaccgatggacctgatgactgccctgcagctcgtcatgaagaggtcaggtgctcacgatggcctttgtgaggttcttcgtgaggctgccaaagccatcgagaagcatgccgctcacctctgcgtgcttgccgagaactgcaaccagcctgattatgtcaagctgtggaaggctcccgcccttgagcacaatgtccccctggttactgggcctaagcccaaatctttgggaagggggttgggttttcaaaatccacctctagggaaaggaaagaaagttttaccttttccttgttttttgtcaaggactcccgaaaaaattttgaggcctttaatttggggggggagtccccaacccccctaaaaaacgtgtgtaatattggagagggggttcacacaacttttgtccccggaaaaaaaatgggtggtgcccggggctttttcaaaaaaaaaaaaattttttgtggggcgccccccccccggggaaaataattttttccccccccccggg

SEQ ID NO: 48621 - protein, 138 aa, Zea mays
  misc_feature: Ceres CLONE 1458060-F
  misc_feature (25)..(119): Pfam Name: Ribosomal_L7Ae Pfam Description: Ribosomal protein L7Ae/L30e/S12e/Gadd45 family
MADQETVAVVEAPTPVLGEPMDLMTALQLVMKRSGAHDGLCEVLREAAKAIEKHAAHLCVLAENCNQPDYVKLWKAPALEHNVPLVTGPKPKSLGRGLGFQNPPLGKGKKVLPFPCFLSRTPEKILRPLIWGGSPQPP

SEQ ID NO: 48622 - DNA, 707 bp, Zea mays
  misc_feature: Ceres CLONE 1458076-F
  misc_feature: Encodes the peptide sequence at SEQ ID NO. 48623
aagctggagctccccgcggtggcggccgctctagaactagtggatcccccgggctgcaggaattcgcacgagaccattacctagaacatcctaatcgaaaaatccatcatacgatctgacgctcgtcccacatcagtagtcgaccaagcacaagcagcagagccggccggaatatgtggacgatcaggaaggtggcgacgcctcaagtggccgtcctcctgctgctcctcatcgtccttgcacaagacgcggcaccgttggctgatgcacacgtgtgccggcgccggagcgcgggcttcaaaggggtctgcatgtccgaccacaactgagcgtaggtgtgcttgcaagagggctacggcggtggcaaatgttacggcatcatgcgccagtgcaagtgcatcagggaccccccccctacctaggatctaggatctagcaagctagctatatcgtcctttaattaacttaataaggatcgacgtcgtggccggtcgctaaatatgtactactatacgtctacactgcctgcatcaaagaatcacatgtacgcgtactctcaccaagctgtgagaacgccacacctatgatgattggccatccttcctatcaaaaaacaaaaaatagcttatcgataccgtcaacctcgaggggggacccggtaccccattcccctctataagagactaattacgcgccctcactggccg

SEQ ID NO: 48623 - protein, 51 aa, Zea mays
  misc_feature: Ceres CLONE 1458076-F
MWTIRKVATPQVAVLLLLLIVLAQDAAPLADAHVCRRRSAGFKGVCMSDHN

SEQ ID NO: 48624 - DNA, 808 bp, Zea mays
  misc_feature: Ceres CLONE 1458081-F
  misc_feature (370)..(370): n is a, c, t, g, unknown, or other
ggagctccccgcggtggcggccgctcttgaatagtggatcccccgggctgcaggatttcgcacgagaccattacctagaacatcctaatcgaaaaacgattccttccgttccatctccaccggctaaactgccctcgcctccgatcgaacagacgttcctcctccgtcgccgccgcggccgtttgatcctccttgcgagtccgaacctccccacgacggcacgcggccggatccagatcgggagtactccccactccccgcgcttctccttcgcatcacaagcggccccggccccagacccctagccggatcggatctcgcgcggcgccgtgccggagatgatgtcgtcgtcgtcggacgcggtattttncactggacctgcaggagtccgggtgggaggagctgcccccaccacccgggaaatatccaactcacaccccacagcaaagcacagcccctcccttccccaaagagcccgacgatacacctggtgggccctgagagatctcctccgcctacgggcgagccgttacgcttgtcaacccaaagcaattttcaaatcctgaggtgttggttcggtctagcatcaatgtctctctcttggccaccctgagctccggttggctctatgtggatcttgataacacaaaattctctgttcccttgaatggtctgactcctgactcgctcaataaattactccagtttccctcctgagttcctgatctcgaccccagcgcttaaacttcctccctctctgacctagcaccctcggtagttggtatctctcccgtctctactagatgtt

SEQ ID NO: 48625 - DNA, 678 bp, Zea mays
  misc_feature: Ceres CLONE 1458082-F
  misc_feature: Encodes the peptide sequence at SEQ ID NO. 48626
  misc_feature (369)..(369): n is a, c, t, g, unknown, or other
ggagctccccgcggtggcggccgctcttcaatagtggatcccccgggctgcattatttcgcacgagaccattacctagaacatcctaatcgaaaaagttccgctcttcgtctttgggggccattgcccgtgcgtcacccgagcccgtgcccggaatctttgtagaagcgtctggaggactcccacccggctgccatccatggctgagaatctggcgcccgagaagcgccactccttcgtgcacaacgggcagaaggtgttcgagtgggaccagacgctggaggaggtcaacatgtacatcgagctcccgaagggtgtgccaaccaagctatttcactgcaacatccaggctagccacgttgaggtaggnatccgcggcaacccgccatacctcaaccatgacctccaccacccagtgaagactgactcgtcgttctggacaataaaagatggtgagatgcatatcacactgcaaaaaagagagaaggggaaaacatggtcatctccaatacaagggcaagggattttggatccatatgctgcagatcaagagcaaaagcggcttatgctccaaaggtttcaggaagagaaccctgggttcgacttttccaggctcagttcagtggaacctgccctgacccaagaccttcatgggaggaataccctccgagtgaagcac

SEQ ID NO: 48626 - protein, 160 aa, Zea mays
  misc_feature: Ceres CLONE 1458082-F
  misc_feature (19)..(93): Pfam Name: CS Pfam Description: CS domain
MAENLAPEKRHSFVHNGQKVFEWDQTLEEVNMYIELPKGVPTKLFHCNIQASHVEVGIRGNPPYLNHDLHHPVKTDSSFWTIKDGEMHITLQKREKGKTWSSPIQGQGILDPYAADQEQKRLMLQRFQEENPGFDFSRLSSVEPALTQDLHGRNTLRVKH

SEQ ID NO: 48627 - DNA, 735 bp, Zea mays
  misc_feature: Ceres CLONE 1458089-F
  misc_feature: Encodes the peptide sequence at SEQ ID NO. 48628
  misc_feature (374)..(374): n is a, c, t, g, unknown, or other
ggagctcaccgcggtggcggccgctctatactagtggatcccccgggctgcaggaattcgcacgagaccattacctagaacatcctaatcgaaaacacctgaggttctacggaatgaacaatcgaatgaaaagtgcgacgtttacagctttggtgtcatattatgggagctggcaacgcttagaatgccatggagtgggatgaatccaatgcaggttgtgggggcagttggtttccaggatagacggcttgatattcccaaggaagttgatcctctggtagcaaggatcatattcgaatgctggcagaaggacccaaatctgcgcccttcatttgcacagttaacaagtgccctaaagactgttcaaagactantgaccccttctcaccaggagacccagagcccccatgcccaccaagaaatctcagtgaacttgactccataggagggctgtcaacttcccgttgtgcatagtttttgttcttttgccgtttgtgttttgtccaagagcccgcaaatgcgggcgcggcttgtaaattgagcgcccccaggcggtggtagacactctgccgtctgcaacaagaccccgtggtagggtatgtatagagttgcccatcctcgggagaagtgattcagtgtgtagcaactgatcgtcaatccctcttttagtcctttgtacacccaaccggtcgaaccgggtgcaagcccccttgaaaagcagtgaacttctgtgtt

SEQ ID NO: 48628 - protein, 86 aa, Zea mays
  misc_feature: Ceres CLONE 1458089-F
  misc_feature: SWISSPROT Homolog: EC 2.7.11.1 Non-specific serine/threonine protein kinase
  misc_feature (64)..(64): Xaa is any aa, unknown, or other
MPWSGMNPMQVVGAVGFQDRRLDIPKEVDPLVARIIFECWQKDPNLRPSFAQLTSALKTVQRLXTPSHQETQSPHAHQEISVNLTP

SEQ ID NO: 48629 - DNA, 743 bp, Zea mays
  misc_feature: Ceres CLONE 1458090-F
  misc_feature: Translation starting site: 172
  misc_feature (319)..(319): n is a, c, t, g, unknown, or other
  misc_feature (330)..(330): n is a, c, t, g, unknown, or other
aagctggagctccccgcggtggcggccgctctagaactagtggatcccccgggctgcaggaattcgcacgagaccattacctagaacatcctaatcgaaaaagaaccccaaatccagttccgttccaatcgccgagaagggcagcaaaggggagaaaaaaaaaggaaatctatggcggcggccggcggcgagaacagcggcgctggcgagggcgagggcgagttctacctgcgctactacgtgggacacaagggcaagttcgggcacgagttcctcgagttcgagttccgccccgacggcaagctccgctacgccaacnactccaactancagaacgacaccatgatcggcagggaggtcttcgtctcgccttccgtcctcggcgagccaggaggatcatccgggaatccaacctcctgaggaagacgaacgcaattggcccgagtccaaacggatgggccgccagaatttcaaaatccttggggaaacaaccctttttcttcccccttccaaaagcggcccccctcgcaaagcccccccccaaggggcccgggggggccccccgaaactttcccccctggcccaaaataaaagggttttggtgtctcccccccccccccccctctagaaaaaaccaccccccgtttgggttcccccccccccccttttttatttttttttgacaaccccggttttttttaaaaaacactctcctccccccaaaaaaagttttttttttggcc

SEQ ID NO: 48630 - DNA, 771 bp, Zea mays
  misc_feature: Ceres CLONE 1458092-F
  misc_feature: Encodes the peptide sequence at SEQ ID NO. 48631
  misc_feature (364)..(364): n is a, c, t, g, unknown, or other
  misc_feature (409)..(409): n is a, c, t, g, unknown, or other
  misc_feature (421)..(421): n is a, c, t, g, unknown, or other
tggagctccccgcggtggcggccgctctagttctagtggatcccccgggctgcaggaattcgcacgagaccattacctagaacatcctaatcgaaaaaaccctagaagccaccctgccgcctcaccgcctctctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcggccaacatcaaggtcgagtcctactggccggcactcttcgccaagctcctggagaagcgcaacgtcgaggacctcatccntctcgtgggatctggtggcggagctgctccagttgctggtgccgnacccccccccgnggctgcggctgctgctgccccggttgtcagggaaaaaaggaaaaaggcagggaggatctgatgacaaactggcttcaccctgtcaactggggaaacccctcccccccccattacaaattttatttggggtgcaaaaacaacctgggctaaggtaaggccccgggcttttgttacacaccccacatttttagtttttgaaaaggggttttgggggacccccccccctctttgggggggaacctgtttttttttctttaaaaaaaaaaaaaaaacttttcttcccccccctcccggggggggggccccccaccctctctcctcaaagggaggattattacccccccctccgt

SEQ ID NO: 48631 - protein, 98 aa, Zea mays
  misc_feature: Ceres CLONE 1458092-F
  misc_feature (21)..(94): Pfam Name: Ribosomal_60s Pfam Description: 60s Acidic ribosomal protein
  misc_feature (60)..(60): Xaa is any aa, unknown, or other
  misc_feature (75)..(75): Xaa is any aa, unknown, or other
  misc_feature (79)..(79): Xaa is any aa, unknown, or other
MASGELACTYAALILSDDGIAITAEKIATIVKAANIKVESYWPALFAKLLEKRNVEDLIXLVGSGGGAAPVAGAXPPPXAAAAAAPVVREKRKKAGRI

SEQ ID NO: 48632 - DNA, 711 bp, Zea mays
  misc_feature: Ceres CLONE 1458098-F
  misc_feature: Encodes the peptide sequence at SEQ ID NO. 48633
  misc_feature (562)..(562): n is a, c, t, g, unknown, or other
  misc_feature (567)..(567): n is a, c, t, g, unknown, or other
tggagctccccgcggtggcggccgctctagaactagtggatcccccgggctgcaggaattcgcacgagaccattacctagaacatcctaatcgaaaaatcaagtacccaaaccctttcgatctgctcaactaccaaactctgctcctccctgcttccgtcacgcgagagcactccactcccacgcgaaccctagcagtggttctccctcggggccccgctaagcagcttggttccaagctgtagaagcatctccgatcccatccgcggcgggttgaggccatcagctccggtttctgcagccggatttgggatccgcgagatgtcttggtccgcgcccgacgacatcctcctctccacctccctcgccggcttcttggacaagaaacttattgtcctgctaagagatggacggaaactgcttggcaccctctgctcatttgatcagtttgcaaatgttgttcttcagggtgcttgtgaacgagtgattgtgggggaaacatattgtgatgttccctctgggctgtacgtaatccggggagagaacgtttgttttaatcgagnattgnatcggcgaaaggatgaactccctgctcacatgacctgggtttccaaagcaaaataagaaagggtgaaaggccaaacgggaaccaaaaatcttaaagggacaattaggaaaccgatggattccctgactttcattaaccgccccc

SEQ ID NO: 48633 - protein, 100 aa, Zea mays
  misc_feature: Ceres CLONE 1458098-F
  misc_feature (13)..(81): Pfam Name: LSM Pfam Description: LSM domain
  misc_feature (81)..(81): Xaa is any aa, unknown, or other
  misc_feature (83)..(83): Xaa is any aa, unknown, or other
MSWSAPDDILLSTSLAGFLDKKLIVLLRDGRKLLGTLCSFDQFANVVLQGACERVIVGETYCDVPSGLYVIRGENVCFNRXLXRRKDELPAHMTWVSKAK

SEQ ID NO: 48634 - DNA, 808 bp, Zea mays
  misc_feature: Ceres CLONE 1458103-F
  misc_feature (294)..(294): n is a, c, t, g, unknown, or other
  misc_feature (300)..(300): n is a, c, t, g, unknown, or other
  misc_feature (301)..(301): n is a, c, t, g, unknown, or other
  misc_feature (330)..(330): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (361)..(361): n is a, c, t, g, unknown, or other
  misc_feature (362)..(362): n is a, c, t, g, unknown, or other
  misc_feature (371)..(371): n is a, c, t, g, unknown, or other
  misc_feature (476)..(476): n is a, c, t, g, unknown, or other
tggagctccccgcggtggcggccgctctagaactagtggatcccccgggctgcaggaattcgcacgagaccattacctagaacatcctaatcgaaaaatctgcggcggggttgattcgatttcgattcccttccccatccatcgcccacctcccctacagacagccaacgcaattcgctccccgaggcgcctccctgaccctgactccctccaccccacaacgtgcgcgctcactcgcgggcggggccgggcccgggccggcaggcacgctcaccgtcaccaccctttatattncctctnncgcgtcgcgcttcaaaactccctcagtcntcnnngctcgtccccctccccccctctacanntctcgaagnacccggggggcgcattgcttgccgcgcacccggtcccgctagggccccctcggggccctggaattcaatcccccccccggccgggctttggccggccccgtttcnggggggggaaggggggggagatttttcccggggggcaaaatttggcccaaaactgtgggccgggaaaaacaaaaaaaaaaaaaaaggcgttttggggaaaaaaaaaaacaacggtgtgtcgccctccccccgcgtgttggttcccccgaaaatggggggcgcgctttttttccccccccaaaaatccttttttttacccccttattttttcccccccccgccgggggtggtaacaaaaaaaacagaggggggggggcccccccaaaatttttttttttcctccccctccgccggagaaaaaccccccccggggaagaatggttttctccctc

SEQ ID NO: 48635 - DNA, 730 bp, Zea mays
  misc_feature: Ceres CLONE 1458106-F
  misc_feature: Encodes the peptide sequence at SEQ ID NO. 48636
aaactggagctccccgcggtggcggccgctctagaactagtggatcccccgggctgcaggaattcgcacgagaccattacctagaacatcctaatcgaaaactcatcgtcacaacgcgtcatcgagtaaaaatccagaggaaaccgaaaatccccaccgaacgcaacttaaaatctccccgtccctcctcgatccagccccgcggagaagagccatggccgattccgcaaccaacgacgcccccctggtcgccagcaaccagcccacggaggaggaggtgacggtggagagggccgcgccgaccgaagatcaggaggaggagaggctgcggaacctctagttcgtgaagcaggcagcggcccatgttctggtgctggtgactcctttgaacacgtattccaaggagggggccccccccgtctgcgtcaggatcaatcaggtcgagggcaccgtgaagggctgggacgggccccgtctacggaccggattccacaccttcccgttcgacctccgggaggccatctaccgcaaggggggtgagtcacgtgtaggaaaaatactgccgacgtccctcccgtgcggaagggagcgccccaaccttgggtctattcgtgctgcaaatggagggttcacccggggccgactgggttggaaacggaaccccgggccctggccaaagtcaaggctttgggggggggttcggagccaaagggctccggggaatattttt

SEQ ID NO: 48636 - protein, 41 aa, Zea mays
  misc_feature: Ceres CLONE 1458106-F
MADSATNDAPLVASNQPTEEEVTVERAAPTEDQEEERLRNL

SEQ ID NO: 48637 - DNA, 762 bp, Zea mays
  misc_feature: Ceres CLONE 1458108-F
  misc_feature: Encodes the peptide sequence at SEQ ID NO. 48638
  misc_feature (735)..(735): n is a, c, t, g, unknown, or other
  misc_feature (762)..(762): n is a, c, t, g, unknown, or other
ggagctccccgcggtggcggccgctctagaactagtggatcccccgggctgcaggaattcgcacgagaccattacctagaacatcctaatcgaaaaactccacacccacactccgcccatcggctgccatggcgaccagggcggcggcggcagccacgctcacggcggctacgtcctctcttcttaggcgctctacctcgctgcggccgcagggtctccgggtcccccaccgcgtgcctccccaaaggtttgtgcgccatattgcttcatcatcaaacgaggaagctgctgccagagcagccgccgccactgctgacgctggaggaccaaccattttcgacaagatcattgcgaaggaaatcccttcgagcatcgtatatgaagatgaaaatgtgctggcatttagagatattaatccacaagcccctgtgcacgttctagtcatcccaaaagcgagagatgggctaaccggattagacaaggctgagccaaggcatacagaaatcctgggccggctcctttacgcagcgaaagtagtggcagaaaaggaaggtgtagcgagtgggtaccgtgttgtcatcaacaatggtgctgaaggatgccaatctgtctatcatctgcacctgcatgtacttggtggaaggcagatgaagtggccccctggtaaattacgaggggtgacatgtttgatttcctgtacccctctgtgagttgagtttgctgcttgtatgactnggtgtgcaaagggagaagagtggtggn

SEQ ID NO: 48638 - protein, 193 aa, Zea mays
  misc_feature: Ceres CLONE 1458108-F
  misc_feature (75)..(174): Pfam Name: HIT Pfam Description: HIT domain
MATRAAAAATLTAATSSLLRRSTSLRPQGLRVPHRVPPQRFVRHIASSSNEEAAARAAAATADAGGPTIFDKIIAKEIPSSIVYEDENVLAFRDINPQAPVHVLVIPKARDGLTGLDKAEPRHTEILGRLLYAAKVVAEKEGVASGYRVVINNGAEGCQSVYHLHLHVLGGRQMKWPPGKLRGVTCLISCTPL

SEQ ID NO: 48639 - DNA, 813 bp, Zea mays
  misc_feature: Ceres CLONE 1458109-F
  misc_feature: Encodes the peptide sequence at SEQ ID NO. 48640
  misc_feature (368)..(368): n is a, c, t, g, unknown, or other
ggagctccccgcggtggcggccgctctataactagtggatcccccgggctgcaggaattcgcacgagaccattacctagaacatcctaatcgaaaaaaaaactagcgcttactgttttgcacggccatagtctcgatccccaccgagtccagcaaacagcaccaccccaccctcttcgcggctccggcagccgcgccaccatggcttctcctgcgggggctaacagcggggcctcctcctcgagagggacacccttgcctttgcccttccccttccccgctgcggcgcacttcccctcccgcggcgccggtcccttcctgttccagcactatcacccggcctccacctcggagggggatgatgatttnaaaaagattagggaagcatggacgacgggaagacccaccccgaagaagcccaagttgtccaacgggggggttcccggatcgcccggggaaacaccccttcacccgtttcaggtatggggccttggggaaaaaaggggggaaaagggggggggggcaacccaaagggggcgttaatggggtttttttaaaccctggaactccaagatgggggccccatccccctggaggggaaagacccttggtactccccccaaaaaaatctaaaagggaaaaaaggcccctgccactctcttaaaaaaataaacggggagccgcggcccaccaatttgggggaacacgaaagaagaccccccccgcccaaacattaaaaaggggtgctctcgctggagaacggccttgttcttctgtgcgcccgtcccatattggcagtagaggggcgtagatt

SEQ ID NO: 48640 - protein, 113 aa, Zea mays
  misc_feature: Ceres CLONE 1458109-F
  misc_feature (56)..(56): Xaa is any aa, unknown, or other
MASPAGANSGASSSRGTPLPLPFPFPAAAHFPSRGAGPFLFQHYHPASTSEGDDDXKKIREAWTTGRPTPKKPKLSNGGVPGSPGETPLHPFQVWGLGEKRGEKGGGATQRGR

SEQ ID NO: 48641 - DNA, 743 bp, Zea mays
  misc_feature: Ceres CLONE 1458111-F
  misc_feature (416)..(416): n is a, c, t, g, unknown, or other
  misc_feature (418)..(418): n is a, c, t, g, unknown, or other
aagctggagctccccgcggtggcggccgctctagaactagtggatcccccgggctgcaggaattcgcacgagaccattacctagaacatcctaatcgaaaaaaacaaacaattggagctgcacgcatgtcccaaaagcccgtcaagacaatcaaacctgcctccaggacctcgatctcaaccggtaacaacagacccgacaaatcctgcatcaacgggacccatgggttttgatctgcagcgctcaaagtccgccgtcgtcgtctcaatcctcgtagagtcgaagtcatagaagaatcaaacagcgcgccgctcctctctcggatctaagcgaggcgagctgcggcgccggggggtcgcgggagggacgaggatgaactggatcgggcgcaagatccacctctacaatgcccccancngcttcaacatgctcgattgggtgggacgcctacctcttcagtatccttccccgaattgctttcctggggggcgggcccccttatcctcctgaaatcggtgggtaaattccgcgccggggtacaccccgggggttttttttacagggtttcgctttccaaaggaacccaacctggggggatgggggggatccgaacttatttttggcccgggcgcggcccaaaaaaaaaaaaaaaaggtttttctaccccccccaccccggggggggccccgggaccaaattccccttaaaggggaggatataaccccccccctcggggcctgttt

SEQ ID NO: 48642 - DNA, 915 bp, Zea mays
  misc_feature: Ceres CLONE 1458114-F
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (471)..(471): n is a, c, t, g, unknown, or other
caggagcgccccccggcaaaccacccaaancccnnnncacaccccccccaaagctggagctccccgcggtggcggccgctctacgaatagtggatcccccgggctgcagtaattcgcacgagaccattacctagaacatcctaatcgaaaaaccatcacagtacgtacgcacgcacactccagcccagcagcggaagcgcccctcggccctcgctcccacaacaagctcaagccagccttctctctctgctccaatggcgcgcttccagctcgcagccgtggccatggccatgctcttcgccgcggcggcggcccgggccggaaacggataactcgagccctaatcataaacctgccctccgtgtggcttatatttttgacttactccccgctccggtggcgtccgttagatcgcggatgttgtaacccgacaacagggggaggggaaaaaataggaagataaaaacccanacctggggtaaccaccaggggggttatatagtgcccacctcaggaaccgtgggatccgcgcgggagaagtgatgggttatgggaccggtttcgctgggattaataaagtgatatccggcgcgccgctttgtatattcgtccagggcttaataattatcggtgctaccgagtggtctatatgcgcgttttttatgagtggggttggaatggtagtgcggctacaccgcgacgttaatgggcccgggcgcggcggttggtattactaaaattctgctccgggcttcttgtcttatattcattcgctagaggagtgtcgcgcgcgatcccagccgagttttttgtttctatcccccaccattatccggttctgattttggcgtacgtatgttaggcaagtaaatcgccgccatgattaaatgataggaggcgtagagtaaagagcgg

SEQ ID NO: 48643 - DNA, 792 bp, Zea mays
  misc_feature: Ceres CLONE 1458122-F
  misc_feature: Encodes the peptide sequence at SEQ ID NO. 48644
  misc_feature (375)..(375): n is a, c, t, g, unknown, or other
  misc_feature (402)..(402): n is a, c, t, g, unknown, or other
  misc_feature (453)..(453): n is a, c, t, g, unknown, or other
ctccccgcggtggcggccgctctagaactagtggatcccccgggctgcaggaattcgcacgagaccattacctagaacatcctaatcgaaaactcggtccctcctctgcttcacacagaccagtgcgcgctcaattcccccctctagcgcctccaccgcaccaaaccggtccaacgggacctatgctctagcctcagagcaaaccaccgcctgaattgtgcggcaattgggggaggattcgcggcaggcagggcgcggatccgttggcgggatgattgcggctgtcaacagagtgccggcgggctggggcgaggatgagatgtccgtgctgcccacgcacaccaaggtggtggtcaccggcaaacaccgcaccangtcggtgctcgtgggattgcacggggnccccgaagaaggccgtcgggctcgggggatgggattggctgctgcttgcanttattcaaacaaaaactttccaagtgcatgcccggtcccttactattgaaaaaaaggaaacctgccccgaatgcctttatggggaaaaaaacctccaatgggcacgaggaagaaagaaaattttatttgggaaaacgggggggaaaaattcaaaatgggcccccaaagaggccttttccccaaacccccggggcccggagaagggaaataagggtttcccccaaaaaacccccgccccgctagggggtggggccccccccccaaaaagggtgttttctcccccccagagccccacaaagttgttcccacaaattaaaaaagggcccccgcgagaaaatg

SEQ ID NO: 48644 - protein, 76 aa, Zea mays
  misc_feature: Ceres CLONE 1458122-F
  misc_feature (35)..(35): Xaa is any aa, unknown, or other
  misc_feature (44)..(44): Xaa is any aa, unknown, or other
  misc_feature (61)..(61): Xaa is any aa, unknown, or other
MIAAVNRVPAGWGEDEMSVLPTHTKVVVTGKHRTXSVLVGLHGXPEEGRRARGMGLAAACXYSNKNFPSACPVPYY

SEQ ID NO: 48645 - DNA, 932 bp, Zea mays
  misc_feature: Ceres CLONE 1458125-F
  misc_feature: Encodes the peptide sequence at SEQ ID NO. 48646
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (807)..(807): n is a, c, t, g, unknown, or other
  misc_feature (858)..(858): n is a, c, t, g, unknown, or other
gacttgccccctcgcccaattttctaaaaaaaaannnnnaagtcatnnnnnnnnnnnnnnnttccccgcggtggcggccgctctagactagtggatcccccgggctgcaggaattcgcacgagaccattacctagaacatcctaatcgaaactctagccaaaaccctagcagccgcccggtgctccctctctgcagatctcccttcgcagccgccgaggaaccccttcacagcgcggaagatggctgaacaggaggccccagtcgcggttgaggcaccaacccccgttcttggggagcctatggacttgatgactgctctgcccctcgtgatgaagaagtcaagtgctcatgaacggtcttgtgaagggtcttccttgagggtgccaaggcccatcaaagaagaacgccgcttaatttttgtgtggtttggggggggacagtggaccggggccaaattaacattcaagtttggggggaaaggggcgacccccccttttaataaaaatgggttataagggtgaattggttggggtttcgggcggggtgtcagggacattatagatcgtgaacgggggggcccgcggcgcgcttgtgcaagagccacccccaggctcctccaatataccccccaggcgcaaaagataataggcgggcgggaaaagagagttgtgctcctgcggagcttataatgtcgctcttcgcgaagcgtccatgttgtgcggggcatatctgacagagagtctttttattatactagtggccgtttcggggcgcgattgatgtgagggggcagtttttttaatatnagctcgccgccacgctatattttaagtggtcggcacgcgtcttgtaatacnctaaagaacgacgcaccccccgaacaagatacaaagcggtgagggcggcgcccgcatatagtcgtgctccgggt

SEQ ID NO: 48646 - protein, 91 aa, Zea mays
  misc_feature: Ceres CLONE 1458125-F
MAEQEAPVAVEAPTPVLGEPMDLMTALPLVMKKSSAHERSCEGSSLRVPRPIKEERRLIFVWFGGGQWTGAKLTFKFGGKGATPPFNKNGL

SEQ ID NO: 48647 - DNA, 734 bp, Zea mays
  misc_feature: Ceres CLONE 1458126-F
  misc_feature (299)..(299): n is a, c, t, g, unknown, or other
  misc_feature (362)..(362): n is a, c, t, g, unknown, or other
gcggtggcggccgctctagaactagtggatcccccgggctgcaggaattcgcacgagaccattacctagaacatcctaatcgaaaaagacagaagacagcccgtcagcccctctcgtttttcatccgccttcgcctccaaccgcgtgcgctccacgcctcctccaggaaagcgagagcttctgcataagaacaacaaatcaaaagcttgatcagctcggtgcctacaaaacctcaacaaccaagtttcatgtctgatctcgacgtccagcttccatctgcctttttgatcgttgctgangcaaatgctgaggactctggtgctggtccctgaaacgaagattatgtgcatgtgcccatcccngaagccgcacggcaaaagagtctgactacgtccagggctgaagaaaattcagctttacaagatccccaggatttgaaaaaagattccgctgcaggggactgtaatcaagaccccaaatgggcagggttttccttccgggggcacccccaaaatgtccccctttccctcacgggggggtttgcaaaaaaaaaatcctatttcccggtttttaaaggacacaaaaatgtgcccccatattgggcccccccattggggggggggagaaccaccattttttttttttttttttataaaaaaaaaaaaattttttttttttgccgccccgctcctaaaaaatttttttttcttttttataagccgccgccggggggg

SEQ ID NO: 48648 - DNA, 728 bp, Zea mays
  misc_feature: Ceres CLONE 1458131-F
  misc_feature: Encodes the peptide sequence at SEQ ID NO. 48649
  misc_feature (405)..(405): n is a, c, t, g, unknown, or other
  misc_feature (435)..(435): n is a, c, t, g, unknown, or other
  misc_feature (436)..(436): n is a, c, t, g, unknown, or other
ctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcatgcgctgatggtggtgacgctgttcccgctggggcggctgctgctggtgctgtcggggctggcgctgacngcctcccgtggtggggctggccgtgccacnnccgtggtcctgatcttcagccccgtgctcgtccccgcgggctgctcatcggacgggcgtcatggggtccccacgtccggccccctggggcccggggggcctgccccccctcaagtgcctcccaaacggggggggaggggttccaggccccccggattctgggaagaggcccccccagagggggaagaccgggccacggggcccaaaaacccggaggggggccggcccccctgggggggcaaaaagccccccccgggaaataaagtcccccccttgggcgggggggtctccca

SEQ ID NO: 48649 - protein, 177 aa, Zea mays
  misc_feature: Ceres CLONE 1458131-F
  misc_feature (44)..(144): Pfam Name: Oleosin Pfam Description: Oleosin
  misc_feature (81)..(81): Xaa is any aa, unknown, or other
MADRDRSGIYGGAHATYGQQQQQGGGGRPMGEQVKGMLHDKGPTASHALMVVTLFPLGRLLLVLSGLALTASRGGAGRATXVVLIFSPVLVPAGCSSDGRHGVPTSGPLGPGGPAPPQVPPKRGGRGSRPPGFWEEAPPEGEDRATGPKNPEGGRPPWGGKKPPPGNKVPPLGGGVS

SEQ ID NO: 48650 - DNA, 720 bp, Zea mays
  misc_feature: Ceres CLONE 1458137-F
  misc_feature: Encodes the peptide sequence at SEQ ID NO. 48651
  misc_feature (412)..(412): n is a, c, t, g, unknown, or other
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaactttcgaatccatctctagggctcctgtttctccccatcctccccccaccccaccccccaccaaacagattcaatccgacaagacaagcatccatgtcgtcgtcacgccggagctcgagccccgacagcaacgacacgacagacgagcgcaagcggaagcggatgctgtccaacagggagtcggcgcggcggtcgcgcgcgcggaagcagcaacggctggagaactggtggcgaagtggcccgcctgcagcgagacgcggcgacgcagccgcacgcggcgctggacgcgactgggcaggggggacggacnacgcgtgctgcccgccgccagccaactgccggccgctgcatccttggcgggtccccaagtgtcnaatgggcgggccccgcaaattcggaaaagtcaccaagacccatggtcggcttgggaaccgtctcccccgaggggaccacgggtttgaaaattgaaccccccgggggagaaacattttggggggggggggggttccccggggggatttttcaaaaaaccccgggggggggggtctttgggaagagaaaatcccttgggggggaaaaaaagccccccaaaaaaggggggggggaaaaacctgtggg

SEQ ID NO: 48651 - protein, 124 aa, Zea mays
  misc_feature: Ceres CLONE 1458137-F
  misc_feature (73)..(73): Xaa is any aa, unknown, or other
  misc_feature (94)..(94): Xaa is any aa, unknown, or other
MSSSRRSSSPDSNDTTDERKRKRMLSNRESARRSRARKQQRLENWWRSGPPAARRGDAAARGAGRDWAGGTDXACCPPPANCRPLHPWRVPKCXMGGPRKFGKVTKTHGRLGNRLPRGDHGFEN

SEQ ID NO: 48652 - DNA, 740 bp, Zea mays
  misc_feature: Ceres CLONE 1458139-F
  misc_feature: Encodes the peptide sequence at SEQ ID NO. 48653
  misc_feature (482)..(482): n is a, c, t, g, unknown, or other
  misc_feature (528)..(528): n is a, c, t, g, unknown, or other
caaagctggagctccccgcggtggcggccgctctagaactagtggatcccccgggctgcaggaattcgcacgagaccattacctagaacatcctaatcgaaaagttctgtttgttgtttttcttctcccgtccgcagtccgcttggcgtgcgcgacggctagggcgaccgccgccgccctacgccctacgtccagctgcccatgtcttcttcgggccccttgccggcgggaactcaccacaccaggaatcgtgctggcaaccggcgcaagtctggagatagggctgataaagctaattactcctacaataatgatggagagaagagcaatgttccttcattaaagaaccttcctccaattgttcatcatgaaacattcttcagcaatgttcagaatgactacaatcaaacaggattagtgcctttggagggatgttctgccagtgaggcttcacagcttctcagtgatcgctggactgctgncatcaacatgtacaatgaccaaacaattgacccctcagagaaaccngtatgtactctggatctagcagctcatcatggggtcacctgaaagctcctcatcagatgactccctcgaggagtgcgccgtgcatggacctcccaccgaactgtgtcgcctgtcgacccctgaaactatcgagtcacatctgcatcatatgcgtatgactaattatggagacagctttcgtcggtctattgttgatgatccatccccgatag

SEQ ID NO: 48653 - protein, 122 aa, Zea mays
  misc_feature: Ceres CLONE 1458139-F
  misc_feature (94)..(94): Xaa is any aa, unknown, or other
MSSSGPLPAGTHHTRNRAGNRRKSGDRADKANYSYNNDGEKSNVPSLKNLPPIVHHETFFSNVQNDYNQTGLVPLEGCSASEASQLLSDRWTAXINMYNDQTIDPSEKPVCTLDLAAHHGVT

SEQ ID NO: 48654 - DNA, 772 bp, Zea mays
  misc_feature: Ceres CLONE 1458142-F
  misc_feature: Encodes the peptide sequence at SEQ ID NO. 48655
ggagctccccgcggtggcggccgctctagaactagtggatcccccgggctgcaggaattcgcacgagaccattacctagaacatcctaatcgaaaaattcattcatcactcaccagtcaccaccactgccgcgaccgagagagtcagagagagcaggcggcggcaatggctggcgctggggacgagtactactacggcgggccgggccagcgcggcgcgccccacggcctgctgctggcggtggtggtgggcctcgtggtggcgggcccgctgttcctgggcggcggcggcgaggcgctgacggaagccgtggcggagctgctgagcccggtggggctcctcctcctccccgtgtgcctgctgttcctcatccgcctcctctcgtccgaccgcggcgcccgcgcgctcgccgacgccttcgccttcgggcgggtcccccgacgccgtccaccgcgtgggagggtccccggtcggcgtcgcgttcttgctcctcctcatcctcgcgctgctctactaccgatcctcgctcttcggcggcgacggcggcgacaaccagtaggatagaaaagctggccgttgccatccctggctgtctggttgggttggtttccggaaggcaaagcccgccaaagggcctcttggcaaaaatggcggggggaaaatcaacggaaggcgttaatccggttgttacttggccggtttgggccccccaaaaaaaaaaaaaaaagctttttcatcccctccaccccgggggggggcccggtaccatttt

SEQ ID NO: 48655 - protein, 132 aa, Zea mays
  misc_feature: Ceres CLONE 1458142-F
MAGAGDEYYYGGPGQRGAPHGLLLAVVVGLVVAGPLFLGGGGEALTEAVAELLSPVGLLLLPVCLLFLIRLLSSDRGARALADAFAFGRVPRRRPPRGRVPGRRRVLAPPHPRAALLPILALRRRRRRQPVG

SEQ ID NO: 48656 - DNA, 812 bp, Zea mays
  misc_feature: Ceres CLONE 1458143-F
  misc_feature: Encodes the peptide sequence at SEQ ID NO. 48657
  misc_feature (396)..(396): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaaatacctctcggagctagccaaacagagttgcgatccttaaatttcttggctgttttgcccaggtatccaaacagattgcgatcgcgagtccggaggtcggcagcatgaaccaccaccaggcccagcccgtccgcaccggcgacgtctacccaccgaccgccgtcaagcgagaggcgagccacgagcgggacaagatcattgaacaaggagatcagcggggcggcgccctccacgtcgaccagacagatcttcccgccggcagacgcatggtcaccgccagcgcaggcggccagntgatggcacagttcaccgtgcccgtgccggacaactaaggtcgcgaaggcaacgaaacgcgtcaccctccgggaaggcccctccatgccgcggcgaaaaacttcggcgggcgaaaagcccctggaacctccccaaaccctgtgggcctttcaagccccccaaaggcccccccaacggggcttggggggaaaaataacccgggggggttgggggcgcccccccccaaaagggccccgaaaacaaaacccnaaacccgcgaaaaccgggcgccgggggccaaaggggacccctccgggcggttgggggggggcaaccccccgggggagtggccgcccaaaagggcgcccaaagaaacccccaaaaggggggcgcgccccccccaaaacacaggagagagaggcggccgggggcccccc

SEQ ID NO: 48657 - protein, 75 aa, Zea mays
  misc_feature: Ceres CLONE 1458143-F
  misc_feature (64)..(64): Xaa is any aa, unknown, or other
MNHHQAQPVRTGDVYPPTAVKREASHERDKIIEQGDQRGGALHVDQTDLPAGRRMVTASAGGQXMAQFTVPVPDN

SEQ ID NO: 48658 - DNA, 765 bp, Zea mays
  misc_feature: Ceres CLONE 1458146-F
  misc_feature: Translation starting site: 176
  misc_feature: SWISSPROT Homolog: EC 3.2.1.23 Beta-galactosidase
aaagctggagctccccgcggtggcggccgctctagaactagtggatcccccgggctgcaggaattcgcacgagaccattacctagaacatcctaatcgaaaaattttcacgccgcgccacgccacggctctctcctctcctctcctctcctctcctcctcccatctcatcatctcatggccgcctcgcgcgtcggcgacccggcggagtcctcgcgcctgcgtatcagcgacgagatcgcgtgggccgagatcagcggtatcgataccgtcgacctcgagggggggcccggtacccaattcgccctatagtgagtcgtattacgcgcgctcactggccgtcgttttacaacggcgtgactgggaaaaccctggcgttacccaacttaatcgccttgcagcacatccccctttcgccagctggcgtaatagcgaagaggcccgcaccgatcgcccttcccaaaagttgcgcaccctgaatggcgaatggaaattgtaagcgttaatattttgttaaaattcgcgttaaatttttgttaaatcagctcatttttttaaccaatacggcgaaatcggcaaaatcccttataaatcaaaacaatagaccgagatagggttgagtgttgttccagtttggaacaagagtccactattaaagaacgtgcactccaacgtctaagggcgaaaaaccgtctatcagggcgatggcccactacgtgaaccatcaccctaatcaagttttgtggggtcgaggtgccgtagagcac

SEQ ID NO: 48659 - DNA, 755 bp, Zea mays
  misc_feature: Ceres CLONE 1458148-F
aaagctggagctccccgcggtggcggccgctctagaactagtggatcccccgggctgcaggaattcgcacgagaccattacctagaacattctaatcgaaaacactcgctcgccaaaccctagctatcaacatcctacctctccctcctggagatcgcccagcagcgcgacatccttggctacaacttcgtctccaacggcacgctcagtgacgaccgtgccactgctccccaggcggacccacctcgcgatggtctcccagatcgcgccagcgctcgataccctccacttaggactgaaccgccgtcgtgcacgcaacatcacttcggcgatagtctcgaggtagcagacctacgggatgcgtctttgattaggcatttccatcatcatccagcgaatgaaatgtgcgcaccgaaggcacgcgggacttccggtgctcacctcgcctagctgggccccgggacatttgcaagggcgctcggtattggccttggaaactgtttggcccaaaatacaggcctaaaaaaaggggggcccccacccccggggcccccaaagacccggggggttttggggacccaatttcctttattttccttggtaaaaaaaattcaaacagggaactcgggaaccctttccccaaaaagaggttttcccccctcccccccccccgggggatttttcttgccccccccccccacaaaaaaaaaattacaccttttttttttacaaagggggggtttttttctacattt

SEQ ID NO: 48660 - DNA, 764 bp, Zea mays
  misc_feature: Ceres CLONE 1458152-F
  misc_feature: Encodes the peptide sequence at SEQ ID NO. 48661
  misc_feature (445)..(445): n is a, c, t, g, unknown, or other
  misc_feature (454)..(454): n is a, c, t, g, unknown, or other
caaagctggagctccccgcggtggcggccgctctagaactagtggatcccccgggctgcaggaattcgcacgagaccattacctagaacatcctaatcgaaaaactcccgtcggtggattccatgtccaaccgcgtcgccggaggccggaaccatgaagcctgtcagtgtcgccgaacacaacaaccaccagcctcgcctgcactcccccacgccggcgtcggcgaccaagatctcgatccccatctcttcgagcgaggcggcgctgttcgggaagggtaggtacaaggtgtgggccctcgcggccatcgcgctcctagcgctctggtccatgttcgccgcctccgtcacgctgcgcttgtcctccgtcgatctcgccaccacgttcggggacgcgagcgatccgctcatcgacgaacttgatcccctggagatggagcaaaganaaaaactantgcccccgatgtgggatgtgtaccaccgcccagataaccgtgtacggttcccaggtttcgggaaaaaacttttaaggttccaattaagaacttgccggggaagaaccccttaccccgggggcccttattctaaaatgttccgggtgcacccccagggcccgagggttgcccctccccaaaaggttttgggaaccaggagaacggccaatttttggagaggggggacgtgccccccaggggaaaaaatctaaaggggggcgcccccccaaaaaagggggtggtaatctcccccctccgccccccattatat

SEQ ID NO: 48661 - protein, 183 aa, Zea mays
  misc_feature: Ceres CLONE 1458152-F
  misc_feature (6)..(164): Pfam Name: DUF1195 Pfam Description: Protein of unknown function (DUF1195)
  misc_feature (98)..(98): Xaa is any aa, unknown, or other
  misc_feature (101)..(101): Xaa is any aa, unknown, or other
MKPVSVAEHNNHQPRLHSPTPASATKISIPISSSEAALFGKGRYKVWALAAIALLALWSMFAASVTLRLSSVDLATTFGDASDPLIDELDPLEMEQRXKLXPPMWDVYHRPDNRVRFPGFGKKLLRFQLRTCRGRTPYPGGPYSKMFRVHPQGPRVAPPQKVLGTRRTANFWRGGTCPPGEKI

SEQ ID NO: 48662 - DNA, 746 bp, Zea mays
  misc_feature: Ceres CLONE 1458153-F
  misc_feature: Encodes the peptide sequence at SEQ ID NO. 48663
catagctggagctccccgcggtggcggccgctctagaactagtggatcccccgggctgcaggaattcgcacgagaccattacctagaacatcctaatcgaaaaactcacgattggagtttcacctcggcagcccagccagccagtggttcctcggctcggaggaacaggcgaacagcaagagcttctgaagatgaaggcgatccccgtggctctcctgctcctcgtcctggttgctgccgcctcctcgttcaagcatctcgccgaggcagcagacggcggcgcggtgccggacggcgtgtgcgacggcaagtgccgcagccggtgctcgctgaagaaggccgggcggtgcatgggcctgtgcatgatgtgctgcggcaagtgccagggctgcgtgccgtcggggccgtacgccagcaaggacgagtgcccctgctacagggacatgaagtcccccaagaaccagcgccccaagtgcccctaggccctaccgctctaagggagggaggatgacccaggatttcgctcgcgatcctgcacagcttctagtcttgtactgctagtttagcgcgccgagcgtcggaatgtcgcgacggttccttccgtgcttgtgtgctgtgtttctcctcggacgtgctataacctagaataataaccaatgcactgtatctgtgtgcttgtcttttgggatgtgatggctcttcaacactagccgccgaagagaacagggatgagcaagaacgtcctt

SEQ ID NO: 48663 - protein, 96 aa, Zea mays; identical to SEQ ID NO: 44310
  misc_feature: Ceres CLONE 1458153-F
  misc_feature (1)..(96): Pfam Name: GASA Pfam Description: Gibberellin regulated protein

SEQ ID NO: 48664 - DNA, 801 bp, Zea mays
  misc_feature: Ceres CLONE 1458156-F
  misc_feature (341)..(341): n is a, c, t, g, unknown, or other
  misc_feature (356)..(356): n is a, c, t, g, unknown, or other
  misc_feature (414)..(414): n is a, c, t, g, unknown, or other
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaagcgtcgcatctttcctctcgtaacgcgtatcagtgccaaccaggcagccatcgccgcggccctcgtgcctctgcatcgcggcgcgccttggtgctccatccacgtaatccctgaggtgcggcacaggcgtggaggtatctcggcagtcggcagggcggctgagagttcggtcccagaaagatggcggggggccctgatgtcgcgggcttgatcgaagatgatgcggtctccgtcatcancgaggggctagtggntgtgtgacatatgtgggcagtgatagtgcccctcatcatattgcaaactgcgctcggngcaatgcccgtgaacacggttactggaatgaaggggttgaccntccctgatcccgcccaaaagggtttgaaaaagaaggccaagcgaacgccaaaggggccacacaaatctaaacaaagcctggggtttctggaaagggggttggggccccaaattcccttgaaagaagggaccccaaagggcggggggaaaaatggggctttgtttgggggggtgggtgttggaacacccgggaccccgaaactgtggttttgcccccccgagaaaaaaaacccctgtgtttggaaaaaaaggggggggccacaaaaaaagggggaatttttttcccccggggaaaaaaaaaaatgggggaaaaaaatcgttgggggagaaaaaaaaaaaaaaaaa

SEQ ID NO: 48665 - DNA, 754 bp, Zea mays
  misc_feature: Ceres CLONE 1458159-F
  misc_feature: Encodes the peptide sequence at SEQ ID NO. 48666
  misc_feature (387)..(387): n is a, c, t, g, unknown, or other
  misc_feature (425)..(425): n is a, c, t, g, unknown, or other
  misc_feature (468)..(468): n is a, c, t, g, unknown, or other
aagctggagctccccgcggtggcggccgctctattctagtggatcccccgggctgcaggaattcgcacgagaccattacctagaacatcctaatcgaaaatgggtctctttaggctagctctgccagtcttgctctccacactctctctgctactagctactagcagtagagcagtagaggagagagcatctacctagcgccgtcggacggatcggagctacctcaccgccgaccgcgcgcgaagagatcgatggctcatgctgctacgctcgctgctgcagccgcggtcgtcgtcctcatcgtcgtctgctgctgctcctcttcggaggccgccagccacagcgccaacgcgaggcagccgccgctggcgcccgacctgtcctggnacttctacaagcggagctgccccaccgcgaatccgtcntgcggagttcgtgcaagaacccgtggcaaggacgccggcctcncgccggcctcctccgcctccatttccagaatggtttgttcaaggttgcgaccggtccgggctctggaacggtcacccccggcccggggaaaaaaggggcccccaacctccggtgggccccacgggttaaggcgtaaaaaattcccaaccccccccaaaaggagggggggggaaatttggtttgttcaaaatctccccttccccgaggaaaatttcttggtccgggggccccaaaagggccccgggggcggccaccccattttccccaaagagattctcgggccccc

SEQ ID NO: 48666 - protein, 167 aa, Zea mays
  misc_feature: Ceres CLONE 1458159-F
  misc_feature (46)..(46): Xaa is any aa, unknown, or other
  misc_feature (73)..(73): Xaa is any aa, unknown, or other
MAHAATLAAAAAVVVLIVVCCCSSSEAASHSANARQPPLAPDLSWXFYKRSCPTANPSCGVRARTRGKDAGLXPASSASISRMVCSRLRPVRALERSPPARGKKGPPTSGGPHGLRRKKFPTPPKRRGGEIWFVQNLPFPEENFLVRGPQKGPGGGHPIFPKEILGP

SEQ ID NO: 48667 - DNA, 805 bp, Zea mays
  misc_feature: Ceres CLONE 1458160-F
  misc_feature: Encodes the peptide sequence at SEQ ID NO. 48668
  misc_feature (312)..(312): n is a, c, t, g, unknown, or other
  misc_feature (449)..(449): n is a, c, t, g, unknown, or other
  misc_feature (452)..(452): n is a, c, t, g, unknown, or other
  misc_feature (460)..(460): n is a, c, t, g, unknown, or other
  misc_feature (461)..(461): n is a, c, t, g, unknown, or other
aagctggagctccccgcggtggcggccgctctagaactagtggatcccccgggctgcaggaattcgcacgagaccattacctagaacatcctaatcgaaaagaaacgagtctagcaaacaaaccgcagcctgagcacccgaggagactccgtgcgaccgaagccagagccagcggaaccgaacggaagcgagacccccggcggctagcgagatggacggcggcgccggcgaggaggggaagcaggagcggcacctggtgctggcccacaagctcttccttctatcccacccctccgttgatgacctctccanggtcgccctccgcgccgaagtcctcgacaccgtgaaatccgatgatatgggcggacgctggtttgagtcccctgggtcccccggggggttgttgctgggaaaggggacccccccctctgctggccaaaatgcttggnaangattgacnnaggaaatcccgcagcctgatgagaaaattgctgatgcggaggaaaactggggtggagacgaaatcccgggaagcatttttggccaaatctttgtattttttaagggtccggaaaaagggaaaagcccctagaaacctttaaacccctagaggagaaacttggttttttggcccaaaaagaggaatttgggtcccacctttgggaaaagaggttttcttcccgggggttttgtggtgaaaaaaaaccccccaaaaagaaaaaaatttttttttaaaaagacgccttttgaaaaaaaaaaaacccagggtgttttgggggggtggttgggggagagacaaattaaa

SEQ ID NO: 48668 - protein, 126 aa, Zea mays
  misc_feature: Ceres CLONE 1458160-F
  misc_feature (34)..(34): Xaa is any aa, unknown, or other
  misc_feature (80)..(80): Xaa is any aa, unknown, or other
  misc_feature (81)..(81): Xaa is any aa, unknown, or other
  misc_feature (84)..(84): Xaa is any aa, unknown, or other
MDGGAGEEGKQERHLVLAHKLFLLSHPSVDDLSXVALRAEVLDTVKSDDMGGRWFESPGSPGGLLLGKGTPPSAGQNAWXXLTXEIPQPDEKIADAEENWGGDEIPGSIFGQIFVFFKGPEKGKSP

SEQ ID NO: 48669 - DNA, 751 bp, Zea mays
  misc_feature: Ceres CLONE 1458162-F
  misc_feature: Encodes the peptide sequence at SEQ ID NO. 48670
  misc_feature (442)..(442): n is a, c, t, g, unknown, or other
caaagctggagctccccgcggtggcggccgctctagaactagtggatcccccgggctgcaggaattcgcacgaaaccattacctagaacatcctaatcgaaaaactgcgactgtgagcttcgttcgttcagttcatccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccacccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccacccctgcangccggccggaggaagctagctaattattataagctaaataaagtatagcggcgtccgctgtgtgtgtttcgagtcagtcagtcagttagttgcgtgccatgggctgcatgctctgagtctgaaatgatgtgatgcctgattgccggcttcttgtcttgtaatcctcccctgccccctcggccccttctgggggcaaccaaggggttggggttgggtttggggggtgccaccacgtatcaggcttaccatggccccgggttgggtttgggcccatcccccctaaaaaaacctatatccttaaaaaaaaaa

SEQ ID NO: 48670 - protein, 40 aa, Zea mays
  misc_feature: Ceres CLONE 1458162-F
  misc_feature (1)..(38): Pfam Name: Metallothio_2 Pfam Description: Metallothionein
MGVAPSKGHAEGGFEAAAGAENGGCKCGGNCQCDPCNCGK

SEQ ID NO: 48671 - DNA, 765 bp, Zea mays
  misc_feature: Ceres CLONE 1458167-F
  misc_feature: Translation starting site: 211
  misc_feature (420)..(420): n is a, c, t, g, unknown, or other
  misc_feature (435)..(435): n is a, c, t, g, unknown, or other
ctggagctccccgcggtggcggccgctctagaactagtggatcccccgggctgcaggaattcgcacgagaccattacctagaacatcctaatcgaaaagaacaaaagaacagctcgccgcggctccgaatggcaacttccccgaaccccgcgacgattcaccgagccggcgcccagtgacccttccagaagcttccagaaggtcaccgccatggccgcgcccttcttttccactcctttccagccctacgtctaccagagccagcaaggatctgtgacggcgtttcagatatccggtggagatgtgcaggtcctgcaggtgatgctgaagtctcaggagaagctgactgcaaaaccaggtgcaatgtgctacatgtctgggaatatgcagatggggacacatttactgccctgaaatgantggagcgtgtggcantgaatttttgggaaacgtgtagcagcaccatttcctttaatctggatctgatgatggatatgtccggattgctgcaccatttcctggggaggaactgccgggtaatcctaccaactttatgtgaaaaactccttggccgggaaaagcctttccatgtccggcaaggatgcccccgtccttatcaacttgacccaggccccggaattttggaattggggcaaaagagcccttaaaaaaaatttggggccgggggagggttttcttgggggggggggaaaccaccaaaaaacacctccccccaaagaggaaaatatttgttttttttttttt

SEQ ID NO: 48672 - DNA, 765 bp, Zea mays
  misc_feature: Ceres CLONE 1458168-F
  misc_feature: Encodes the peptide sequence at SEQ ID NO. 48673
aaaagctggagctccccgcggtggcggccgctctagaactagtggatcccccgggctgcaggaattcgcacgagaccattacctagaacatcctaatcgaaaactactgcggcttcaggactcgacctcttgcgccgccgccatgaccttcaagcgccgcaacggcggccgcaacaagcatggccgcggtcacgtcaagtacatccggtgctcaaactgcgccaagtgctgccccaaggacaaggcgatcaagaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccgcgtccgatccccgtgagaagcgcagggaccgcaagccgccggagcgcttcaggcgcagggaggataggcctgctggtggacaaggaggcccccgccctggtcctggtgctgctgctccagctccagcacctgttgctgctcgcccataggctttagcttttcgaccgtgttaagtcttctgcccactcagtttcggaattgtcgcctatgggtgtgtgaagctgctatattagagttactttttgtctaaagcctgaacattttcaaagaatttgaatatctgaatattttgaatatttgtgctgagtttttcgaagaatttgaatatctgaacaaaaaaaaaaaaaaaagcttatcgataccgtcgac

SEQ ID NO: 48673 - protein, 89 aa, Zea mays
  misc_feature: Ceres CLONE 1458168-F
  misc_feature (1)..(89): Pfam Name: Ribosomal_S26e Pfam Description: Ribosomal protein S26e
MTFKRRNGGRNKHGRGHVKYIRCSNCAKCCPKDKAIKRFQVRNIVEQAAIRDVQEACVYDGYVLPKLYAKVHHCVSCAIHAHIVRVRSP

SEQ ID NO: 48674 - DNA, 751 bp, Zea mays
  misc_feature: Ceres CLONE 1458169-F
  misc_feature: Encodes the peptide sequence at SEQ ID NO. 48675
aaagctggagctccccgcggtggcggccgctctataatagtggatcccccgggctgcaggatttcgcacgagaccattacctataacatcctattcgaatatctgcggagcatgtccattcaaccacaatgcacgaccttcttgatcttgccgcaacgtcacgcaagactactctagctgcatggccgacccatgaggagaatgctgctgtccgtccccccgatactgcggccgataatgctgttgatgtaaaggcgtcaaatcgagaacctgattgaccaggcggacataagggacattatcttgcaaggtttcatcggtaggaggcccatatcgaagcttgccaaaatctcgagccagtgaaaattgaagctaaaaccaaaatgatatacgccaacatcgatcgcaaaccaccccgcgagcaagacaggctcgccagcaatctgggagcgctgagcctccgaccgcaggtgaacagggaggccgccgagctgaggctggagctgctacctcccgataccggacgagcaggtggctcacatccgacaaaccggggtcacgccttcctctttctcatgccggatctggtgcccgtgactctgattccttcgctgcatgaccacgctctgggagtcactcctactgtaaatactgatgaacctggaagactgtgatactcccgccatggttagaaaaatttgcctcgtgtccgacttggagttcgcccttgcgctcaagggagaccaaaatt

SEQ ID NO: 48675 - protein, 49 aa, Zea mays
  misc_feature: Ceres CLONE 1458169-F
MHDLLDLAATSRKTTLAAWPTHEENAAVRPPDTAADNAVDVKASNREPD

SEQ ID NO: 48676 - DNA, 830 bp, Zea mays
  misc_feature: Ceres CLONE 1458172-F
  misc_feature: Translation starting site: 169
  misc_feature (358)..(358): n is a, c, t, g, unknown, or other
  misc_feature (432)..(432): n is a, c, t, g, unknown, or other
atagctggagctccccgcggtggcggccgctctagaactagtggatcccccgggctgcaggaattcgcacgagaccattacctagaacatcctaatcgaaaagtagtctccgctcatccaccctcccttttttgttcttgacttgtgcagacgcagttgcatacacaaatggcgacttttcaaatctcttccactagcatgaccaccaaggcggttctcagaacccagccgaccaacaagctcatcgctaacaatagcccacaagtctccgttggatccgtcaagaaagtctcgagatcctttggcttgaaatgctcagccaattcaaggtgccaccatgatgtcagccgtgtacaanggtcagctcataggacccagaaggcgaagaacacgagttcgacgttcaggacaaccagttcatattggacccanctgaagaggcgggattgactttgcccttacccttgcaaagaccggagcgggttccacctgccccggtgcaaaagtggaaagggaaaattaaaccccccagaggggacctttcctggggaaaacccctgggaaaaagggttttcccttaaacttggggggtcaccccccccccaatggtggggacccccccccccaaaaaaaaaacacttttaaaaaacccccctctcttggggggggaaggacaaacaggttttttagaaaaaataaattgtgggggcccccccccccccccaaatttttgtggttaaaaaagttctttttttaaaaacaaccccccgaaagcctttttttggtaacaaacccctcccccgcggggggagaggaataatatttttttt

SEQ ID NO: 48677 - DNA, 758 bp, Zea mays
  misc_feature: Ceres CLONE 1458177-F
  misc_feature: SWISSPROT Homolog: EC 3.2.1.23 Beta-galactosidase
aagctggagctccccgcggtggcggccgctctagaactagtggatcccccgggctgcaggaattcgcacgagaccattacctagaacatcctaatcgaaaacgacctcccctgggcggagccgttcaacgcgctgtccggccagctcgcggcgctcggcgccggcgaggtgcgcgccgtcgacgaggccgtccggaggctcgcgtcggcgctggactccgggaccgacaacgagggggccgtgcgcgccgcggcgcaggaggttgggaggcgcaccgaggagctcgcgccgcggctggaccgcctgtctgacgccgtcggcggcgtgttccgcgccgcgctgggcctccgcaacgccgagcttggatgcttaatggtgggacccgcggggaagcccgtgtaggaatagtacttcgtactagctgttatactgggatactgcgtgaagttgatttgggatcatgtgtgcgtcagtgtcgaggacgaggaggccactagttgcaatttgcatgattttggatacgtggcatccactgctgtatcccccattcgtcaactgggactgggagaaaccatcttcaggttgctgtaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatcc

SEQ ID NO: 48678 - DNA, 764 bp, Zea mays
  misc_feature: Ceres CLONE 1458181-F
  misc_feature: Encodes the peptide sequence at SEQ ID NO. 48679
  misc_feature (415)..(415): n is a, c, t, g, unknown, or other
aaagctggagctccccgcggtggcggccgctctagaactagtggatcccccgggctgcaggaattcgcacgagaccattacctagaacatcctaatcgaaaaaaaaaaccctcacgaaattctgagatccatccagaaacgtcgctccatggcgattatctccgacttcaaggaggacgaggccccgcagcagccggcggcggtcggccccggcgtcaaggagaccctggtggcagcgctagagaggaccggcggtgcactcccctttctccaggcggccatcgatgtcgctcaccgcaggtctggcctgttccgcgacccttcggcggtgagcaaggttaccgcgatggcggcggccgtcagggcgcaggtggagaccgaggagagggcagccagagaggtcaagaggaaggcncaagaggccgagaggaaggctgcggccgaggcgcagaaggctgacatggaggcggcgacggcgacggcggaggagaagctggagaaggaccgtatggatgcggataaggcggaggaaggcaacgttagacaaccaaatgctggcaatggtcttgatttggagcagtactcatggactcaacagttgcctgaggttaacatcactattcctgttcctcaaggaacaaatccagatttgtgggcgttgatataaagaaaaccatctgaaaggtgttctgaaggccagccacctatcattgatgtgagctctatcagccgttaaggttgatgattgcttctggagcatagag

SEQ ID NO: 48679 - protein, 172 aa, Zea mays
  misc_feature: Ceres CLONE 1458181-F
MAIISDFKEDEAPQQPAAVGPGVKETLVAALERTGGALPFLQAAIDVAHRRSGLFRDPSAVSKVTAMAAAVRAQVETEERAAREVKRKAQEAERKAAAEAQKADMEAATATAEEKLEKDRMDADKAEEGNVRQPNAGNGLDLEQYSWTQQLPEVNITIPVPQGTNPDLWALI

SEQ ID NO: 48680 - DNA, 751 bp, Zea mays
  misc_feature: Ceres CLONE 1458189-F
  misc_feature: Encodes the peptide sequence at SEQ ID NO. 48681
  misc_feature (535)..(535): n is a, c, t, g, unknown, or other
  misc_feature (608)..(608): n is a, c, t, g, unknown, or other
  misc_feature (623)..(623): n is a, c, t, g, unknown, or other
  misc_feature (650)..(650): n is a, c, t, g, unknown, or other
ggagctccccgcggtggcggccgctctagaactagtggatcccccgggctgcaggaattcgcacgagaccattacctagaacatcctaatcgaaaaaggcacaagctacaaaccctaacccatccgggagcaccggaaattttggaggctgaaacggaaaggggagaaggcgatgacgacgagggagccgcgcgaggcgtcccggcgcgatgggcgcgactcgcacgggaggcgcccccactcctcgttcaggtcgcggagggacgatcccagcccaaggagaagagatgacaggaggcgtgaatcggacagggcgcaccacagaagtcgagatggagaatttttggaggtggtggaccatgatcagaagcggaatagagatgctgcgcagagcgctgaccctccgaatgctgagtcgaagtcagcgagtgatatgaagaatggcccctccaccaggcatgagagatcacctaggggaaccaaacgattttctgagtcgagtgaggcatggcggcctcggtctttctttcagcancatgagcgtggaagtgctgggcaaggtggtcggcattatgaccgccaggctagtgactatggaaggcaaaggnagcatctctctgatngagataaaccgaagaccgagagacccngtttgcagggaaagattgagctggacagccaaaagaggatggtgattcacatgggagcatgatggatttttcccagttggaggaagcagcaccccttgcac

SEQ ID NO: 48681 - protein, 179 aa, Zea mays
  misc_feature: Ceres CLONE 1458189-F
  misc_feature (121)..(121): Xaa is any aa, unknown, or other
  misc_feature (146)..(146): Xaa is any aa, unknown, or other
  misc_feature (151)..(151): Xaa is any aa, unknown, or other
  misc_feature (160)..(160): Xaa is any aa, unknown, or other
MTTREPREASRRDGRDSHGRRPHSSFRSRRDDPSPRRRDDRRRESDRAHHRSRDGEFLEVVDHDQKRNRDAAQSADPPNAESKSASDMKNGPSTRHERSPRGTKRFSESSEAWRPRSFFQXHERGSAGQGGRHYDRQASDYGRQRXHLSDXDKPKTERPXLQGKIELDSQKRMVIHMGA

SEQ ID NO: 48682 - DNA, 745 bp, Zea mays
  misc_feature: Ceres CLONE 1458206-F
  misc_feature (485)..(485): n is a, c, t, g, unknown, or other
tggagctccccgcggtggcggccgctctagaactagtggatcccccgggctgcaggaattcgcacgagaccattacctagaacatcctaatcgaaaaacccatctctctctcccagccggctctctctctctcctctcttctccctgcttcagccgattccaagccgctggacaccaggacgccgagcaagccaggctgcccagccgcgaccccgagcgcccctgcccgaccgcgccaagcgcgcgaccctgcgcgacgacccgccgcccagcgcacgacgccctgcaacccgcgcgcctcaagccgaccgaagccaggaaccgaccaagccgccaagatccgaagcgcccgtgaccgttcttcttcgcgagtaaaggagcatttagtcatccggcagcgacgatcctacagggggcaaacacgatctctgcccctccttccccaaaatcatctctctcccgatcttgccctcccagattcacanctgctcttctctccgggtacgacctggctcatcctgatttgaaccgcaacatggtttaccaccctagttcccggaggaggatggaaacaaaaaagttggagttgtcctttgcttccctgaaaaccaatataggggccgggaccaccctctgaccctggaaaaggggaattgtttataaaacctaattttttttagagcaaggtgtttctcaaaaaattcccggggaagcgcccccaaaaaattttttctcttttcccctt

SEQ ID NO: 48683 - DNA, 760 bp, Zea mays
  misc_feature: Ceres CLONE 1458208-F
  misc_feature: Encodes the peptide sequence at SEQ ID NO. 48684
  misc_feature (416)..(416): n is a, c, t, g, unknown, or other
ctggagctccccgcggtggcggccgctctagaactagtggatcccccgggctgcaggaattcgcacgagaccattacctacaacatcctaatcgaaaactccacagcacgcacgcagcacccaacaacatacacaccacagaccaaaacgaccgccgcaccttcagcagcaaagtgtccaagcggcggcatggcagcgagcaaggcgcgtgtcgcgctgttcctggcggcgctcgcggtggcgagcctgctggcgctggccccggccccggccggcgccgcgacgacgtgcgcgccgacgcaactgaccccgtgcgcgcccgccatcgtcgggaacgcggcgcccaccgcggcgtgctgcgccaggctcaaggcgcacccggcgacctgcttctgccagtacaagaggaaccccancatgcagcgctacgtcaactcccccaacggcaagaaggttttcgccgcctgtaaggtgtccctgcccaggtgctgatgctgagtgagtcgtctgctgcagtgctgccccgtcaggtcgatgtcgatccatgctgctcgatcgatcgatcgaccgacctcgcgtcgcgtatggtcctactacttgagcacctttgggcagagtttagtattgctcgagaacaataaacggagacgtaccactcccagtacttggtacagtgtgagttcgatctgctctctgcagaaagacttggtatatatgccgtcatgtatgtatacctgtcacgtgtactactatgtatgat

SEQ ID NO: 48684 - protein, 100 aa, Zea mays
  misc_feature: Ceres CLONE 1458208-F
  misc_feature (34)..(100): Pfam Name: Tryp_alpha_amyl Pfam Description: Protease inhibitor/seed storage/LTP family
  misc_feature (76)..(76): Xaa is any aa, unknown, or other
MAASKARVALFLAALAVASLLALAPAPAGAATTCAPTQLTPCAPAIVGNAAPTAACCARLKAHPATCFCQYKRNPXMQRYVNSPNGKKVFAACKVSLPRC

SEQ ID NO: 48685 - DNA, 767 bp, Zea mays
  misc_feature: Ceres CLONE 1458211-F
  misc_feature: Encodes the peptide sequence at SEQ ID NO. 48686
  misc_feature (767)..(767): n is a, c, t, g, unknown, or other
ggagctccccgcggtggcggccgctctagaactagtggatcccccgggctgcaggaattcgcacgagaccattacctagaacatcctaatcgaaaaatgccgacagagtcgtccgtcccaggctcccagtcccagccccggcgcccgtctcaaatcaaaaaaattcatctcaaatctcaaacccataaataaatactgtattttccaaccaagccactcgcccgaccttcatccgcattccacgcgcactccgctgcctcactccgagactccgccgctgtttccaacttccgttgcgcacgagcgaaacatccggagctagcaagggaggaggaggaggaggaggaggcgatggcggggggcggggataaggtggactacgtcttcaaggtggtgctcatcggccactccgctgtcggcaagtcgcagatccttgcgcgcttcgcccgcaacgagtttagcctcgactcgaaggccaccattggggtcgagttccagactcggactctcgtcatcgaacacaagtccgtcaaggcgcagatctgggacaccgccgggcaggagaagtatagagctgtcacaagtgcctactacagaggtgctttgggagctctgctagtctatgatatcacaaaacgccagagcttcgaccacatacctcgctggctggaagagcttcggggccatgctgacaaaaacatgtgatcatgctggttggcaacagagcgacctcgaggacgagcgtgccgtaagcaccgaggacgccn

SEQ ID NO: 48686 - protein, 117 aa, Zea mays
  misc_feature: Ceres CLONE 1458211-F
  misc_feature (13)..(118): Pfam Name: Ras Pfam Description: Ras family
  misc_feature: SWISSPROT Homolog: EC 2.7.11.1 Non-specific serine/threonine protein kinase
MAGGGDKVDYVFKVVLIGHSAVGKSQILARFARNEFSLDSKATIGVEFQTRTLVIEHKSVKAQIWDTAGQEKYRAVTSAYYRGALGALLVYDITKRQSFDHIPRWLEELRGHADKNM

SEQ ID NO: 48687 - DNA, 738 bp, Zea mays
  misc_feature: Ceres CLONE 1458212-F
  misc_feature: Encodes the peptide sequence at SEQ ID NO. 48688
ctggagctccccgcggtggcggccgctctagaactagtggatcccccgggctgcaggaattcgcacgagaccattacctagaacatcctaatcgaaaaatagagaaacctctgctgcgcacagggtgtttgattcttagagagagagagagagagagagacctagaccaagaccaagaccaaggccaaggagcaccgctccccgtacatccccagcaggagagggagagagacagagaaggttgtgcgaagggaagaagacgcggcgggagagaagggcgacatggagaggccggcgcccgtgaggaagtcccacacatcgacggcggacctgctggtctggccggaaggtgcgccgcaggagttgcccgccgggtccacgccgccatccaaccgccggccgcaccagccccccgaggcgctcaggaaggtggtgttcggcggccaggtgacggaggcggaggccgagagcctcaacaagagttctggtctataggctctggaaaaggaatggctagtagtgttaccgtaatgtgactatggtttagcccttcatggaattgccatctcaccaactatgttggagtactgcaaactgaccgtagccatcaaaatgctccccgtaaggaaaccatgctctgctcccaagtggaaggagatgacaggaagcggcatatttgcagctgggggcgagggtgaaaaaaatgaatccgccaatgtctctgcaacttccgtccgg

SEQ ID NO: 48688 - protein, 70 aa, Zea mays
  misc_feature: Ceres CLONE 1458212-F
MERPAPVRKSHTSTADLLVWPEGAPQELPAGSTPPSNRRPHQPPEALRKVVFGGQVTEAEAESLNKSSGL

SEQ ID NO: 48689 - DNA, 827 bp, Zea mays
  misc_feature: Ceres CLONE 1458216-F
  misc_feature: Encodes the peptide sequence at SEQ ID NO. 48690
  misc_feature (430)..(430): n is a, c, t, g, unknown, or other
  misc_feature (459)..(459): n is a, c, t, g, unknown, or other
caaagctggagctccccgcggtggcggccgctctagaactagtggatcccccgggctgcaggaattcgcacgagaccattacctagaacatcctaatccagaaatcaaccgcagtacacggcgtatcattcccagcgaccacgaaagactagctagccaagtgcatgcaaccagccatgcaggccgggaagacggccgtggatgcgacgaaggaggccgcggccaacgtcggggcctcgacaaacgccggcatgcagaatacccgtgccgccgtgcaaggccaggtggagaaggccacggcgcgcaacgcatcggacaaagtcccggccgaggagcgccagcgggaccgcgtgcggcgccccgaagttggaaaaaccaggaacccgtggggcccaaacccggccggaaaagacccccccccttggggggnggaggaaggtaaccacccccaaacccccntccaagggcgcgccccggaaaccggccccccaaagggaattgtgggggggaaaaaatccccccccccggggggggacctctaagggggggggcgggaaaaaaccccccccccccctggggggacccggacgggggggggccaaagccccaaaaaaacccgcttcggggaaaaaaatttctcggagaggggcccaccgggggaaaaccacaagaaaaaggctccccccaggaggacccctctcggggggaaacttggggtgggaaaaaaaaccaaccaacggcgcccccgcgggggaaatcccaaataaaatgttctcactggaaaaaaaaaaaaaaaaattttctcctcccccccaacgggggggggg

SEQ ID NO: 48690 - protein, 121 aa, Zea mays
  misc_feature: Ceres CLONE 1458216-F
  misc_feature (85)..(85): Xaa is any aa, unknown, or other
  misc_feature (95)..(95): Xaa is any aa, unknown, or other
MQAGKTAVDATKEAAANVGASTNAGMQNTRAAVQGQVEKATARNASDKVPAEERQRDRVRRPEVGKTRNPWGPNPAGKDPPPWGXEEGNHPQTPXQGRAPETGPPKGIVGGKKSPPPGGDL

SEQ ID NO: 48691 - DNA, 785 bp, Zea mays
  misc_feature: Ceres CLONE 1458222-F
  misc_feature: Encodes the peptide sequence at SEQ ID NO. 48692
  misc_feature (346)..(346): n is a, c, t, g, unknown, or other
  misc_feature (382)..(382): n is a, c, t, g, unknown, or other
  misc_feature (727)..(727): n is a, c, t, g, unknown, or other
aagctggagctccccgcggtggcggccgctctagaactagtggatcccccgggctgcaggaattcgcacgagaccattacctggaacatcctaatcgaaaagatccaattccaccctcgttctcaggcactgtcacacagacacagctgacctgccactgccaggaaagtaggtcgaggatgccccgcagcggcttctcggggtccttcaggtcgcccaagatcgacgtcgtcatcgacatgggaaaccccttcctcaaccgcaccgtcgacggcttcctcaagatcggcgccgtcggcgcctgcaaggtggctgccgaggagaccttcgagtgcctccacagggnggatgtttcgaagcacaaggttgagcatgccctgangaagatgtgcaaggagggcgcatattggggcactgttgcttggagtttaggtggccatggtgtacgggctggaaaggggtccgtggccccctgtgactggaaaaacccaataatcggggccccctttgccggccccctgatttccggcgcccaaaaaagaaaagaaggaaggctccaagagacccttcccccccgggggggcccccgccgccgaatttcccccgtgtttccctgtaaaaaagagaacccgttttttcgggcgcttttgcgaaaaaaaaaaaaaaaaacctcccccgggcccctaaacaaaaaaaaaaaaaaaaaaaaaaacccccaaaaaaaaancctctttttttcccccccccccggggggggcccgcaccctccccccctttttgttgtt

SEQ ID NO: 48692 - protein, 202 aa, Zea mays
  misc_feature: Ceres CLONE 1458222-F
  misc_feature (56)..(56): Xaa is any aa, unknown, or other
  misc_feature (68)..(68): Xaa is any aa, unknown, or other
  misc_feature (183)..(183): Xaa is any aa, unknown, or other
MPRSGFSGSFRSPKIDVVIDMGNPFLNRTVDGFLKIGAVGACKVAAEETFECLHRXDVSKHKVEHALXKMCKEGAYWGTVAWSLGGHGVRAGKGSVAPCDWKNPIIGAPFAGPLISGAQKRKEGRLQETLPPRGGPRRRISPVFPCKKENPFFRALLRKKKKKTSPGPLNKKKKKKKNPQKKXLFFSPPPGGGPHPPPLFVV

SEQ ID NO: 48693 - DNA, 806 bp, Zea mays
  misc_feature: Ceres CLONE 1458226-F
  misc_feature: Encodes the peptide sequence at SEQ ID NO. 48694
  misc_feature (404)..(404): n is a, c, t, g, unknown, or other
tggagctccccgcggtggcggccgctctataactagtggatcccccgggctgcaggaattcgcacgagaccattacctagaacatcctaatcgaaaaactcgagccagccagccagccagcaagccgcttgggcgccatctctctagagcttcgtaccctcgaagagagatccggcgcggcccaataaacacccggcttactacagattcgcagatggccggcctcaggatgaagttcgtcgccgtcgccgccatggccgccgcgctcgtggcgtccgccgcagccgccgaggcccccgccccggctcccgcgtccgacgccgcggccgccgtacccctcggcgcggcctccctcgccgccgccgccttcggctacctcttctgctagatccgcgctggatacncgcccccgctccaaatatgaatcgtctggtctggcgcgcgtgaatccagctcgggggtccggcgtggccctttttgaagggtccccggggcgtttggtaatttttgaaaccgccccccccccccccaaaaaaaaagggtgccccggggggggggaactgtttttaccccccctgttttttcgggggaaaaaatggaaaccccgggggggtttccgggtgttaccagggaaatgtttttttttgctcaaaaaaaaaaaaaaaaaaattttttttaccctcgcccacccggggggggggggccgggcaccactccccccaaaaagagaggagttatattgcccgcgcccggcggggcgtttttttttaaaccgggtgttggggagagaaaaacccgggttcccc

SEQ ID NO: 48694 - protein, 57 aa, Zea mays
  misc_feature: Ceres CLONE 1458226-F
MAGLRMKFVAVAAMAAALVASAAAAEAPAPAPASDAAAAVPLGAASLAAAAFGYLFC

SEQ ID NO: 48695 - DNA, 755 bp, Zea mays
  misc_feature: Ceres CLONE 1458228-F
  misc_feature: Encodes the peptide sequence at SEQ ID NO. 48696
  misc_feature (425)..(425): n is a, c, t, g, unknown, or other
ggagctccccgcggtggcggccgctctagaactagtggatcccccgggctgcaggaattcgcacgagaccattacctagaacatcctaatcgaaaaacgataacccaaacaaaccaatcatcctctccgtgtaggccgcgggattccgtgtccctctccaatccggcgtagccatcgtcgccggatacaggatccggtccccgcgatggagccctcaccaacctcctcctcgccggctgtggcgcgccggttgtcgccggaggtaaggagggtgccgaagcgggcgctggaggagttgttggagcaggtccagcgggctgttgagatgctgcgcgatgccgacgctgatctcgccatctctctctcggaagaaaccgcagcagcctcgccggaagccgaggaccgcaaccaccatgttggtgtcnatggagatggcatgccgacgtcgtcggttgcgagtgactcccattacaagacgacgcagatgtgtgaacttcttaaatccaaggttgaatccctccaatttccttcaaagcttaatgggtttccaaaggtcagaaaatcagaatttgggcagttgaacccggaaaccccctgggaaaaaaaaaacccggattttggggaagaaggggaacccaaagaaggaaatgttcttttaaaacaagaaaaatggggtcagagggaaccccccctttgtggcgcgcgcgggtctcccctaaaaaaaaccagggcccgcccccgaaaaaaatcaaaaa

SEQ ID NO: 48696 - protein, 183 aa, Zea mays
  misc_feature: Ceres CLONE 1458228-F
  misc_feature (74)..(74): Xaa is any aa, unknown, or other
MEPSPTSSSPAVARRLSPEVRRVPKRALEELLEQVQRAVEMLRDADADLAISLSEETAAASPEAEDRNHHVGVXGDGMPTSSVASDSHYKTTQMCELLKSKVESLQFPSKLNGFPKVRKSEFGQLNPETPWEKKNPDFGEEGEPKEGNVLLKQEKWGQREPPLCGARGSPLKKTRARPRKKSK

SEQ ID NO: 48697 - DNA, 747 bp, Zea mays
  misc_feature: Ceres CLONE 1458229-F
  misc_feature: Translation starting site: 146
  misc_feature: Pfam Name: ATP-synt_E Pfam Description: ATP synthase E chain
  misc_feature: SWISSPROT Homolog: EC 3.2.1.23 Beta-galactosidase
  misc_feature (629)..(629): n is a, c, t, g, unknown, or other
  misc_feature (747)..(747): n is a, c, t, g, unknown, or other
ggagctccccgcggtggcggccgctctagaactagtggatcccccgggctgcaggaattcgcacgagaccattacctagaacatcctaatcgaaaactccaaacccttgccgactcagatccagcttcctcgcaccgccgtcgccatgccgttcactccaggcccctactctggcgtcagcaccctcgcccttgtggcgagggcgtcggcctttggcgtcggtgtcgtctacgggagcatcaagctctcaatcctcaaggtaacaaaacctaaaaaggaggaagtgcatgatcatcactaaggacgacaaggctgctacattttaattcccacatatggaaggatgttataaattggcagtgcaccccttctccatacgtacaatttcgtttatgatttgtggacctgtctgtaacatacctgctttttttttgtgttgtaataaattcttatacaatgacatgaaatcaggaagtggaaaagcaagtcgtccaaaaaaaaaaaaaaaaaagcttatcgataccgtcgacctcgagggggggcccggtacccaattcgccctatagtgagtcgtattacgcgcgctcactggccgtcgttttacaacgtcgtgactgggaaaaccctgncgttacccaacttaatcgccttgcagcacatcccccctttccgcagctggcgtaaaagcgaagaggcccgcaccgatcgccctccccacagttgcgcaacctgaatgccgaatgaaan

SEQ ID NO: 48698 - DNA, 756 bp, Zea mays
  misc_feature: Ceres CLONE 1458236-F
  misc_feature: Encodes the peptide sequence at SEQ ID NO. 48699
aagctggagctccccgcggtggcggccgctctagaactagtggatcccccgggctgcaggaattcgcacgagaccattacctagaacatcctaatcgaaaaattttcccactcgatcgccaataatggagtttccgcacgaccaccaccaccacggtcatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggaggggccggggacgcctacggccacagcggccaaggctacgcgcccccgccggcctacggcgccgggggcgggtacggcaacgtcgtccacatcgcgtacaaggtcggccaccacacgccttactactgcggcggcggcggcggtcttggtggcgcctacggaggcggtggctccgagtacagccacgagggccgaccgcaccacggcggcggcggatcccagtacggccacgagacacgcccgcaccagggcggcgccccgcctgtgaggcatcagacgtacaggatctactgctaggctggggaggaccagtacagcctctcctcccgcgacggcaaggtctgcctcgtgcgcacggaccgtgatgacaacgcgcagcactggatcaaggatctgagatacagcaccaggggtgaacgatgaggaaggctaccctgccatcgtcctcg

SEQ ID NO: 48699 - protein, 159 aa, Zea mays
  misc_feature: Ceres CLONE 1458236-F
MEFPHDHHHHGHRRDDDEDDRRGPPPPVYGGYGQPPPPDPYGRAPVDPDPYGRPPPQSAYGGAGDAYGHSGQGYAPPPAYGAGGGYGNVVHIAYKVGHHTPYYCGGGGGLGGAYGGGGSEYSHEGRPHHGGGGSQYGHETRPHQGGAPPVRHQTYRIYC

SEQ ID NO: 48700 - DNA, 764 bp, Zea mays
  misc_feature: Ceres CLONE 1458242-F
  misc_feature: Encodes the peptide sequence at SEQ ID NO. 48701
aaagctggagctccccgcggtggcggccgctctagaactagtggatcccccgggctgcaggaattcgcacgagaccattacctagaacatcctaatcgaaaagttgactttattaaaaaagggattatcttcattttgtagctttgaatcgcctctcagaaccgagatcctcaaaacccttctcccccctcccggatcgagtgcttgagctccgaccaaatctcgcagcggctgcaattccgagcccgaagagcggatcaggcgaggacgacgccttcgattctgatctgcggtcggcgcgacctagagagaaccggagatgcagcagggcgacggcacggaggcgcaggtgacgtgggaggaccagcagaacatcaaccgcttcggtcgcctcaacaaccgcctccacgagccccacgacgagatcaagctcgcgaaggagacgaatgagaaccttgatgatgctgggaatgaactcatcttgtcggatgaagacgttgtacgcttccaaattggggaagtgtttgctcacatgccaagggatgacgtcgagactaggctggagcagatgaaagaggatgcggctaagaagctggagaggttagaggaggaaaaggaatccatcctggcccagatggccgagctgaagaagatactgtacgggaaagtcaaggatgccatcaacctggaggaagattagcagtactggagtcgtggcgatttgaccctctttctagttcaggtgctgttttttcccttgctct

SEQ ID NO: 48701 - protein, 126 aa, Zea mays
  misc_feature: Ceres CLONE 1458242-F
  misc_feature (16)..(120): Pfam Name: Prefoldin_2 Pfam Description: Prefoldin subunit
MQQGDGTEAQVTWEDQQNINRFGRLNNRLHEPHDEIKLAKETNENLDDAGNELILSDEDVVRFQIGEVFAHMPRDDVETRLEQMKEDAAKKLERLEEEKESILAQMAELKKILYGKVKDAINLEED

SEQ ID NO: 48702 - DNA, 753 bp, Zea mays
  misc_feature: Ceres CLONE 1458246-F
  misc_feature: Translation starting site: 128
  misc_feature: SWISSPROT Homolog: EC 4.4.1.5 Lactoylglutathione lyase
  misc_feature (420)..(420): n is a, c, t, g, unknown, or other
aaagctggagctccccgcggtggcggccgctctataactagtggatcccccgggctgcaggaattcgcacgagaccattacctaaaacatcctaatcgaaaaaagccgcagcagctagctagctagcatggccgggaaagagcttacgctgctggggttatgggcgagcccgttcgtgctccgggcgcgcatcgcgctcagcctcaaaggcctcacctacgcatactccgaggagaacctcgacgacaagagcgagcttctcctcagctccaaccccgtgctcaagaaggtgcccgtgctcatccaccacggcaagcccgtctgcgagtcccacatcatcgtgcagtacgtcgacgaggctttccccgccgccgcacctaatttccttccatccgacccctacgaccgcgcccccccccncttctgggcctcctacgtcgacgacaagttctacagcgcgaggatacccgtgttcaagggcaggacggcggaggagatggcggaggcggccaggcaggccgtcgcggcgctggagacgctggagcaggcgttcagggagtgctcccaaggggaaggccttcttcggaggggacagtgtggggctcctcgacctcttgctcgacggccttgttgggtggctggaacccaccgaggccctctgcggggtgaaggccctcgaaccccgccaggactccgctgcttgcggcgtgggccgaacggttcttgccccttgagggtgttaaggggcctaac

SEQ ID NO: 48703 - DNA, 835 bp, Zea mays
  misc_feature: Ceres CLONE 1458247-F
  misc_feature: Translation starting site: 208
  misc_feature (38)..(38): n is a, c, t, g, unknown, or other
  misc_feature (43)..(43): n is a, c, t, g, unknown, or other
aaaacccaattttagatgtttattataaggtgtaaccnccaanattattaaactggagctcaccacggtggcggccgctctttaactagtggatcccccgggttgcagtatttcgcacgagaccattacctagaacatcctattctaaaagagcttcgttcattcagtttcatccgtgttcttgtttcctaggtttagagagagaggatgtcctgctgcggaggcaactgtgggtgccgctccggctgcaagtgcggcaacggctgcggagggtgcagcaagatgtacccggacctggctgatcatgtgaccacctccacccaggctctcatcatgggtgtcgcatcatccaaggggcacgcctagggcgggttctaggcggccgctcggagctgagaacggcgggtgcaagtgtagtggttgttgccagtgcgacccctgcaactgtggcaagtgagccacccccctctcaccctgcaggccggccggaggaagctggctaaccatgataaccttaataaagtataaccggcgtccgctagtgtgtgtttcgagttcggtcattcagtttacttgcctgccccctggctgggcctgcctctgtgccctgaaatgaacgaatgatgcctgaatagccggcgttcaggtcactgtcagtcctccccatggcccccctcacggggtttttcggtccccgtaaccacggagactgcggtctacgttgcaccgtgattgccaccaaaggtaccccagactcaccacatttttctttggctcctcggtttgttccacctttccactctcatgatataataattggtaccgtctcatcccc

SEQ ID NO: 48704 - DNA, 731 bp, Zea mays
  misc_feature: Ceres CLONE 1458248-F
  misc_feature (334)..(334): n is a, c, t, g, unknown, or other
  misc_feature (382)..(382): n is a, c, t, g, unknown, or other
  misc_feature (389)..(389): n is a, c, t, g, unknown, or other
  misc_feature (393)..(393): n is a, c, t, g, unknown, or other
  misc_feature (432)..(432): n is a, c, t, g, unknown, or other
tcccccgggctgcaggaattcgcacgagaccattacctagaacatcctaatcgaaaaaaatatttcccaaccccctcagaaaggagaaataatcctccctttctctcctctcctgcctttccccattactactccccagtcccactcccacccgcaggccgtgccgccccagcaaatctcacgcacagaaacaccaaagccccaaaggcccaaactcaccacctcccaatggagaacggcgacgaaaccctcgcctcccccacgggcgccgccgagacggacgcgctcaacggcggcgtcgcggaggatgagtaggtctgtataattgaaaccncaaagtcctatgtcacgctccgcgagtataaggctgccccacaccccncaacaanaaanaggacgagggcggtgcccactccaccgccaaaccctacncagttgtcgccgcccaagccgagatcgaggaccttcctggcaactagcttgacttggaggataagctatctgaggcccgccgtgagaacaattccctcgccgaagagacccaacgcaggggagggaattttcctgcatgcccgggaaggaggtcgcattcccggaggtcaccgccaccttttatcatagaaggaggtcgccccgctcccgggggaaggtatgaatgcctccaatcctgctatctgggatcatacaagggccaagcacttacctggacaagtggaagacaccgggtaggt

SEQ ID NO: 48705 - DNA, 866 bp, Zea mays
  misc_feature: Ceres CLONE 1458254-F
  misc_feature: Encodes the peptide sequence at SEQ ID NO. 48706
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (735)..(735): n is a, c, t, g, unknown, or other
gttctccccccccagcacctcacaaaaaaannnnnnnnnnnnnataaagctggagctccccgcggtggcggccgctctagaatagtggatcccccgggctgcaggaattcgcacgagaccattacctagaacatcctaatcgaaaaaacccgggcctcacaagatagggtcggaaagccccgacgccgacggcgtcggcgacgccccgggcaaggggtccaccgtccatgttggccccgcccgggggcctgccgacaagcgccgccttccggagtaccgttctacctcctcctcggggtcccgtgatcgccagcacgcccacgcggggcgccggccgccgccctcggcctaggaggacgcgcgcgcctctcatatcctggtcaagagcgagggcttccgacgaaaggccttcgtggccccatagaaaaggaaatcgcagttctgatacaggaaacgtgggtggcccccccccccccccccaacacgccaaaaggtgggagggagtggggggccccgccaccaggtaatcacaccagaactcaacatagggttagcagactcccgaacggggggggttcggcccaagtcattcccatgatgaatgcttcgaggtcccttaaggcggggggtgtaacatgtccggaaaccctgttttgggaaaagtttgttgatcgggccctccatgatgcggcggagatatcaagggccccgtgagggaaaaaaaaagagcccagnggttcacgagcgatctcgagggttctggtttgaagggacactggcccacgcttattctattaaggcgggcgcggggtcatgtgataagcacggaggggatctcgctccctcatgtcagcgggattccgcgc

SEQ ID NO: 48706 - protein, 39 aa, Zea mays
  misc_feature: Ceres CLONE 1458254-F
MMNASRSLKAGGVTCPETLFWEKFVDRALHDAAEISRAP

SEQ ID NO: 48707 - DNA, 734 bp, Zea mays
  misc_feature: Ceres CLONE 1458257-F
  misc_feature: Encodes the peptide sequence at SEQ ID NO. 48708
  misc_feature (372)..(372): n is a, c, t, g, unknown, or other
  misc_feature (373)..(373): n is a, c, t, g, unknown, or other
  misc_feature (486)..(486): n is a, c, t, g, unknown, or other
tggagctccccgcggtggcggccgctctagaactagtggatcccccgggctgcaggaattcgcacgagaccattacctagaacatcctaatcgaaaactcattccactctccaacgcgcaccgggcggtttttcgttcctttctttttttttcccctcttccccttccccttctccttccagcggcgctcaggccaccgccggccaatcccatcacccgccggatagggatcgacccgtttgttgattggcgcgcgcctgcaatcgatcgattgcattgcagggttagggcggccgccgtcgagatagatcgatccatccatcgatcgaattggttttgttggtggatcggagatattcattcgggtttatnnatcggctgctgctggtgagcctcccggtgacgggcgccatcatctaccgctgcaagcactgcgacacccacctcgcctacgacaccgacatcatcgcaaggacattccactgnaagaacggcaaggcctacctcttcaacaggatcgtgaatgtgaatgttggtacgaacgaggaggaccggatgatgactacgggcctgcacaccgtgtgcgacatcttctgcgatcgctgcccaaccatactcggctggaaataccttcccgccttcgacaagagccagaagttccacgaaaggtatagttcatcttcgacaggttccaccgccttggcagccgcttcctggatgaatgcccctgcccg

SEQ ID NO: 48708 - protein, 59 aa, Zea mays
  misc_feature: Ceres CLONE 1458257-F
MMTTGLHTVCDIFCDRCPTILGWKYLPAFDKSQKFHERYSSSSTGSTALAAASWMNAPA

SEQ ID NO: 48709 - DNA, 757 bp, Zea mays
  misc_feature: Ceres CLONE 1458262-F
  misc_feature: Encodes the peptide sequence at SEQ ID NO. 48710
  misc_feature (467)..(467): n is a, c, t, g, unknown, or other
  misc_feature (468)..(468): n is a, c, t, g, unknown, or other
  misc_feature (524)..(524): n is a, c, t, g, unknown, or other
  misc_feature (536)..(536): n is a, c, t, g, unknown, or other
  misc_feature (537)..(537): n is a, c, t, g, unknown, or other
  misc_feature (540)..(540): n is a, c, t, g, unknown, or other
  misc_feature (587)..(587): n is a, c, t, g, unknown, or other
  misc_feature (619)..(619): n is a, c, t, g, unknown, or other
  misc_feature (683)..(683): n is a, c, t, g, unknown, or other
  misc_feature (733)..(733): n is a, c, t, g, unknown, or other
aaagctggagctccccgcggtggcggccgctctagaactagtggatcccccgggctgcaggaattcgcacgagaccattacctagaacatcctaatcgaaaaagtttgccgctctgtgagcctgctgccgtcttcttccgccgccgccgtcgccgtcttcgtccgtagagcagcagatcagagagcggggaggaagaaaaaccgatcgatggcgtccaactacgtggacacgacgggcgaggagggacggttccacggccctcacagccacagcaccagcacgaccccgacgggcggcgcggcggcggcggcatcgccgcgtaacttccggcgcagcttctccaccgcgtcctccgcggggcacagccacggcggcggcggcggcggcggaagaagacggcggcaggctcacagagcggcaaactttttcgattaggatgttctaggtaatggtctcgtgcgtttcnnctgcaggcccgggggatccactagttctagagcggccgccaccgcggtggagctcnagcttttgttcnntanacacaaataaaatttaactactaattttcaaactcatcctcccattncttctcatttctttaaacatcccctcctattnttttaaaccctatcctccccatctctattttacccttattttttttcaaatcccaaatttcaanaccatcccttcttaaacaaaaacacttttcccttacctttaccttcaaanataacccttactaattctcccacc

SEQ ID NO: 48710 - protein, 75 aa, Zea mays
  misc_feature: Ceres CLONE 1458262-F
MASNYVDTTGEEGRFHGPHSHSTSTTPTGGAAAAASPRNFRRSFSTASSAGHSHGGGGGGGRRRRQAHRAANFFD

SEQ ID NO: 48711 - DNA, 843 bp, Zea mays
  misc_feature: Ceres CLONE 1458266-F
  misc_feature: Encodes the peptide sequence at SEQ ID NO. 48712
  misc_feature (257)..(257): n is a, c, t, g, unknown, or other
  misc_feature (258)..(258): n is a, c, t, g, unknown, or other
  misc_feature (260)..(260): n is a, c, t, g, unknown, or other
  misc_feature (368)..(368): n is a, c, t, g, unknown, or other
  misc_feature (843)..(843): n is a, c, t, g, unknown, or other
ggagctccccgcggtggcggccgctctagaactagtggatcccccgggctgcaggaattcgcacgagaccattacctagaacatcctaatcgaaaactagacctaaacggctccatgctgtgagaccaccaacagtgtccatggctctggacgccccggtggagcgacgggacgaggtacagatcgcgatggggaacggaaacggcgtggcgccgtctcaaccgtcgcggccagccggtcggccaacggctgctgcnncngcagcgccatactcggacaggcggctgcggctgaacccaaatgcggatcacaagccggaagactacagcgacgtgcgcggcgagtccgcgccgggccgtgttgtgagnacttcagcgggaatcttccaccgacccttcatgatgaaaaacccccttctcccccccacccctttcatgccggaaaatttccctcggggttcttggccccaccgcccaggcctaaaaagggggcaagggcccctcaaaaatctagcccctaggatacttccccccgttaagaaggccttttttgggaagaatttttctaaatagggctcccttcaagggttcctttcttctccactttttccctcgaggtggctcttggcggtcgttccccacagaacgtgtcttcaaaatctttatttgcgtgagacctcttaccggggggaaacaactctttccgggaggtgttcgccccctctccctctggcagatttctctgttgcacaggcgcacccatctcttgaaacaatgcgccccctgcctcctacatctttacaacaactgcggccgtcgaaaacgactaacacagcattggtgn

SEQ ID NO: 48712 - protein, 143 aa, Zea mays
  misc_feature: Ceres CLONE 1458266-F
  misc_feature (40)..(40): Xaa is any aa, unknown, or other
  misc_feature (76)..(76): Xaa is any aa, unknown, or other
MALDAPVERRDEVQIAMGNGNGVAPSQPSRPAGRPTAAAXAAPYSDRRLRLNPNADHKPEDYSDVRGESAPGRVVXTSAGIFHRPFMMKNPLLPPTPFMPENFPRGSWPHRPGLKRGQGPLKNLAPRILPPVKKAFFGKNFSK

SEQ ID NO: 48713 - DNA, 743 bp, Zea mays
  misc_feature: Ceres CLONE 1458267-F
  misc_feature: Encodes the peptide sequence at SEQ ID NO. 48714
  misc_feature (377)..(377): n is a, c, t, g, unknown, or other
aaagctggagctccccgcggtggcggccgctctataactagtggatcccccgggctgcaggaattcgcacgagaccattacctagaacatcctaatcgaaaaatcgcattgacatatcgttcatcggatccagtcctctcccgggatctcctccggctataaatttccggccccaattcacccaatccagatgcgcaaacatcgaatcgtctcgctagtggctgccctactcgtgctgcttgccctcgccgccgtttcctccacgcgcagcgcacaaaaggagtccgcggctgacaacgccgggatgttggcaggcggcatcaaggacgtgccggcgaacgagaacgacctccagctccaggagctcgcgcgcttcnccgtcaatgagcacaaccaaaaggccaatgctcttcccgggttcgagaagcttgtgaaggccaagacacaagtggttgctggcacgatgtactatctcactattgaagtgaaggatggcgaagtcaataagctctatgaagctaaggtctgggagagccctgggagaacttaagcagctgcaagaatcaagcctgtttaaaaggtgctaacgcttaaagatttgtcgccccctgggacatttcctgccgaaaaccaaaactaatttgcaaattagggactgcttcgaaacagcccaaacatgccccccccccttttttcaaaaaacagggccctaagggaaatcctaaaatccccgcccagaaaat

SEQ ID NO: 48714 - protein, 119 aa, Zea mays
  misc_feature: Ceres CLONE 1458267-F
  misc_feature (42)..(117): Pfam Name: Cystatin Pfam Description: Cystatin domain
  misc_feature (63)..(63): Xaa is any aa, unknown, or other
MRKHRIVSLVAALLVLLALAAVSSTRSAQKESAADNAGMLAGGIKDVPANENDLQLQELARFXVNEHNQKANALPGFEKLVKAKTQVVAGTMYYLTIEVKDGEVNKLYEAKVWESPGRT

SEQ ID NO: 48715 - DNA, 793 bp, Zea mays
  misc_feature: Ceres CLONE 1458274-F
  misc_feature: Encodes the peptide sequence at SEQ ID NO. 48716
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (403)..(403): n is a, c, t, g, unknown, or other
  misc_feature (418)..(418): n is a, c, t, g, unknown, or other
ccccgcggtggcggccgctctagaactagtggatcccccgggctgcaggaattcgcacgagaccattacctagaacatcctaatcgaaaatttttttccgccaccgcccgatccccacaccgccacccgccgcctctaaccccgctgtcccgtcttgtgctctgacctcaccgctggtcagtgtcataccgcatggaccccaccgaccactcgccggaggaggtgtacaccgtgtgggcccttccgccggaacccgtccgtgatcgtttccgccgcatcatggagggcctccccgctgaatacggcggccccacctttgagacccaccgtaaccatctcgggtgatttccgtggtagggnnntaataaactgaaaaggtggttcattaaagaaattaatactnactttctttcacaanaaataaagaaaaatggtttacccttggaaagttgctccacccatggcgtaaaaatcttttctgcacccccccccgaaggttgggggacctatgaatttattggttcgtccattttcggttttatataaaaaactccctttatatcgccccggtacaccctctttttctgggccccctctatctttacaacacaattgtagtcgtccaaagaaaaaatcgtgaagattcgcgccaggaggagtctcctcttgcaaacggatgtgggcacatcttagagttttcccgccctctatgatactaacgcccgccccgaaatacacctcttgatattctcgaccctattatgtgtgagtgacatcccacccttttctggtt

SEQ ID NO: 48716 - protein, 50 aa, Zea mays
  misc_feature: Ceres CLONE 1458274-F
MDPTDHSPEEVYTVWALPPEPVRDRFRRIMEGLPAEYGGPTFETHRNHLG

SEQ ID NO: 48717 - DNA, 758 bp, Zea mays
  misc_feature: Ceres CLONE 1458275-F
  misc_feature: Encodes the peptide sequence at SEQ ID NO. 48718
aaagctggagctccccgcggtggcggccgctctataactagtggatcccccgggctgcaggaattcgcacgagaccattacctagaacatcctaatcaaaaaatcaagtctcaactctcaagaggcagctaaaccaaccagcggtgatctgtagtagcaacttggttcttggtaggtgagataacgatacagcaggtagctcgagcgagaatgagccaggagcagccgaggaggccgtccggccatgacgagacgagcggcggagagcagggcgccgtccgctacggcgacgtgttcccggcggtgagcgggggcctcgcggagaagcccgtggcgccgcaggacgcggccacgatgcagtcggcggagaacctggtgttcggccagacgctcaagggcggcccggcgtttctcctccaccccgcggccaccgccaacgagcgcatgggcgccgtcgggcacgaccaggccacggacgccaccgccgtgcagggcgtcaccgtctccgagacccgcgtcccgggcggcggccgcatcgtcaccgagttcgtcgccgggcaggctgtcggccagtacctcgcgcgggacgacgatggcggcggcggcatcgccggccccggcgccggagcgggagttgcgggtaaggatatcacgaaggtgacgatcggcgaggcgctcgaggcgacggccctcgcggcgggtgacgccccggtggagcgcaacgacgcggccgccatccaggcggcggaagctcgcgc

SEQ ID NO: 48718 - protein, 182 aa, Zea mays
  misc_feature: Ceres CLONE 1458275-F
  misc_feature (22)..(81): Pfam Name: SMP Pfam Description: Seed maturation protein
MSQEQPRRPSGHDETSGGEQGAVRYGDVFPAVSGGLAEKPVAPQDAATMQSAENLVFGQTLKGGPAFLLHPAATANERMGAVGHDQATDATAVQGVTVSETRVPGGGRIVTEFVAGQAVGQYLARDDDGGGGIAGPGAGAGVAGKDITKVTIGEALEATALAAGDAPVERNDAAAIQAAEAR

SEQ ID NO: 48719 - DNA, 761 bp, Zea mays
  misc_feature: Ceres CLONE 1458277-F
  misc_feature: Encodes the peptide sequence at SEQ ID NO. 48720
  misc_feature (761)..(761): n is a, c, t, g, unknown, or other
aagctggagctccccgcggtggcggccgctctagaactagtggatcccccgggctgcaggaattcgcacgagaccattacctagaacatcctaatcgaaaactctctcttgattcctttcccgaggagctcagctcgctcggctagctaggcaccgggttcctgttcctgccgcgaggcgcgtctcacacgcggcggtcggtgcgcgcatgcagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccagaagccgcagcccagtatcgccccgcccaagctcggccgcccccgccccggccccgccgacgaccactccccaacgggagggaagaagttcctgagctacttccggtgttgtatcaaggcctgaagaggtgctgctctagtgcctgcagtccctgtgtttttttttcgcagcagaacacttgtgagcaatcaggcctcggttttgttaagtaccccgtgtccaaaaacgtgtaatatatttgtccttatggatcagtcgttgggcctgtatgaagaacagacccagttatggggcaaaaaaaaaaaaaaaaagcttatcgataccgtcgacctcgaggggggcccccgtaccn

SEQ ID NO: 48720 - protein, 107 aa, Zea mays
  misc_feature: Ceres CLONE 1458277-F
MQQRGHDAAGANAWMTVPAFGDWDTKNGALPDYSMDFSKIREMRKQNKKELSRASLGGDDDLLAHAQKPQPSIAPPKLGRPRPGPADDHSPTGGKKFLSYFRCCIKA

SEQ ID NO: 48721 - DNA, 927 bp, Zea mays
  misc_feature: Ceres CLONE 1458285-F
  misc_feature (12)..(12): n is a, c, t, g, unknown, or other
  misc_feature (548)..(548): n is a, c, t, g, unknown, or other
aactattagccnactcttcagcagccacccccacaattttacaaaaaagtagcactccccgcggtggcggccgctctagaactagtgcatcccccgggctgcaggaattcgcacgagaccattacctaaaacatcctaatcgaaaaactcataaaccactcctgcactttcactctatcataacctaccaggctactagcataataagtcgccaatccctcccccgagagagtcagaaatggcatcacccccctaatcgctttcccgggtggcaaatcacgagccatggcacacttgcgctggtgtaagtgccgaccctgagatcctcactccctttcacggggggcatgacccctgccgcagccttataacccgctttgccagccagattttgccgtactacattcaggtttggttttttaaacccaccattcccgtggatgaataaattttatgggatggaaaatgtgggcccccccccgggggggacattgacccattctaccatgcccggggtcctcctatacccccccctacaccaacctcancatcaaactacaccacttgcctgccttcattcgagaatggtttgcgggtgtgtagcgcctgttaaagtcttctgcaatgacgttctcctctggcgttgtcgatacttggtgccctatcatgtgctgcttttgcagttgtactcttgattctatattctgtcggcccgcctctttacgagctcccgccttgtttagtcttactttatatgtttttaccgtcacgcgtgttcccccgttacctattttactataggaacaccttgcatgtgcgatcgcgacgtttcgaatagacttcgttgttgtgtgtacaggtctggcctttctatttactgcgcggacgtatgtcgcaagtgtattcagcatctcaggcagaaacctc

SEQ ID NO: 48722 - DNA, 725 bp, Zea mays
  misc_feature: Ceres CLONE 1458287-F
  misc_feature: Encodes the peptide sequence at SEQ ID NO. 48723
  misc_feature (689)..(689): n is a, c, t, g, unknown, or other
cggccgctctagaactagtggatcccccgggctgcaggaattcgcacgagaccattacctagaacatcctaatcgaaaaatatgagtctcgtgcatttacgcaagtttgctgaattgaatctgcggagccctgtgctttcttacatcaaagtttccagatgttcagtgctccatcgagttagcataacatcgaccacacttcagaaattggtgcttcagaaacaagagagtttatccagcttgtcattgcaatgccacaacttgattgatgtggatcttagcgactgcgagtcattaacaaatgcgatttgtgaagtatttagtgatggaggtggttgccctaagctaagatcattgattcttgacaattgtgagagtttgagcattgtagaactgaatagcagttctttggtttgtctctctcttgctggttgccgctcgatgacatgcttaagactctcgtgcccaaatttgcaacatgtgaatcttgatggatgtgatcaccttaaaaatgcagcattctgtccagtgggccttgaatccctaaatctgggaatttgtccaaaattaagtattctgtgcattgaggccccaaatatgtctataatggagctgaagggttgtggtgtgctttccgaggcttccatcaattgccctcgcttgacatctttagatgcctctttctgcangcagcttgtggatgattcactgacttgtatgaccgg

SEQ ID NO: 48723 - protein, 214 aa, Zea mays
  misc_feature: Ceres CLONE 1458287-F
  misc_feature (203)..(203): Xaa is any aa, unknown, or other
MSLVHLRKFAELNLRSPVLSYIKVSRCSVLHRVSITSTTLQKLVLQKQESLSSLSLQCHNLIDVDLSDCESLTNAICEVFSDGGGCPKLRSLILDNCESLSIVELNSSSLVCLSLAGCRSMTCLRLSCPNLQHVNLDGCDHLKNAAFCPVGLESLNLGICPKLSILCIEAPNMSIMELKGCGVLSEASINCPRLTSLDASFCXQLVDDSLTCMT

SEQ ID NO: 48724 - DNA, 759 bp, Zea mays
  misc_feature: Ceres CLONE 1458288-F
  misc_feature (394)..(394): n is a, c, t, g, unknown, or other
  misc_feature (409)..(409): n is a, c, t, g, unknown, or other
aagctggagctccccgcggtggcggccgctctagaactagtggatcccccgggctgcaggaattcgcacgagaccattacctagaacatcctaatctaaaaatataccctgctcgtcagcccggataagataacgcccatctgcacgggccacgcgaagcgttcgagctcctcccacggcagccatggtcaccgccaccacctccccgctcttctccctctcctccctccgcgcctccctcccttcccccacccgatttcacacgtctctctcgctccgagccctctccccacgtgaccgtctctctgcctccctcactttcgcctccccactcgtttcaggcgggtacgggacctgggcggcgacttcaatgtcgtccgcgggaaggttgaanacgcgggtgctgcangtggtgtgccaagccactaactggacgacggcccgactcggttaagaaaaaggagcgccttaaacgactagccccgcttccgaaatcacgcgcggcagggcttagatgcgccctaggatgaaaaaggtcctaacagctccttgaaaagcctaagaagaaaccttgaccccccggccagaaaagaaaaaaaaagcttatccgttacccgccaacctccgaggtggggcccggtaccccaatttgcccttaaatggagatctaataccccgcgccccacggcgccccctttttaaaacaccggggacgggaaaaaccctgggggttaccccaatttaaacccccttgccccc

SEQ ID NO: 48725 - DNA, 793 bp, Zea mays
  misc_feature: Ceres CLONE 1458289-F
aaagctggagctccccgcggtggcggccgctctataactagtggatcccccgggctgcaggaattcgcacgagaccattacctacaacatcctaatcgaaaaatatgagtctcgtgcatttacccaagtttgctgaattgaatctgcggagccctgtgctttcttacatctaagtttccagatgttcactgctccatcgagttagcataacatcgaccacacttcggaaattgtggcctcagaaacaagagagattatccagcttgtcaatgctgtgccacaacttgattgatgtggatcttagcgactgcgactcgttaccacatgcgatttgtgacatattttgtgatggaagtggttgcgctaagttaaaatcatcgcatcaggacatttggaaatttttattatcccacaccccacatagcagtcttgggttgtccttctctgggggttccgctttaggactggtttaaacccccggggcaaattgcccctggcgatcttgggggaaggactcccttaaattgggctttccgccccggggccttaaaccccaaacttgggaatttggtcaaaattaaacctctgggccttgggcgcccaaaatttttcttaaaggcccaaagagggttggggggggtttccaaaaattttcctccagttcgcccccgcggagaaattttaaaggccccctctccggcgcgggccggtgggagagaaattctcttttttttttttccccggggcgccgcccttcaaaagagaaaatacacacaccccgcacaaccgcccc

SEQ ID NO: 48726 - DNA, 737 bp, Zea mays
  misc_feature: Ceres CLONE 1458294-F
  misc_feature: Encodes the peptide sequence at SEQ ID NO. 48727
  misc_feature (465)..(465): n is a, c, t, g, unknown, or other
  misc_feature (521)..(521): n is a, c, t, g, unknown, or other
  misc_feature (523)..(523): n is a, c, t, g, unknown, or other
  misc_feature (583)..(583): n is a, c, t, g, unknown, or other
ggagctccccgcggtggcggccgctctagaactagtggatcccccgggctgcaggaattcgcacgagaccattacctagaacatcctaatcgaaaaattatcaatttatcaccggggttagttttatgattcccaaacgaatgtatgcgcccaagctaggaaagggaggtggaaccttgggcttggggatggagggcagggagaatgccagggatgcgatgggggcagcgacgacggtgaggaggagggagccggcgaagaggcccgggagagtgtcgagccccagggagatggcaccctcgtcccgcagcgacagcaccacgaagtaggcgctcaggatctgcacctccagcacatacataattcagatggcctatcgtaaccttgcaggaacgggactggaggactacagcgagatggatcaaaggttggcttacaaataagaaggtggcggccgcgctcatncactgggggatctcgtgggggctgactgccactagaggtaccaccgcccgctccgnangttcctggatgaaccgggctagcatcccccattccccgatcctctcctgagggttggagntgactctaccccttccgcaccgggagtgcttatggctcctgcattcggccacccatgtgatgtggcccgaaaaagcccttggtttaaggggaaatccccccgaaatcccgtggccccacctttaagaaaaaattctttttcccgggagaaaaag

SEQ ID NO: 48727 - protein, 62 aa, Zea mays
  misc_feature: Ceres CLONE 1458294-F
MYAPKLGKGGGTLGLGMEGRENARDAMGAATTVRRREPAKRPGRVSSPREMAPSSRSDSTTK

SEQ ID NO: 48728 - DNA, 751 bp, Zea mays
  misc_feature: Ceres CLONE 1458295-F
  misc_feature: Encodes the peptide sequence at SEQ ID NO. 48729
  misc_feature (627)..(627): n is a, c, t, g, unknown, or other
acccgcggtggcggccgctctagaactagtggatcccccgggctgcaggaattcgcacgagaccattacctagaacatcctaatcgaaaaaatcacccgataagtagcaggggtgcagggagagcgacgacgacgacacgccacccgtaagtgagccgagagcccgcgagaccagctagctagctgtagataaccagccagcgcgagcatggcggcggcggcggtggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtgcccccagacctccgcggctacggcggcaccgccgcgccgcccgacgtcgcgtcctactccgccttccacgtcgtcggcgacgtcgtcgccctgctcgacgcgctcgacatccacaacaaggtgttcgtggtgggtcacgactggggcgccatcatcgcgtgatacctctgcctggtacggccggaccgggtggcggcgcttgtcacaccagcgtcgccttcatgcgccanatcttcgtccgcgccgccgtcagcggcgtcaggcccatcgactacttccaccgcacctacgggcccagctactacatctgccgcttccaggagcctggtgtcgcaaagaaggagttctcgccgt

SEQ ID NO: 48729 - protein, 116 aa, Zea mays
  misc_feature: Ceres CLONE 1458295-F
  misc_feature: SWISSPROT Homolog: EC 3.3.2.10 Soluble epoxide hydrolase
MAAAAVVRHRTVEANGISMHVAESGPDGGDGAPAVVFLHGFPELWYSWRHQMAHLAARGYRCVPPDLRGYGGTAAPPDVASYSAFHVVGDVVALLDALDIHNKVFVVGHDWGAIIA

SEQ ID NO: 48730 - DNA, 790 bp, Zea mays
  misc_feature: Ceres CLONE 1458296-F
  misc_feature: Encodes the peptide sequence at SEQ ID NO. 48731
  misc_feature (412)..(412): n is a, c, t, g, unknown, or other
  misc_feature (420)..(420): n is a, c, t, g, unknown, or other
  misc_feature (479)..(479): n is a, c, t, g, unknown, or other
tggagctccccgcggtggcggccgctctagaactagtggatcccccgggctgcaggaattcgcacgagaccattacctagaacatcctaatcgaaaaattcccaacttccgctgcgcctcgactcgtagcccgaaccctatccgcgggccggaggctatagagcagccatggcgcgagtgcctcgcgctcgtcgccctcctcgtactcggcctcgccgccgccgccgcctgccgcggccgacgcgaccttcgtctgtcgcgaacaagaagatttcgctctcccgccccaagttgggcgtctagcgcgtcgccatctccgtcgacctctagaaccagagatccgcgactgcctatgatgtgtgcattactgacgactcttggtcaacacagatgtctgagcttgtcactgcanaaaaatcntacaagatgggaaaggcttgactcctggtgccactgcttcaaacacatatgtcctgtanaccaaaacccagggcaagcttccagggttcaccagctatcattacttacgggttcccacaaagacgcctctttcgggaggaaataatcaattcccatcttccacgtggaatattctcgccgaagagacctcccaaaaaaaaattttgaaggggctaaaaaggtttggtgtgaaaaacggggcacatgggggcggggtgtcccttttgggggaaaagggttttctaccgttgggcggggccccgttaaaaaaagttcctctgaggggaccgaaaaaaaaaggcgtttctcttttttgggtgcgcgttggggg

SEQ ID NO: 48731 - protein, 52 aa, Zea mays
  misc_feature: Ceres CLONE 1458296-F
  misc_feature (4)..(4): Xaa is any aa, unknown, or other
MSCXPKPRASFQGSPAIITYGFPQRRLFREEIINSHLPRGIFSPKRPPKKKF

SEQ ID NO: 48732 - DNA, 760 bp, Zea mays
  misc_feature: Ceres CLONE 1458297-F
  misc_feature: Translation starting site: 200
aagctggagctccccgcggtggcggccgctctatactagtggatcccccgggctgcaggaattcgcacgagaccattacctagaacatcctaatcgaaaacttctttggatgccaaggcaccctcctccggaacccaaacccaagcccagaccagtcgaccctgcatccaaatctaggttatcggttcccctccacaggatgtcccaccccgccgctggaggcgccatggttcctgctgccggacgcgacatctcatgggctatcggcgtcccccggttcggcgactaggtctgggccaacgtaaagtcccatccgatggtggccatgccatatctacgtcatcagcctcaccgatgacgaggaggtacttcgcggacaccgcgacgggctcggcctcgtcgcctatcccccccacacgagcatgtggatgctttgaccctcaggagctcgaccgcttctaggaccacttcaccaagaatgaggcccaaggcgggaactcccgcagccgctttgcctcctctttggccgaggcctactactagttagccagccgcagcgcgctaggtctgttctgccctgtgcgatttcatgacgccttccgtccccactccagcgacgaggatttcttcctggtcgacgtcccggcattcaataccgatgctgagtacaaactcgaccatatcccggtcatcaggacccgattcgtgacgcgtactgcgcacaactaccagcatgaagtcgccgtggatcagcgagacg

SEQ ID NO: 48733 - DNA, 781 bp, Zea mays
  misc_feature: Ceres CLONE 1458303-F
  misc_feature: Encodes the peptide sequence at SEQ ID NO. 48734
  misc_feature (358)..(358): n is a, c, t, g, unknown, or other
  misc_feature (656)..(656): n is a, c, t, g, unknown, or other
aaactggagctccccgcggtggcggccgctctagaactagtggatcccccgggctgcaggaattcgcacgagaccattacctagaacgtcctaatcgaaaaagaccacccaaacccacaccacccactcggcggcggcgacggcggcggcggcggagcacgcaaagatggtgaagttcctgaaaccgggcaaggcggtgatccttctccagggtccgttccccggccggaaggcggtcattagtgcgcgttttctaggagggtcacgcgcgaccgcccctacggccactgcctcgtcccccgcctaagccagtacccccagaggtgatccgtagggactcggccagaagatcgcgaanaagtcccgcgtgaagtgcttcctgagcctgttcacttcacccaatcatgcccccccgtaacccggaatgtcacctcaaggaaggggcctccgggggcccaagccccccccccccggaaaaaaagccccccccgaaaggcccccaggccctcctgggaagggtccccccgccaaaaagggggtttccccccctccccttttaagaaaaagccccttaaaaaaaattttttgtgtgttgctccaaaaaaacacaggagggcccccccccctttttttttctccccccaaatttttggtgnaaacccccccccaaaaattttttttggcggggagggaggaaaaaaaaaaaaaatttttttttctcccccccccccgggggggggggcccccccccccccccccaaagaagaacaccacccccccc

SEQ ID NO: 48734 - protein, 46 aa, Zea mays
  misc_feature: Ceres CLONE 1458303-F
MVKFLKPGKAVILLQGPFPGRKAVISARFLGGSRATAPTATASSPA

SEQ ID NO: 48735 - DNA, 772 bp, Zea mays
  misc_feature: Ceres CLONE 1458305-F
  misc_feature (494)..(494): n is a, c, t, g, unknown, or other
aaagctggagctccccgcggtggcggccgctctagaactagtggatcccccgggctgcaggaattcgcacgagaccattacctagaacatcctaatcgaaaaaatccacccaaatcccagaccgagctccaatcctcagcgccgccagtcgcgccgcctccgatggccgccgcggcgcgggccccacgtcatcgagctccacgatcccaccccgcccctcctccggccgggcgccggggaccgcaccggccgccatccccgcgccgtcgcgcgatgagggcatcctcgcgcagcaccctcgcgccgccccctcgagcgcatccgcctcgcacccggccttcgcccttatcgaggagcgcctcataacccggaaccagcacatccagaagctcctcgtcgacaaccagcggttccccgccacgcacgtcgcgcttcagcagcagcttatcgcggcgcaacacgagctccgggcgatctccgtcgctgccaccagngcgcgcgccaagcgggaggtctaggtgcgagcgctggccgaccagacagcccacatagaggccgaggcgagggccgtcgccgctgcgcgcgcggaggtcgaccaagttcacgcctacgtccaggtgctcgtcgcagcgcgcactgaccttgtcgaccggctccacggcctactgtacgaactcgcgcacaatcaagctgacgcaactaagaccgattccgtccgtgaccacactgaaaccatgcgactggagatcagaacggcatggatccgtgatgc

SEQ ID NO: 48736 - DNA, 754 bp, Zea mays
  misc_feature: Ceres CLONE 1458307-F
  misc_feature: Encodes the peptide sequence at SEQ ID NO. 48737
  misc_feature (516)..(516): n is a, c, t, g, unknown, or other
  misc_feature (517)..(517): n is a, c, t, g, unknown, or other
aaagctggagctccccgcggtggcggccgctctagaactagtggatcccccgggctgcaggaattcgcacgagaccattacctagaacatcctaatcgaataaccaaattggcacttccgtaccccgaccccggccaccgtgtggaaacagaaacagcaatggcgggaaggctggtgccgagcacgaagaaggcgatggagcaccgggaggagaagcccaaggtgccgtcgagcgacccgggctccgaccccgacctggtgcagctggtggccgggcagcagccgcccaacatctcggatatgaagccgctgacgcgggaggcgtacggcggcggtatgtacgcggccgaggaggagggcggccggcggaggggccccgcgcggccgcgcgcgagcgccacgcatagcgccgacgggcccaatgagcatcgcgctggcgcgaggcccattccaccgccgccgtcgtgcaccgggtgaccgcgacttcgacatcagcgggcagtcctacatcagtanncgcatgtgcccgcttgccagcgccgccgcttgggcgtggccatttgcattttgtggctgaccagtaccctccgtaagttcttggcaaaaacttggttgggacttgcaaagggcctttgcaacccccttttaaaaatggcacccccccttgtttccccaaaataggttggaactgggcaaaaaaaaaaaaagtttttttctcccaccccgggggggcccggacccttcccccctaggg

SEQ ID NO: 48737 - protein, 105 aa, Zea mays
  misc_feature: Ceres CLONE 1458307-F
MAGRLVPSTKKAMEHREEKPKVPSSDPGSDPDLVQLVAGQQPPNISDMKPLTREAYGGGMYAAEEEGGRRRGPARPRASATHSADGPNEHRAGARPIPPPPSCTG

SEQ ID NO: 48738 - DNA, 735 bp, Zea mays
  misc_feature: Ceres CLONE 1458312-F
  misc_feature: Encodes the peptide sequence at SEQ ID NO. 48739
  misc_feature (451)..(451): n is a, c, t, g, unknown, or other
  misc_feature (650)..(650): n is a, c, t, g, unknown, or other
tccccgcggtggcggccgctctagaactagtggatcccccgggctgcaggaattcgcacgagaccattacctagaacatcctaatcaaaaaacaacacctcgctttttgtactcttccgtctttgccctcgcgttatcgcgctcgtctcgcctggcctagctagatgcctgcctgccttggcttgcttgctacatcatgtacacagcgagaggaatgacaggagcaccaaaagaaacaagagagagagagagagagtcgtttcctttcctcgaacttattccatggagacctcttctcacaagcgggcgcgggaggcggtcgatctcaccgccgccgccgccgccgccggagaggccgtgtggccggagtccaacacaaagaggctgcggccgcaggacctgctcaacatgctcgaggacaacaccgacgcggcggccgccggcgacctgncgtccgtcatgctgagcctgtaggaggagatagccagcttcgacgaggccgcggaggcggcgccgtcacatcacccggagctggtgttcctgctcaaggcctcggacgacgagctgggcctgccgccggccggatccgccgccccctcttcagaggaggccgggctcgccggcccgccggaagccgccgcccccgccgncggcgcgctctaaggccagatctgggccttcgacaaccaaatcgacggaggcttcggtggctactcgcccgaggctgccgccgcc

SEQ ID NO: 48739 - protein, 63 aa, Zea mays
  misc_feature: Ceres CLONE 1458312-F
  misc_feature (57)..(57): Xaa is any aa, unknown, or other
METSSHKRAREAVDLTAAAAAAGEAVWPESNTKRLRPQDLLNMLEDNTDAAAAGDLXSVMLSL

SEQ ID NO: 48740 - DNA, 757 bp, Zea mays
  misc_feature: Ceres CLONE 1458323-F
  misc_feature: Encodes the peptide sequence at SEQ ID NO. 48741
tgagctccccgcggtggcggccgctctagaatagtggatcccccgggctgcaggaattcgtctcacccctaatcgaaaaattttgctcggtaaacaacgtgtgaggatggtgcactagcagaagcccttgtacataatggatttcgcggtgaatcccacgttccataatggcataattccatatttctgcagcttgttccgccgagcgaacgacccacaaccagaagccacccattggcgtacgcgaggcgataggagcatcccgtcccaagaggagaaactccggccggcgacgcacgggaaaatggggaagacgccggtgcggatgaacgcggaggtgtacacgctgacgcccttccagaacaaggagatgcccgggctgaggaaggacatcaccaccaagatccaccacaaggtcgccgagaactggatctccgccacgctcctcatcacccccgtcgtcggcacctacacatacgacatgtggtacaaagagaaggagaacctttcccacagatactaaatgacatgccctccaatttgctacagcttgtcgcagttcaattttccatgatgcgatgcataatctgccaatgtcattactttgctcaagtttacttcaacccattttcacctttccatatacatataccgtatctgtgcctggcaaacatcttttgacgctgactaaatatgcgcgtcctgtctcttgaagtgtagactgaagaaaatatctgacagaaaacaaggacaccga

SEQ ID NO: 48741 - protein, 128 aa, Zea mays
  misc_feature: Ceres CLONE 1458323-F
MDFAVNPTFHNGIIPYFCSLFRRANDPQPEATHWRTRGDRSIPSQEEKLRPATHGKMGKTPVRMNAEVYTLTPFQNKEMPGLRKDITTKIHHKVAENWISATLLITPVVGTYTYDMWYKEKENLSHRY

SEQ ID NO: 48742 - DNA, 752 bp, Zea mays
  misc_feature: Ceres CLONE 1458325-F
  misc_feature: Encodes the peptide sequence at SEQ ID NO. 48743
  misc_feature (609)..(609): n is a, c, t, g, unknown, or other
aagctggagctccccgcggtggcggccgctctagaactagtggatcccccgggctgcaggaattcgtctcacccctaatcgaaaaataacaagcgtcctgggaaggagcaagttccactccactcccctgagtcccctccatcatgtgtgtaatcatgtcaatgtgaaggcaacaatgtcaaaggcagtggtcggcactgccactggcactgctacgcacgcaacgcatcgccttttgagggaacttctgttcactgtccctactccctccctcccccgcaggctgctggtggaggactacccgcaacgcaccatcttctacaacctccacaacgccggcctctccttcggcgtctacttccaggacgtgccggccgtgctcttctacaggaacctccacaagctcaagtaccttctggacttccacccgctgcacacttccttcgccgaccacgcccgccgcgagacgctccccaactacgccgtcatcgagcaccactacctgcactccaagctggacccggccaacaacgaccacccgtcacacgacgtgtaccagggccagatgctgctcaagaacatctacaatacactcctctccagcctgcnatgaaaacagacactgctcatcttctcctacgacgagcacagcagtctcctctgacaacgtacccacgccgtctccggcgtgcccagcctccacgcatacgcagaccgtcttcatacacttcacatctaaccgctcgaggacc

SEQ ID NO: 48743 - protein, 144 aa, Zea mays
  misc_feature: Ceres CLONE 1458325-F
MSKAVVGTATGTATHATHRLLRELLFTVPTPSLPRRLLVEDYPQRTIFYNLHNAGLSFGVYFQDVPAVLFYRNLHKLKYLLDFHPLHTSFADHARRETLPNYAVIEHHYLHSKLDPANNDHPSHDVYQGQMLLKNIYNTLLSSL

SEQ ID NO: 48744 - DNA, 766 bp, Zea mays
  misc_feature: Ceres CLONE 1458327-F
  misc_feature: Translation starting site: 372
  misc_feature (449)..(449): n is a, c, t, g, unknown, or other
  misc_feature (567)..(567): n is a, c, t, g, unknown, or other
  misc_feature (598)..(598): n is a, c, t, g, unknown, or other
  misc_feature (766)..(766): n is a, c, t, g, unknown, or other
aagctggagctccccgcggtggcggccgctctagaactagtggatcccccgggctgcaggaattcgtctcacccctaatcgaaaaatccgccccgatccgaccccaaatcaattccaaattcaatccggtctcagtggttggcccgccgctgccagtgccagatcgaatcggactctcggctcgtgtgcagcccaccggcgagacgccgaagctatatttttatgcccatctgatccgatgcgtggtgtggcgtcctctccgcttttactagatcatcagtagccagctcaggagccgagcctggtcagggtagccaagcccatcccggtcctctcccggcgtcttctccctccgcaccgcggctccggcaatggcgggcgtcggctccgcgctgcgtcggctctacctctccgtctacaactgggtcgtcttcttcggatgggcgcangtgctgtactacgcggtcctgacgctgcgtttgagcgggcacaaggccgtctacaccgccgtcgagaggccgctgcagttcgcgcagacagccgccatcatggagatcgttcatgggnctcgtaggttggtgaggtctccggtctctgncactcttccacagattggatccagttcgtccttacgtggggtgtcatgtggagttttcctgagaccagtcacaccttcttgttactaccctggtcataagctggtctatcactgagatcatcagatactccttcttttggaacgaacgagcatttggctttgcgcttn

SEQ ID NO: 48745 - DNA, 756 bp, Zea mays
  misc_feature: Ceres CLONE 1458330-F
  misc_feature: Encodes the peptide sequence at SEQ ID NO. 48746
  misc_feature (364)..(364): n is a, c, t, g, unknown, or other
  misc_feature (386)..(386): n is a, c, t, g, unknown, or other
ctggagctccccgcggtggcggccgctctagaactagtggatcccccgggctgcaggaattcgtctcacccctaatcgaaaacccgttcctcacgccgcctccacgcctccaacagaagaaccctaagctgccctcgctccgacgccgccacctcgtcgtccgaccgcatcgattcgatggcccgcatctccgccgtcgttgccgccgtgatcaccgccgccgttgtcgttgacgcgctgttcacagccgcctccgccaccgaggcaccggcccccgccccgatgtccggcgcgggcgccctctcagcgcagctctccgtcggctggctcgcggcgctccctcgcgcttttctcccgcactgancggtgaggccgccccgtctgcntggcgcgtctcagatctaggggaacagtggtagtgagagttgcaatcttagtgtaatcccaagtatcctacgggtggtgataggttatgaaaataagccattgggtttgttcaccggggggggggaaaggaaaaatccgggcttttggaaaatttttcctttggagccgagatttatttaaaagagaggggggagttataacatataaaatttatagggggtttttgcccccggccccccggggaaaggggattattttgggggtttaggggttttaaaaaaaaaaaaaaaaaaaggagggggggggcccctcccccctaagggagggttaaacccccccccgcggggttttttaaaaagggggggggaa

SEQ ID NO: 48746 - protein, 61 aa, Zea mays
  misc_feature: Ceres CLONE 1458330-F
MARISAVVAAVITAAVVVDALFTAASATEAPAPAPMSGAGALSAQLSVGWLAALPRAFLPH

SEQ ID NO: 48747 - DNA, 794 bp, Zea mays
  misc_feature: Ceres CLONE 1458342-F
  misc_feature: Encodes the peptide sequence at SEQ ID NO. 48748
aagctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctctttttcaccgcgacctcttttttttcctaaggaacgtacattgtcattttttggaagcttctgaaagcatggcgtggcgcgtgaactatgattgtatgagtcactcccaagctaaactggttgagtactatgctagcctgaagaactgcatccccatctggggtgggaccccgagggaggtttctttttcggaaacgcctccttttggccccgaacaattagggccccccccaagccgggaaaaaaccggggtttgggtttgggagaaaaaaaccccggggtttttccaaaggcccatcgaaaaagaaaaaaagaggttttttaaacccaggtgtccccccccccaaaaatttggggggccttttgattaaggggcgataaacgttctataaaaaaaaaaaaaaaaagggcgggggggggccccctccccccccgggaggaaaaaccccccccccggggcggttttttaaaacggggggagaaaaa

SEQ ID NO: 48748 - protein, 72 aa, Zea mays; identical to SEQ ID NO: 46180
  misc_feature: Ceres CLONE 1458342-F

SEQ ID NO: 48749 - DNA, 731 bp, Zea mays
  misc_feature: Ceres CLONE 1458348-F
  misc_feature: Encodes the peptide sequence at SEQ ID NO. 48750
  misc_feature (627)..(627): n is a, c, t, g, unknown, or other
tccccgcggtggcggccgctctagaactagtggatcccccgggctgcaggaattcgtctcacccctaatcgaaaaaaactgagcaaacccctcatcctattctcgcgcccggcgtctcccttctccaacctccgtttctaatccgcgctgctaatcccactcccagtcccagctcgtccgctgagatggacagtagcagcctcaaatccgcgcagctcctggagctgatgcgccagcacctggccaccgatgccggcaaggaggtcaccaagaaggtcggcctcgtctaccagctcaacatcgcccccaagaagatcggcgttgatgaggagatcttcgtggtcgacctcaagaagggcgaccccaccaaagggccgtaccagggaaagccggatgccactttctccttcacggacaacgatttccttggaatcgccaccggcaagacgaatccgcagattgcattcattcgaggggcgattaaaaatcaggggagcatcagtgcggcgcagaagttcacccctgacatcttccccagcctgctaagctgtaaaggttaaattgtgtattacttgggcaagggaataaatatgtttgcaactccattactatgaacaaaaacatggntgaacatgaaaaccctttcccgggggaattggaaaaggttaactcccttaaaaaaagccaatgtcgtttccaaaaaaaaaaaaacaaaaccccggggcccaatt

SEQ ID NO: 48750 - protein, 124 aa, Zea mays
  misc_feature: Ceres CLONE 1458348-F
  misc_feature (12)..(117): Pfam Name: SCP2 Pfam Description: SCP-2 sterol transfer family
  misc_feature: SWISSPROT Homolog: EC 2.3.1.176 Propanoyl-CoA C-acyltransferase
MDSSSLKSAQLLELMRQHLATDAGKEVTKKVGLVYQLNIAPKKIGVDEEIFVVDLKKGDPTKGPYQGKPDATFSFTDNDFLGIATGKTNPQIAFIRGAIKNQGSISAAQKFTPDIFPSLLSCKG

SEQ ID NO: 48751 - DNA, 774 bp, Zea mays
  misc_feature: Ceres CLONE 1458351-F
  misc_feature (624)..(624): n is a, c, t, g, unknown, or other
  misc_feature (749)..(749): n is a, c, t, g, unknown, or other
  misc_feature (750)..(750): n is a, c, t, g, unknown, or other
  misc_feature (758)..(758): n is a, c, t, g, unknown, or other
  misc_feature (762)..(762): n is a, c, t, g, unknown, or other
  misc_feature (763)..(763): n is a, c, t, g, unknown, or other
aaagctggagctccccgcggtggcggccgctctagaactagtggatcccccgggctgcaggaattcgtctcacccctaatcgaaaattcctgccggctgccgactgccgtcccggcatcctgttgttgcccatctcatcgcccgaggccggccgcccagtgccgcacaaccaccatatctccctcacagtcacagcctcactccatgacgctcgttgcctgccagccagcctaatctataagctcatcgccgtcgaggcagtgcccagctgctctcttctatttctacaagcggtcaggtagtattattagtatgttgtatggctaatggctaatggctaatggccgatggcctgcgagacaacaccaactgcgccgagctgccgcagacaacaccaactgcacactgctgcataggaggtcaggagaaggcgctccagcgcagcacggcagcagggatttctggacggatctgattgaataaaccgtgaaggagatgccctggaatagattcatgcccttcctttcaaaatgttgtacttctaccgttcagacatcttcatcatattcatctttttcctcgtccttctccccgatacaaccatggttatttgtgggtcatggncaccctggtgagaatgtatcatcaccaggcacaacgtgggttttgatagatagatgcatttgcgccatcccagggtatacccctgactacacattacttcaaagcactctttggtgaagggaggnntgaatgantccnntgtcttctgcc

SEQ ID NO: 48752 - DNA, 748 bp, Zea mays
  misc_feature: Ceres CLONE 1458352-F
  misc_feature: Encodes the peptide sequence at SEQ ID NO. 48753
  misc_feature (375)..(375): n is a, c, t, g, unknown, or other
tccccgcggtggcggccgctctagaactagtggatcccccgggctgcaggaattcgtctcacccctaatcgaaaaactatcctaccaggcaccactcgcatcgtgtgctcagtcagatccccgtcccgcatttcctaaggccagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcagctgctcctggcctctaaggtttaagcgcaatgatgttgttgtaagagcaatatcggaagagtgtggcccgcangggcttcccattgatctcagaggtaaaagggcattcattgctggagttgctgatgataatggctatggatgggcaattgcgaaagcacttgctgcggctggtgctgaaatttctgtgggtacatggttgccggcacttaacatatttgagacaagtctgaggcgtggaaagtttgatgaatcacggaagctgccagatggatctcctatggatattgataaagtctatccacttgatgctgtctacgattcccctgatgatgtccctgaagatgtcaaatcgaaacaaagatatgcaagggcatcaaactggacagtaaaggaagttgttgaatcttcgaggaatgatttggcagcattgacatactaacgct

SEQ ID NO: 48753 - protein, 194 aa, Zea mays
  misc_feature: Ceres CLONE 1458352-F
  misc_feature: SWISSPROT Homolog: EC 1.3.1.9 Enoyl-[acyl-carrier-protein] reductase (NADH)
  misc_feature (72)..(72): Xaa is any aa, unknown, or other
MTASAAAGVQMVAARPCISASPGILTARVAVSRTDCMLSTTATFPKISCSWPLRFKRNDVVVRAISEECGPXGLPIDLRGKRAFIAGVADDNGYGWAIAKALAAAGAEISVGTWLPALNIFETSLRRGKFDESRKLPDGSPMDIDKVYPLDAVYDSPDDVPEDVKSKQRYARASNWTVKEVVESSRNDLAALTY

SEQ ID NO: 48754 - DNA, 758 bp, Zea mays
  misc_feature: Ceres CLONE 1458353-F
  misc_feature: Encodes the peptide sequence at SEQ ID NO. 48755
  misc_feature (392)..(392): n is a, c, t, g, unknown, or other
  misc_feature (506)..(506): n is a, c, t, g, unknown, or other
  misc_feature (518)..(518): n is a, c, t, g, unknown, or other
  misc_feature (533)..(533): n is a, c, t, g, unknown, or other
  misc_feature (534)..(534): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
acagctggagctccccgcggtggcggccgctctagaactagtggatcccccgggctgcaggaattcgtctcacccctaatcgaaaaatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacnccggtgttcctgatcttcagccccgtgctgggtcccgccgcgctgctcatcgggacggccgtcatggggttcctcacgtccgggcgcgctggggctcggggggcctgtcctcgntaacgggcctcnccaaaacgggggggnnaggcgttccacgccaccccgggatacgtggaagagggcccccccaggatgggggaaggccccggcgcacgcgggccaaaaaaccgcccatgggggcccaggcctcccgggnnnnnncccatcgccccccccccgggaaagttcatgtcccccccccttgnnnncggcgccttgtttcccctcataaaaaaccccnnnggaagataaaagaaaataccacccccg

SEQ ID NO: 48755 - protein, 118 aa, Zea mays
  misc_feature: Ceres CLONE 1458353-F
  misc_feature (44)..(119): Pfam Name: Oleosin Pfam Description: Oleosin
MADRDRSGIYGGAHATYGQQQQQGGGGRPMGEQVKGMLHDKGPTASQALTVATLFPLGGLLLVLSGLALTASVVGLAVATPVFLIFSPVLGPAALLIGTAVMGFLTSGRAGARGACPR

SEQ ID NO: 48756 - DNA, 761 bp, Zea mays
  misc_feature: Ceres CLONE 1458358-F
  misc_feature: Translation starting site: 156
  misc_feature (504)..(504): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (709)..(709): n is a, c, t, g, unknown, or other
  misc_feature (754)..(754): n is a, c, t, g, unknown, or other
aaagctggagctccccgcggtggcggccgctctagaactagtggatcccccgggctgcaggaattcgtctcacccctaatcgaaaactatctccctgtttaatcaatccttcaagcggaagctgcctcctcctcgtcgtccggtcgtgataagggatggcgggccgtggcaaggctatcggcgctggcgccgcgaagaaggcaacgtcgaggagctccaaggccggactccagttccccgtctgcaggattgctaggttcctcaaggcgggcaagtactctgagcgcgtcggcgccggcgcccccgtgtacctcgccgccgtcctcgagtacctcgcggctgaggttctcgaacttgccggggaacgccgcgagggacaacaagaagacccgcattgtgccgcgccacatccagcttggctgtgcccaccgacgaggagctgaccaaactggttcggtggtgccccccctcccaggccgaggggttatggcctaccttcccttnaaattcggcccccaaaaaaggggcctttcccccagggcgcgggtgcaaaaccaaaacacctgaaccccttccccgaaaaaagtccccacaccccccttttttttagagaaaaagaaaaaatgtttctccattggggaagacccggttttccgcgaagaaaattaaannnttttgttcttttttggaggaaagggaaggggggggnaacccgcggggtccggccaaaaaaaaaagagggggctcttttgtncctaacg

SEQ ID NO: 48757 - DNA, 757 bp, Zea mays
  misc_feature: Ceres CLONE 1458365-F
  misc_feature: Encodes the peptide sequence at SEQ ID NO. 48758
aagctggagctccccgcggtggcggccgctctagaactagtggatcccccgggctgcaggaattcgtctcacccctaatcgaaaaacctacgaagctccttaattaattattgccctttcacttcgccatcggcagccgagcaccatgagctccacaggcggcggcgaccatggcgccaagaagtcttggccggaagtggtcgggctcagcctggaagaagccaagagggtgatcctgtgcgacaagcccgacgccgacatcgtcgtgctgcccgtcggcacgccggtgaccatggatttccgccccaaccgcgtccgcatcttcatcgacaccgtcgcgaacgcaccccacatcggctgacgtttaaatctacaaaatgaatgactcggacatgccatgcgtacctgtccgtctcccaataaaggatgtgtgtgtgcttcgatcgttcctataagttgctaggaaaaataatggcatgcgtctttatgcatgaataaacacgtatcggaagtgaaaaactggctctacttctaaacatcagagtccgagacgctcgaggaacccaattctccctatagtgagtcgtattacgcgcgctcactggccgtcgtttcacaacgtcgtgactgggaaaaccctggcgttacccaacttactcggcttgaagcacatccccctttcgccagctggcgtaatagcgagaagcccgcaccgatcgccattccaatagttgcgcaacctgaatgcagatggaaa

SEQ ID NO: 48758 - protein, 71 aa, Zea mays
  misc_feature: Ceres CLONE 1458365-F
  misc_feature (12)..(71): Pfam Name: potato_inhibit Pfam Description: Potato inhibitor I family
MSSTGGGDHGAKKSWPEVVGLSLEEAKRVILCDKPDADIVVLPVGTPVTMDFRPNRVRIFIDTVANAPHIG

SEQ ID NO: 48759 - DNA, 763 bp, Zea mays
  misc_feature: Ceres CLONE 1458368-F
  misc_feature: Encodes the peptide sequence at SEQ ID NO. 48760
ctggagctccccgcggtggcggccgctctagaactagtggatcccccgggctgcaggaattcgtctcacccctaatcgaaaaatccaattccacttccacaccgcgggcctcgccgccgacgccgacgccgccggccatgtccaagtacggcaccattcccacctcctcctccgcgggcggagggcccgtgcccctcggcggcgcctccccgctcgatttcatctcccgcgccaaggctcggggcgcctcggcgctggcgacgcgccggccctggcgcgagctcgtggacgtccacgccgtcggcctgcccccgagcctcggcgacgcgtacctccgcgtgcgcgccaacctcgcccacttcgccatgaactatgccatcgtcgtcctcgtcgtcgtcttcctctccctcctctggcaccccgtctccctcatcgtattcctcgtctgcatgcttgcctggctcgtcctctacttcctccgcgacgagcccctcgtcctcttcggccgcgtcgtcgccgacggctacgtcctcaccgtgctcgccgtcgtcacgctcgtcctgctcctcctcaccgacaccaccgccaacatcctctcctcgctgctcatcggcctcgtgctcgtcctcgtccacgccgcgctgcacaaggcggaggacaacacccccgacgatgctgaccgctgctacccgccggtgtcacaccatccgcccactgaggatctgaatgtggccgtctgcgctttggctgtgatcaattctga

SEQ ID NO: 48760 - protein, 208 aa, Zea mays
  misc_feature: Ceres CLONE 1458368-F
  misc_feature (35)..(186): Pfam Name: PRA1 Pfam Description: PRA1 family protein
MSKYGTIPTSSSAGGGPVPLGGASPLDFISRAKARGASALATRRPWRELVDVHAVGLPPSLGDAYLRVRANLAHFAMNYAIVVLVVVFLSLLWHPVSLIVFLVCMLAWLVLYFLRDEPLVLFGRVVADGYVLTVLAVVTLVLLLLTDTTANILSSLLIGLVLVLVHAALHKAEDNTPDDADRCYPPVSHHPPTEDLNVAVCALAVINS

SEQ ID NO: 48761 - DNA, 781 bp, Zea mays
  misc_feature: Ceres CLONE 1458369-F
  misc_feature: Encodes the peptide sequence at SEQ ID NO. 48762
aagctggagctccccgcggtggcggccgctctagaatagtggatcccccgggctgcaggaattcgtctcacccctaatcgaaaactcttcggacaaaaatatccttgtacctgcatctcgacctcaccggcgtccggcggtggtatcacgatggtggcgttgctggaccagcggatcgggatgtctgcggcagctgccgcgttcatcaccctggaggagttcggatccgcctcatcctcgcccaagtccttcgtgaagtccaccgtctccgcccatgacgtcgtcatcttctcgaatcatactgccagtactgcaaaatactaatgccgtgtttaacgagcttgacctgatcaagagccatatgttgctgaacttgaacagcgagaggatggctcagaaattcaggagccctaacttgaaagagtggcagggggactgtcccctcaatttttgtccaggaaaagcacctgggtggtcctgaaaacccgttgaacccttcaaaatggaaaactggggttaacttccaaacttcgaggcccggggcccccttggggcaaattcccccctggggcgccgtttttttgggttaaaacggaccgggttttaaaaattcaaaatgggttacccccccggggaaaccaaacaaccccttaaaaagctcttttttccccggggggagaaaaaaaaattctctttgttaaagccaacaggaatttttggagccctccgaaaaaaaaaaaccgcggggtttttttttttaccaccccgacagacttttttt

SEQ ID NO: 48762 - protein, 57 aa, Zea mays
  misc_feature: Ceres CLONE 1458369-F
MVALLDQRIGMSAAAAAFITLEEFGSASSSPKSFVKSTVSAHDVVIFSNHTASTAKY

SEQ ID NO: 48763 - DNA, 762 bp, Zea mays
  misc_feature: Ceres CLONE 1458371-F
  misc_feature: Encodes the peptide sequence at SEQ ID NO. 48764
  misc_feature (530)..(530): n is a, c, t, g, unknown, or other
  misc_feature (737)..(737): n is a, c, t, g, unknown, or other
  misc_feature (744)..(744): n is a, c, t, g, unknown, or other
aaagctggagctcaccgcggtggcggccgctctagaactagtggatcccccgggctgcaggaattcgtctcacccctaatcgaaaaacgtgtcgatgcagtccgtgactgcaatagaacatcctggccaacaccggtgagcgaagagaaacgattccatagtcgaagcgtagatcgcagcggagcagaggcatggatggaaagagctttagcaacgaacagcaagcccaacaaaagaacccagacgcagtgacaaacagtgttccgagccaaggccaggagcccttgaacacgtttccagattcagacgatggaaacacgaacaccggtccgttgaatggccatgcagcagctcatgtgaacatggaagctgccatctctacggaggacgtcatacgggctggcgggttcggagcgaaggatgacattggcagcctcctcccgacggcaattgattccaccgattttgaggcctcgctgcgggatgcccgtggtttcgagggcgagaaagcggcgccgtcgcatcctggnactagggtggaagggggagaaagctgatggtggaacaaactggcagatgtggcggagcagtgatcacgctttcctcttctgtagcccagctccagccttcagaaaaccttgttttctgccacgtgtgtctggagagctgccctgcgtatgaactttctttgtcacagtggtttgtgtgacacataacattctgtgtatgaacatgangatgtcngttctatgcctgtctgtc

SEQ ID NO: 48764 - protein, 121 aa, Zea mays
  misc_feature: Ceres CLONE 1458371-F
MDGKSFSNEQQAQQKNPDAVTNSVPSQGQEPLNTFPDSDDGNTNTGPLNGHAAAHVNMEAAISTEDVIRAGGFGAKDDIGSLLPTAIDSTDFEASLRDARGFEGEKAAPSHPGTRVEGGES

SEQ ID NO: 48765 - DNA, 698 bp, Zea mays
  misc_feature: Ceres CLONE 1458373-F
  misc_feature: Encodes the peptide sequence at SEQ ID NO. 48766
  misc_feature (374)..(374): n is a, c, t, g, unknown, or other
  misc_feature (542)..(542): n is a, c, t, g, unknown, or other
  misc_feature (594)..(594): n is a, c, t, g, unknown, or other
tggcggccgctctagaactagtggatcccccgggctgcaggaattcgtctcacccctaatcgaaaaacatcccatcccatccgcagcggctttacctaccgagaagaagagagaaaaaaggttcgagtgcgttccacagtgaggagtgagaagagatggctccggtgaagctgtacggcgcgaccctgtcgtggaacgtcaccaggtgcgtggcggcgctggaggaggccggcgtcgagtacgagatcgtacccatcaacttcggcaccggcgagcacaagagccccgaccacctcgccaggaaccccttcggccaggtgccagctttgcaggatggtgacttatacctcttcgaagcgcgggcgggttgcaantacgcgtgccgcaccaacaagtcagagctgttgaaggagggcgacatcaaggagtcagcaatggtggatgtgtggctcgaggtggaggcccatcagtacactgccgctctgagccccattctcttcgagtgccttatccatctcatgcttgggggagcgtgggaccanaaggtcatcgacgaccaaccttgtaagatcaaaaacgtgctggccgtgtacnaggcgcaccttgagaagtcccaagtaccgtggtgggagacttcctcagtccttgcggaccttaacccatgtgtcggtcaccccgtgccttggcgggtacactct

SEQ ID NO: 48766 - protein, 181 aa, Zea mays
  misc_feature: Ceres CLONE 1458373-F
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
  misc_feature (73)..(73): Xaa is any aa, unknown, or other
  misc_feature (129)..(129): Xaa is any aa, unknown, or other
  misc_feature (147)..(147): Xaa is any aa, unknown, or other
MAPVKLYGATLSWNVTRCVAALEEAGVEYEIVPINFGTGEHKSPDHLARNPFGQVPALQDGDLYLFEARAGCXYACRTNKSELLKEGDIKESAMVDVWLEVEAHQYTAALSPILFECLIHLMLGGAWDXKVIDDQPCKIKNVLAVYXAHLEKSQVPWWETSSVLADLNPCVGHPVPWRVHS

SEQ ID NO: 48767 - DNA, 740 bp, Zea mays
  misc_feature: Ceres CLONE 1458375-F
  misc_feature: Encodes the peptide sequence at SEQ ID NO. 48768
  misc_feature (209)..(209): n is a, c, t, g, unknown, or other
ggcggccgctctagaactagtggatcccccgggctgcaggaattcgtctcacccctaatcgaaaaatcttaacagccaggaagctggcgtcttgcttgtccttgttcttttcccacccggctacccccgtcgtcgccgccgctttccccgtggtttcagagctccagtcggctagctaggccgcctggctaatctccctgccttctatnagtacaggttcattgtgtgctgtgctccccagctcatcactgacacaagagagcacgctactactcatcactcgccaacgtgcatagatcagggaagcggcactccatcactgactggacgctcatggcgaggtccacctctacttcccgcgggcttggcctgttttctttgggttgcaaccccgggccttgcggggaacccaaattgtttagggaatctgccccggttaatacccccccccgggaaaatataacggttcccgggtcagaggaaatttttggggagacaatttttttttctggggggggaaaacgggggaacaccaaaaccgggggggtcctgggggggggggccccacggaaaaaaatcccggggggggaaaaccgggggggctctttgtgggggaaataaaaaccgggggggggagaaaaaaaccccaaaaaaaaccccggccgaggaaaaaataatttttcttctcgcgaggggggggggggggtgttttttaacacccgagggaggtgtttttttta

SEQ ID NO: 48768 - protein, 95 aa, Zea mays
  misc_feature: Ceres CLONE 1458375-F
MARSTSTSRGLGLFSLGCNPGPCGEPKLFRESAPVNTPPRENITVPGSEEIFGETIFFSGGGKRGNTKTGGVLGGGAPRKKIPGGENRGGSLWGK

SEQ ID NO: 48769 - DNA, 750 bp, Zea mays
  misc_feature: Ceres CLONE 1458380-F
  misc_feature: Encodes the peptide sequence at SEQ ID NO. 48770
  misc_feature (669)..(669): n is a, c, t, g, unknown, or other
ccccgcggtggcggccgctctagaactagtggatcccccgggctgcaggaattcgtctcacccctaatcgaaaattgggtatgatctgtatggtgccaacctgaatgatgatgacatggacatggctatgacccggtacagcttacctgaggtggttcttgtcaagaagagctatgagaagaggcctcgcacacggcgatggaagcttaagaggctgccggtggaggaagatgctgcaaataaggccaagggcgaggaagagaagaggctagatgagtacgaggctttcctcagggatttggaggtggactcagggatgtggtccaagatgaatctgtacaaaaatgaggactataggtctgagatggcatcaacagttggtgatgatatccctacggtgccaattgaggagctgattgaggacttgacccttggtgacgatgaggaggatgaagggaaagaaactgtggaagggaacactcatactggaatggtggaatgagcaatactgtctactatttgtttccgaattgctgactgggatgggttggcctacctgccccttctggtgatgagcctgtcagttatcatatatgttatttttgtttgttactgctacaagtagaattttggttgtagtggctaagttttgaattctgctgtttgtcnaatcatcttttttttccactcttccctggtatccaacttttcattaatttttaaataaaagctttcataaaaatgatttcc

SEQ ID NO: 48770 - protein, 128 aa, Zea mays; identical to SEQ ID NO: 46921
  misc_feature: Ceres CLONE 1458380-F

SEQ ID NO: 48771 - DNA, 747 bp, Zea mays
  misc_feature: Ceres CLONE 1458382-F
  misc_feature: Encodes the peptide sequence at SEQ ID NO. 48772
ggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccggggctgtggaaggacatcaccaccaagatccaccacaaggtcaccgagaactggatctccgccacgctcctcctcacccccgtcgtcggcacctaccaatacgccatgtggtacaaagagcaggagaagctttcccacagatactaaatgggatgtcctccaagttgctgcggcttgtcgcagttgaattttccatgatgggttgtataatctgtcaatgtcatttctttgctcagttttagttcaacccattttcacctttccatatgcatatacggtatctgtgcctggcaaacatattttgaggctagctaaatatgaaccttttgtctcttaagtgttaaataaagaaattatctgacaaaaaaaaaaaa

SEQ ID NO: 48772 - protein, 72 aa, Zea mays; identical to SEQ ID NO: 46899
  misc_feature: Ceres CLONE 1458382-F

SEQ ID NO: 48773 - DNA, 716 bp, Zea mays
  misc_feature: Ceres CLONE 1458384-F
  misc_feature: Encodes the peptide sequence at SEQ ID NO. 48774
ccccgcggtggcggccgctctagaactagtggatcccccgggctgcaggaattcgtctcacccctaatcgaaaaatccaaggccctcccaaagtcccaaaggccgccgccgcccgccagcccaccatggccgcgcagtccttcctcctcgccgccactgccgccgccaggtcccccgcggtcttcgccgctccctattcctccgcacgccctttccactcggtccacttcgtcgccggcccgtggggcgccgccgccgccagggcgctcgtcgtcgcggacgccactaagaaggccgtagccgtcctcaagggcgcgtctgaggtcgagggcgtggtcacgctcacgcaggacgacgatggacccacaactgtgaatgtccgtatcactggacttacccctggacttcatggcttccacctccacgagtttggtgatactaccaatgggtgcatatcgacaggaccacattttaatccaaacaatctgacgcacggtgcaccagaagaccaagtccgtcctgcgggtgacctgggaaacattgttgcaaatgctgagggcatagccaaggcaaccattgttgatacccagattcctttgactggcccaaattccgttgttgggaaagcatttgtgggttctgaacttgaaaatgatttggggaaagggggccatgacctcacccttctctattggaaaagcctggggaaaaacggc

SEQ ID NO: 48774 - protein, 197 aa, Zea mays
  misc_feature: Ceres CLONE 1458384-F
  misc_feature (54)..(187): Pfam Name: Sod_Cu Pfam Description: Copper/zinc superoxide dismutase (SODC)
  misc_feature: SWISSPROT Homolog: EC 1.15.1.1 Superoxide dismutase
MAAQSFLLAATAAARSPAVFAAPYSSARPFHSVHFVAGPWGAAAARALVVADATKKAVAVLKGASEVEGVVTLTQDDDGPTTVNVRITGLTPGLHGFHLHEFGDTTNGCISTGPHFNPNNLTHGAPEDQVRPAGDLGNIVANAEGIAKATIVDTQIPLTGPNSVVGKAFVGSELENDLGKGGHDLTLLYWKSLGKNG

SEQ ID NO: 48775 - DNA, 775 bp, Zea mays
  misc_feature: Ceres CLONE 1458386-F
  misc_feature: Encodes the peptide sequence at SEQ ID NO. 48776
  misc_feature (461)..(461): n is a, c, t, g, unknown, or other
  misc_feature (523)..(523): n is a, c, t, g, unknown, or other
aagctggagctccccgcggtggcggccgctctagaactagtggatcccccgggctgcaggaattcgtctcacccctaatcgaaaaaacagtccgtatattccgctcataattcctcaccggcctgcctcagagagagaaaaagcggagattagcggcggcgatggcactcccggcgtcgagctccggcctcttccgcttcgtctccccgcgcagccgcccccagtccaccgacatcgtggctgccgcctcctggggagtcttcgccggcaccgccggcctctacctcgtccagccatttgactggattaagaaaactttcttcgagaaaccccaaccagaggcataaaaggcttgcaagtctgcaactttggtacttcacttttatccgggatggttcctgactgaagagaacttggataactcagcaaataatacgagaccccctcgtgtttccctgttnggttttttatatcagatgtaggcaatccccacgagggagacaggaaacagagaactgctggnttcacctgtgtctatataaactcctgtggtatccaacatgctggtttaaaacctgtggcaatttttccttgcttggtttaaaaaaaaaaatttaaaaaaaaaaaaaaaccgggggcgccggaggacccaattcccccaataaggggccgtattccgcgcgccccggggcccgctttttaaccgccggagggggaaaaccgggggttaccacttttaacgcttggggaaaatcccccttttccgaggggggaa

SEQ ID NO: 48776 - protein, 61 aa, Zea mays; identical to SEQ ID NO: 45456
  misc_feature: Ceres CLONE 1458386-F

SEQ ID NO: 48777 - DNA, 794 bp, Zea mays
  misc_feature: Ceres CLONE 1458395-F
  misc_feature: Encodes the peptide sequence at SEQ ID NO. 48778
ctggagctccccgcggtggcggccgctctagaactagtggatcccccgggctgcaggaattcgtctcacccctaatcgaaaaacacacaacaccagtcaccagctcatcacatccatctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgtggacgactgcagccagcaccagcagcagacccagctgaaggtggccgcgccgccgtccaaccctactaggggcaagaagcgcgccgccgccgaaagaggagcagaacagaagcgcgccgccgccgaagaggaaggcagacaagcagcgcgacgcgtagacagcacccccgggcgcaaggtgagtagctagatctgaacaccgaaacgtccaaaggaacccaaacgtgtgtcccttcgacgtacgttacgtgtacgtacgtaccaattctttcccttcgggcccaaatgctgcccgggggggccccccccccccactatttgtcccaaattttgaggggccccgggggagaggccccccgggagggctcaacaaaaaacttttttccgaggaaaaaacacgggcctccccaccaccacaaagggggccaaaaaaaataggtggggggccgcgcccacaaaagggggtcccccccccccaaaaaaacccggcggggggggggggtttttttataatatgatagacccccccc

SEQ ID NO: 48778 - protein, 83 aa, Zea mays
  misc_feature: Ceres CLONE 1458395-F
METVVGDLMATELRLGLPGTVDDCSQHQQQTQLKVAAPPSNPTRGKKRAAAERGAEQKRAAAEEEGRQAARRVDSTPGRKVSS

SEQ ID NO: 48779 - DNA, 759 bp, Zea mays
  misc_feature: Ceres CLONE 1458401-F
  misc_feature: Encodes the peptide sequence at SEQ ID NO. 48780
ctggagctccccgcggtggcggccgctctagaactagtggatcccccgggctgcaggaattcgtctcacccctaatcgaaaacaagtgggagaggcagaggtttgggcttcagggtgggtttgtcacaaacccattagccgagccgaacatttcatctgcagggaaaacaatggttactcatgaaggcaggaagaaggataaaactttacaaaagtgaagggcgggttaggcatgatgaagacattctgttccaagcgtgaactgctcgagtttgcttattatcatggaggcggctgtagttctcttttccaccgcgacctcttttttttcctaaggaacgtacattgtcatttttggaagcttctgaaagcatggcgtgcgcgtgaactatgaatgtatgagtcactccgaagctaaactgtttgagtactatgctaagctgaggagctgcattcacatcatgtggtgaacccccaggaagccttctttatcggacagccttccttggtaccgacgcaatcaggccccccccaggccgggactacccttggtttggctttggaagaaaacaacccttgggttttgcaaaacccaatcccaaaccagaaaaacagttcctttttaaaccccaaggtgtcccccccccaaaaacatggaggcgccccttgtaaaagcgccgaaaaaaccctttaaaaaaaaaaaaaaaaaaaaaagcggggggggcccccctcccccccaaaagggggaaaaaccccccc

SEQ ID NO: 48780 - protein, 71 aa, Zea mays; identical to SEQ ID NO: 46198
  misc_feature: Ceres CLONE 1458401-F

SEQ ID NO: 48781 - DNA, 702 bp, Zea mays
  misc_feature: Ceres CLONE 1458405-F
  misc_feature (149)..(149): n is a, c, t, g, unknown, or other
  misc_feature (311)..(311): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (397)..(397): n is a, c, t, g, unknown, or other
  misc_feature (533)..(533): n is a, c, t, g, unknown, or other
  misc_feature (560)..(560): n is a, c, t, g, unknown, or other
  misc_feature (592)..(592): n is a, c, t, g, unknown, or other
  misc_feature (613)..(613): n is a, c, t, g, unknown, or other
ctcaccgcggtggcggccgctctagaactagtggaatcccccgggctgcaggaattcgtctcacccctaatcgaaaactaacccctccttcgtttgcccatcctcgtgacggctcctcgccagtcgcctcgtctctccctgccgcgtcncctccaggttcgcctccgccgggcctcccggctccggcgggcctgaaaaaagcaatatagggactgtgcaggtaagaaaggaagagggtcccggcaaatggggaaatccaaaaaaaaaaccgaacccaattttgggccccgggggcggaaacggggaccccnccctatgtgaagggaaggattttcccgcccctgaaagggagcttttttttccccccccccgagggaaagaaagggggnnnnccccnaaaaaccccccccccccgtgtggggtgtggagagaaacacccagagggccccccaggggggggggggaaggggtttctttgggggggtgggggaacaagaagggggggggtgattgttgaataaggagaaaaaaanacccaccaccccccccccccctggtanataagacacctgcggtggtgtcgatgtctccnacaaaaaaacaaaaaaacacncattacgtgggagaagctcacgacacgtctgcgggaccgaatcgaaaaagacgaccctaagccggggcgccgatgcgcgcggcgccccc

SEQ ID NO: 48782 - DNA, 770 bp, Zea mays
  misc_feature: Ceres CLONE 1458407-F
  misc_feature: Encodes the peptide sequence at SEQ ID NO. 48783
  misc_feature (544)..(544): n is a, c, t, g, unknown, or other
aaagctggagctccccgcggtggcggccgctctagaactagtggatcccccgggctgcaggaattcgtctcacccctaatcgaaaacattacatctccaggcagctcctctcgctctctgtagccgacgactattgcagggcttcttcggggaccagatcgctgccacctaggttaggggccccaaattatcctaggacccctcggcggccacgagcaccaccagcttggttcactcccaacaaaatgacagccaatgtgtatgaatcaactagagatgctcccatcctccatgcagatggggagagctttcagtgcaacatgtgcttcaacctaactcacgagccaatattgacgcactgtggccatgtctaggggtcgccgtgccttaaccgaacccaccacattcacccccactcgtttcagtagcgagtgtgcaatgccctctagtagaaggacaagcaccgccccatttatgcgccctgcaagatcgcgtccaatcaaagttgaacaacatgccctaggacaaaattcccccctgccanagggccaaaggcttgcctaaaaccgccagacccaagcaaacacagcctttgccaaggctaatgcaatccattggaacccgggcctaaggaggcccccttggaaaatagcgctatggggaaaactaaccaatttttaataatccctctgtaaagaaaatgtttcccaactcccttaacggatgccacaatcaatggggtatacctaaaagcccgcctcatttacctt

SEQ ID NO: 48783 - protein, 42 aa, Zea mays
  misc_feature: Ceres CLONE 1458407-F
MTANVYESTRDAPILHADGESFQCNMCFNLTHEPILTHCGHV

SEQ ID NO: 48784 - DNA, 748 bp, Zea mays
  misc_feature: Ceres CLONE 1458408-F
  misc_feature: Encodes the peptide sequence at SEQ ID NO. 48785
ggagctccccgcggtggcggccgctctagaactagtggatcccccgggctgcaggaattcgtctcacccctaatcgaaaaatgcacccaaatcgacaaattcttcccccctctccgatctcgacgcgcaccgatgcgggcgatgtcgtcagcggttaatggtatgctgcgggcacggctgctcggggcagcgcgcgttcgcggcggcgacggcgagggggccgggcggtggacgaccccaggtcacgatgagcgccccaaggggtacctcttcaaccggccgccgccgcctccgggggaatctcgcaagtgggacgattgggagctgccctgctacgtgacctccttcctcaccgtcgtcaacctcggcgtcggcctctgcgcaaagccccaccttacaatcgagacgcgggcgcaccgaaaggtgctcgagcgcctccagcatcatgagctcgccgctggcgactcccagtacgagtggtccgcgcgtctcaaggcctctctaactctcggatgcctctgatttggtctccataggagcgccaccatgtgccgtcctgattgttctggacttctggtatagatggacaacgacctgaccacgatgctgctgttttttccgttctgcactcaacttgcccggtgatgatggctgatcccctgaaattctgattatgtgaatggttgaacgctgtatatcatcctatcctcacgtggactatcgctgaccacataaaggattttcttgc

SEQ ID NO: 48785 - protein, 129 aa, Zea mays
  misc_feature: Ceres CLONE 1458408-F
MRAMSSAVNGMLRARLLGAARVRGGDGEGAGRWTTPGHDERPKGYLFNRPPPPPGESRKWDDWELPCYVTSFLTVVNLGVGLCAKPHLTIETRAHRKVLERLQHHELAAGDSQYEWSARLKASLTLGCL

SEQ ID NO: 48786 - DNA, 776 bp, Zea mays
  misc_feature: Ceres CLONE 1458410-F
  misc_feature (375)..(375): n is a, c, t, g, unknown, or other
  misc_feature (436)..(436): n is a, c, t, g, unknown, or other
  misc_feature (437)..(437): n is a, c, t, g, unknown, or other
ctggagctccccgcggtggcggccgctctagaactagtggatcccccgggctgcaggaattcgtctcacccctaatcgaaaaattttgtcggtaaacaacgtgtgaggatggtgcactagcgaagcccttgtacataatggcattcgggcgaatcccacgttccataatggcataattccatatttctccagctgttccgccgagcgaacgacccacaaccagaagccacccattggcgtacgcgaggcgatcggagcatcccgtcccaagaggagaaactccggccggcgacgcgggggaaaatggggaagacgccggtgcggatgaaggcggtggtgtacgcgctgtcgcccttccagcagaaggtgatgccnggggctgtggaaggacatcacccaccagatccaccacaaggtcaccgagaactggatctcnngcacgctcctcctcacccccgtcgtcggcacctaccaatacgccatgtggtaacaaagacaaggagaagcctttcccacaaatacaaaatgggatggcctccaagttgcgtgcggcttgtccccaatagaattttccatggaggggtggataaatcgggcaaggccaatttccttgcccagtttaagttcaaccattttcccctttccaaagcaataacgggaactgggcccgggaaaattttttggaggggcaaaaatagaaccctttggcccccaaaggggtaaaaaaaaaaaatttttttaaaaaaaaaaaaaaaaaaaaaacccccggggtcccc

SEQ ID NO: 48787 - DNA, 736 bp, Zea mays
  misc_feature: Ceres CLONE 1458411-F
  misc_feature: Encodes the peptide sequence at SEQ ID NO. 48788
  misc_feature (36)..(36): n is a, c, t, g, unknown, or other
  misc_feature (736)..(736): n is a, c, t, g, unknown, or other
ctcgctgatacaaaaagacccccgggctgcaggaanttgcctcacccctaatcgaaaaactcttatataagcctccgccgccgctaacattcctcttcccctcgcgcaccgctcctgagtcctgtccaccctgccaccggcgacgccgcgccgccgcagcaattgtcaccgtcgctatggcccgtatcaaggtgcacgagctccgggggaatagcaagacggacctgcaggcgcagctcaaggagctgaactcagagctctccctcctcctcgagagccaaggtcaccggcggaccacccaataagctctccaagatcaaggtggtgcgcacctcgatctctcgcgtgatgacagggatctcgcagaagcataagtcggcgttgcgggaggcctacaaaaagaagaacctgctccccctcgacctccgccctaagaagacccgtgccatccgccgccatctgaccaagcaccagctctctctgaagaccgagagggaaaagaagcgcgagaagtacttccccatgaggaagtatgctatcaaggcctaggtcagaactgtgagatgctgcgcttagcatatcatcggctgtgttttaatttttggtttgtatggacatttgctgagggccggaagtacgatgcatccctccatttccctaatggctaaatggtttgactggcaaacagaaaaaaaaaagcgagaccctcgacgtacccattcggcctaaactgagn

SEQ ID NO: 48788 - protein, 66 aa, Zea mays
  misc_feature: Ceres CLONE 1458411-F
MTGISQKHKSALREAYKKKNLLPLDLRPKKTRAIRRHLTKHQLSLKTEREKKREKYFPMRKYAIKA

SEQ ID NO: 48789 - DNA, 756 bp, Zea mays
  misc_feature: Ceres CLONE 1458417-F
  misc_feature: Encodes the peptide sequence at SEQ ID NO. 48790
  misc_feature (631)..(631): n is a, c, t, g, unknown, or other
tggagctccccgcggtggcggccgctctagaactagtggatcccccgggctgcaggaattcgtctcacccctaatcgaaaaacattcacatcgcactctcctccagcctccaggcttggcaagcgtgcttcacatgaccacatccatgtcgaacagcgccgctagcgagaagcaatcgcagcaggcaggccacaggcagcggcccccggcggcgtcggccgcggacgcggagatgcagagggtgttctgccgcatcgacgcggacggcgacggccggatctccgcctcggagctggccgcggtgacgcgcgccatctccccgccagcgagctcctcgcacgggcgccgcgaggtggccgccatgatggacgagctggacacggaccgcgacggcttcatggacctcggcgagttcagggcgttccacgcgcgcggcggcggcggcgtggacgacgacaccgagctccgcgccgccttcgacgtctacgacgtctacggcgacggccgcgtcacggcggccgagctgggcaaggtgctcgcgcgcatcggcgaaggcggatgcaccgccgaggagtgcgagcggatggtctccggcgtcgacgccgacggctgcgtcgggttcgaggacttncagaagatgatgtgcacccagcccgcagcctaagccggcgccgcccgggcggtacaaggcaaaggccgaggccgaggacaaggacgagtgacggatgtagtcagggaggaacgggaacggctgga

SEQ ID NO: 48790 - protein, 172 aa, Zea mays
  misc_feature: Ceres CLONE 1458417-F
  misc_feature (29)..(57): Pfam Name: efhand Pfam Description: EF hand
  misc_feature: SWISSPROT Homolog: EC 2.7.11.1 Non-specific serine/threonine protein kinase
  misc_feature (162)..(162): Xaa is any aa, unknown, or other
MSNSAASEKQSQQAGHRQRPPAASAADAEMQRVFCRIDADGDGRISASELAAVTRAISPPASSSHGRREVAAMMDELDTDRDGFMDLGEFRAFHARGGGGVDDDTELRAAFDVYDVYGDGRVTAAELGKVLARIGEGGCTAEECERMVSGVDADGCVGFEDXQKMMCTQPAA

SEQ ID NO: 48791 - DNA, 766 bp, Zea mays
  misc_feature: Ceres CLONE 1458419-F
  misc_feature (667)..(667): n is a, c, t, g, unknown, or other
ctggagctccccgcggtggcggccgctctagaactagtggatcccccgggctgcaggaattcgtctcacccctaatcgaaaaacaacgccgagaggcaagagttctggataagggtcctctcgaccgcaacgcccctcatctagctcaaccccgatatcgccgacccgatggggcccatggtggagaagaggccagcggaaaagatttcggcggctcgagggagaggctgagaatactaccgacagtcagatccccacgggcgatgatcggctgtcctcattcaagtccaccgggaaggaggtctgttataaaaagggaaataatattttccctaagagcgtgaagaccgtcattatctacatcttctaagtgctgaagcaggtgcacccctacgtctgtataacctcctcggcacatgtccatcgtgaactccttcgtcaacgatgactatcagaatctgctcagcgaggccgaccacctggcacgcttcatcatcaaacccactatcttgtcccggaagatctagagctccctgcgcctagtcgtcctcggatagctctgcctgtcgctgacaacgagggatccgtggccgtcacctagttcaccagctactgaacacgctgcgttatccaccaatatgtatcaaggtctcattgcagtgtgcantcgtcatgcccctagcctagcacgctagtttctagcttgcctgctctatacatccggctcgccggatcgtatgcgcctcatagatgtgatgtcactctg

SEQ ID NO: 48792 - DNA, 759 bp, Zea mays
  misc_feature: Ceres CLONE 1458421-F
  misc_feature: Encodes the peptide sequence at SEQ ID NO. 48793
aagctggagctccccgcggtggcggccgctctagaactagtggatcccccgggctgcaggaattcgtctcacccctaatcgaaaactctctttttcctattctcctccttctgcctcctcgcccggcaggccgcggccggcgggtacggaggctggcagagcgcccatgccaccttctacggcggcggcgacccctccggcaccatgggcggggcatgcgggtatggcaacctgtacagcactgggtacggcacgaacacggcggcactaagcacagcgctgttcaacgacggcccggcgtgcgggtcgtgctactagctgcactgcgacaacgccggcatctcatgccggccggggtccatcctggtgatggccaccaacttctgcgcgcccaactacggcctccccacccaccacagcggctggtgcaacccgccccgaccccacttcgacatggccgagccggccttcctccacatcgcgcagtaccgcgccggcatcgtgcccgtctcctacagaagggtgccgtgcgtgaacaagggaggcgtccggttcaccatcaacggacactcctacttcaacctggagctggtgaccaaagtggacggctccggcgacacgacgaccgtgcccttcagagcaatctcaccgtttggcaggccctgcccccaagctggaggatgacggagaaaaaaaaccccttccgggaagacaaaagcctctcccttcaggtcacctccaggagagggccgttcccta

SEQ ID NO: 48793 - protein, 104 aa, Zea mays
  misc_feature: Ceres CLONE 1458421-F
  misc_feature (1)..(49): Pfam Name: DPBB_1 Pfam Description: Rare lipoprotein A (RlpA)-like double-psi beta-barrel
MATNFCAPNYGLPTHHSGWCNPPRPHFDMAEPAFLHIAQYRAGIVPVSYRRVPCVNKGGVRFTINGHSYFNLELVTKVDGSGDTTTVPFRAISPFGRPCPQAGG

SEQ ID NO: 48794 - DNA, 740 bp, Zea mays
  misc_feature: Ceres CLONE 1458422-F
  misc_feature: Encodes the peptide sequence at SEQ ID NO. 48795
ggagctccccgcggtggcggccgctctagaactagtggatcccccgggctgcaggaattcgtctcacccctaatcgaaaagttccgactctggagcggagcggcagccaaatctcgaccacgtccggcaaccgcgccccctcggctttgcgcccacaccaagccaccctctgttctcctcttccgtggcggactagcggcgcactggtgtggtgctcctccaagctctggtctgctccgcgccccgcctccccgtcgaccggcgactttggccccggcccccgggctaggaagcgagttcaccggtggatccgcgcgtgtccctccctgttacctgcgggtcgccccagccggccacccgcgcccccgcaccctactgacttgggcttgctgtatagcacggaccacatcaagggtcgtcgtcgaccacgtttgaggcttggccatgcctttaaatatagatattgatctgttcaagctggatattgatgagctgatagctgattattccaaggagaactgtacatcactcttcgaattcaaacgagtatggatgggcaagaaattttcttatatctatgaaggcagacctaagacaaactcaggtttattcatgcagtccctctttctgcattgaattggtcatttgacttctcaaagttcactgcaccaaagattggctgggctatactgcctttactgtctgtatgagtgccagccatacaagccgcagttcaagat

SEQ ID NO: 48795 - protein, 63 aa, Zea mays
  misc_feature: Ceres CLONE 1458422-F
MPLNIDIDLFKLDIDELIADYSKENCTSLFEFKRVWMGKKFSYIYEGRPKTNSGLFMQSLFLH

SEQ ID NO: 48796 - DNA, 661 bp, Zea mays
  misc_feature: Ceres CLONE 1458426-F
  misc_feature: Encodes the peptide sequence at SEQ ID NO. 48797
  misc_feature (34)..(34): n is a, c, t, g, unknown, or other
  misc_feature (118)..(118): n is a, c, t, g, unknown, or other
  misc_feature (119)..(119): n is a, c, t, g, unknown, or other
  misc_feature (126)..(126): n is a, c, t, g, unknown, or other
  misc_feature (132)..(132): n is a, c, t, g, unknown, or other
  misc_feature (133)..(133): n is a, c, t, g, unknown, or other
  misc_feature (138)..(138): n is a, c, t, g, unknown, or other
  misc_feature (142)..(142): n is a, c, t, g, unknown, or other
  misc_feature (183)..(183): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (209)..(209): n is a, c, t, g, unknown, or other
  misc_feature (210)..(210): n is a, c, t, g, unknown, or other
  misc_feature (416)..(416): n is a, c, t, g, unknown, or other
cgattgggtaccgggttgcccctcgatcacttcngtggtaaaggagaggaaagatagtcactggtctatctatctagcgagagagagagaggaaagctagctagctagcatggagtgnnggttttngatggnntcacnaggntcatgtcgtcaccaggcgcgagatagatcattgttggtganannnctttgttaaatcttctaatatnntgtatatggtcaagggcctgataagagaggttgctgggtttgctccttatgagaagcgtatcactgagcttctgaaggttggcaaggacaagcgtgccctgaagcttgctaacaaaaagcttggaactcacaatagggcaaagaacaagagagaggacatgtccgtcttcctcaggaatatgaggtcggctggtactcacactganaaaaaaaaatagagagcatttcaagttcatggagctggctgccagagattatgttccagtgtctgattttccatacatgtagaacctaatagacatggtcaaagtattatgtatcgaaagcggttcatgggattttgctccttccagtgcatcaaggggtttatgtatcgagacaatttatgggatctttggtcttattctaatgcatccatggttttgtgaaaaaaaaaaaaagaataacccta

SEQ ID NO: 48797 - protein, 70 aa, Zea mays
  misc_feature: Ceres CLONE 1458426-F
  misc_feature (1)..(62): Pfam Name: Ribosomal_L36e Pfam Description: Ribosomal protein L36e
  misc_feature (67)..(67): Xaa is any aa, unknown, or other
MVKGLIREVAGFAPYEKRITELLKVGKDKRALKLANKKLGTHNRAKNKREDMSVFLRNMRSAGTHTXKKK

SEQ ID NO: 48798 - DNA, 662 bp, Zea mays
  misc_feature: Ceres CLONE 1458427-F
  misc_feature: Translation starting site: 120
  misc_feature (35)..(35): n is a, c, t, g, unknown, or other
  misc_feature (167)..(167): n is a, c, t, g, unknown, or other
  misc_feature (227)..(227): n is a, c, t, g, unknown, or other
  misc_feature (327)..(327): n is a, c, t, g, unknown, or other
  misc_feature (329)..(329): n is a, c, t, g, unknown, or other
  misc_feature (333)..(333): n is a, c, t, g, unknown, or other
  misc_feature (369)..(369): n is a, c, t, g, unknown, or other
  misc_feature (370)..(370): n is a, c, t, g, unknown, or other
  misc_feature (379)..(379): n is a, c, t, g, unknown, or other
  misc_feature (420)..(420): n is a, c, t, g, unknown, or other
  misc_feature (455)..(455): n is a, c, t, g, unknown, or other
  misc_feature (462)..(462): n is a, c, t, g, unknown, or other
  misc_feature (486)..(486): n is a, c, t, g, unknown, or other
  misc_feature (497)..(497): n is a, c, t, g, unknown, or other
  misc_feature (556)..(556): n is a, c, t, g, unknown, or other
  misc_feature (575)..(575): n is a, c, t, g, unknown, or other
  misc_feature (590)..(590): n is a, c, t, g, unknown, or other
cgattgggtaccgggccccccctcgagccctgcantggtaaaggaccagcggcatctatagcaaccggtccaacactttcacgctcaggcgctcagctctagcaatggctgcctccaccatggcgatctcctccacggcgatggccggtacccccatcagggtggcntccttcggcgagggccgcatcaccatgcgcaagaccgtgggcaagcccaaggtggcggcntccggcagcccctggtacggccccgaccgcgtcaagtacctcggccccttctccggcaagcccccgagctacctcaccggcaagttccccggcaactacngntggnacaccgccgggctgtccgccaaccccaaaaccttcnncaagaaccncgagctggaggtgatccactcccgctgggtcatgctcggcncgctcggttgcgtcttccccgagctgctctcccgncaacgcntcaagttcggcaaggccgtctggntcaagggcggntccaaatcttcaccaagggcgggctggactaccttggcacccccagcctgatccacgcncaaaccatcctccccatcntggcctgccaggtcntgctcatgggccccgtcaagggctaccgtattggccgcgggccccttcgcaaggtcgtcgacccgctgtacc

SEQ ID NO: 48799 - DNA, 643 bp, Zea mays
  misc_feature: Ceres CLONE 1458431-F
  misc_feature: Encodes the peptide sequence at SEQ ID NO. 48800
  misc_feature (348)..(348): n is a, c, t, g, unknown, or other
  misc_feature (500)..(500): n is a, c, t, g, unknown, or other
  misc_feature (514)..(514): n is a, c, t, g, unknown, or other
  misc_feature (523)..(523): n is a, c, t, g, unknown, or other
cgattgggtccgggccccccctcgagccctgcagtggtaaagggattacccagagacctcgagaacggctggaagaaccgagagcgctccggaaatgtcggcgggtgagctgcggttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattangatatatgtttccctttgaggagttgagcaagagaaggtggagactactttttcagccacatcagtggatataaagtttcatgatgtcaaaggcaagattaccggtgtgctataccaaagctgaacagggaatttgtcctgaaaaatgtaangtggtgtgaaaccnaccagggtngttggtactcttttcaggggtctaaagggcactgggtaaacttgcacttcaaggaagaccagttcagcccaacatggacaaggaaaaaatccgatgtcgggattatggacttaatggaga

SEQ ID NO: 48800 - protein, 90 aa, Zea mays
  misc_feature: Ceres CLONE 1458431-F
  misc_feature (85)..(85): Xaa is any aa, unknown, or other
MSAGELRLELDELRRLESLAKHPRVQILLANEIRNVEAKLAKATEPSPEPLAAASAPAPAPAARPVLSYVTLGSFSWEQDNEKIXIYVSL

SEQ ID NO: 48801 - DNA, 627 bp, Zea mays
  misc_feature: Ceres CLONE 1458433-F
  misc_feature: SWISSPROT Homolog: EC 3.4.22.14 Actinidain
  misc_feature (245)..(245): n is a, c, t, g, unknown, or other
  misc_feature (366)..(366): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
gccgtggtaaaggccggacctacacgccgtcggcgaggaggagcggcggtaccaggtgttccgggacaacctccgctacatcgacgcgcacaacgccgccgccgacgcgggcgtccactccttccgcctcggcctcaaccgcttcgccgacctcaccaacgacgagtaccgcgccacctacctcggcgccaggaccaggccgcaaagggagaggaagctcggcgccaggtaccacgccagcgacnacgaggacctggcggagtccgtcgactgggagggcaagggcgccgtcgccgaggtcaaggaccaaggcagctgcgggagctgtggggctttctccacatagcagctgtgggaggcatcaancagattggtacaggcgaactgatctccttgtctgagcaagagcttggccacggggaaccttcgtacaatcagggtggcatggggagtctgatggacattccctttgaattcctccccccccatggggggaatcccacccgggaaggttttcccctttaaaggggcgggacggacaaatttgttgtcctcccggaaaaccgtcggggnnnnnnnnnnnnnnnnnnnnnnnnnnnnnnnnnnnnnnnnnnnnnnnnnnnnnng

SEQ ID NO: 48802 - DNA, 873 bp, Zea mays
  misc_feature: Ceres CLONE 1458441-R
  misc_feature: SWISSPROT Homolog: EC 3.4.22.1 Cathepsin B
  misc_feature (818)..(818): n is a, c, t, g, unknown, or other
ccgcggtggcggccgctctagaactagtggatcccccgggctgcaggaattcccagagctctggttttttttttttttttttgcgaatcgaaattccagttcttatgacacttattccacttgactaacgagatgtggcatcgacagaaaagcgccctatggaaggagatcctgtacagaatacatacgccatcgaggacatttaacaattgcattttaaaatggactttcattaattaccaatgctctttgaggccatgcaaatgtaaccaattaaacgatggctcttccagcggacacagcccaagtttgaaaccatatactttgtgggatggcattccaggagcaacgccctccacgatgccacattcatttttgcccctgtatgatcttgaacatccataatcgccccagcctttattccactgatttgccagaagctagtaatcctctccagctgtcactggattccccatccaatcaacttgagcgggatggtcacctcataatgccaccggtgatatgcttgtccactcgagatttgtactgtgcgaaaaactcgtaaactgaaaaagcaacttctacaggaccatttttgcagacctctgccattatgtcatgtggatcggaatttattctgtacacgacactgctgaaatgcttcttttcctgacaaacgaggttctgctccttgcattacttttcaacattagtgtatgatcatcatgttaccatccgaggatgcttgcaacccacccgggtccaaagtatgaatcccactcaatcgggaactaccccatttttgaaccaagtagggnccgtgcttctataagaatagccttccatccaccccatggccgcaagataagaccc

SEQ ID NO: 48803 - DNA, 659 bp, Zea mays
  misc_feature: Ceres CLONE 1458441-F
  misc_feature: SWISSPROT Homolog: EC 3.2.1.21 Beta-glucosidase
  misc_feature (518)..(518): n is a, c, t, g, unknown, or other
cgattgggtacgggccccccctcgagccctgcagtggtaaaggactcgcgtcgggagccgtacgccgcggagcagacatcatcatgtcccacgccgccaccgtccgcgcctacgggaagacataccaagcgacgcaaggcggctccatcgggatcgtggccgtgctgaaatggcaccagccgctgactaactccacccacgacatcctggccgctcggcgcgcacacgctttcgagacggactgctttctggacctccatattcatgggcgattaccctccgagcgatgcgggagatcctgggatcagacctgccgaccttcaccgcacaggagaacgctctgctgctgcggtacgagggagacttcctcgagctgatgcactacgcggtgatctacgccagggactgcctgcactccccgtgcaacctcgggacgtagaagctgaacgccttcgtctccgctactggggaaagggacagacggcgtcatcatcggcgcagatactgctctggcaggnttcttcgacgtcccatacgtcatagagctggctatccattacgtcaacaggaggtacaagggctcgcccgatgatcttacggacagctgctactctcagtgcagtgatgccagcaaggaagagttgatctacgatgtgtgg

SEQ ID NO: 48804 - DNA, 768 bp, Zea mays
  misc_feature: Ceres CLONE 1458453-F
  misc_feature (15)..(15): n is a, c, t, g, unknown, or other
  misc_feature (21)..(21): n is a, c, t, g, unknown, or other
  misc_feature (444)..(444): n is a, c, t, g, unknown, or other
  misc_feature (456)..(456): n is a, c, t, g, unknown, or other
  misc_feature (665)..(665): n is a, c, t, g, unknown, or other
  misc_feature (682)..(682): n is a, c, t, g, unknown, or other
cgattgggtaccggncttctntcgagcactgcagtggtaaggtgtgatttttgtttcggtttgctactttgctttgctcggagaagctgatctcgcttttgaggctggaaaatcatctccggccaggataagagaaccccgacccgagcaagattttggtgggcttgtgattttttttgatagtgtttattcgttgtagcgggatccatgccgaggttcacactttcctccattgttatttctggcccataggttctcggttgtagatgcttctcactcatccctttgctcatgggtgtggctgttttctatgctcctatctttttttgtctctcatctttctagccctatcgccatcaccctacgttaagttgtggggggcggtggggggggggggggggggggtttgtattaaataaaaaaaaaaaacccccacgtgtgtcnaccccccccccnccccacttccctctcttccctagccgcccctctttttgggcggcccgtatctgattcccccactgtttggtgggcactgatattttgtatgtgtggatgtttcatctaacccctcccgctgggagcgcagggcgccggtatatgtgtagcaagaccccgtgtcgtctatatttaatttcctcccgacttgcctcggggcgtgttctttnaagagtggctttccttnattttcatctttcttttgtgttggtctttatgatgcttttctcatctccccctcaccacctattcgattgtttttgttcggtgtgg

SEQ ID NO: 48805 - DNA, 834 bp, Zea mays
  misc_feature: Ceres CLONE 1458477-F
  misc_feature: Encodes the peptide sequence at SEQ ID NO. 48806
  misc_feature (46)..(46): n is a, c, t, g, unknown, or other
  misc_feature (834)..(834): n is a, c, t, g, unknown, or other
ttttccggtttaaaagtaacctcaattaaatattctccctctacanatctccgaatgggtccgggccccccctcgagccactgcagtggtaaaggagtcctttcaagcatttcctggcccccccgggttgcccggctcgacgctcttctgtttcaagcccataatgaatgggatgacgctgagagagcttaccggcaactcctggaaatccatccatttgaccagattgctcccaagaggaaaattgctattgcaaaagccaaaggcaatatgtcgctagcaattggttatatcactaagtatctggaattatttatggcagatcatgatgcccgcagagaacttgccgaaacatatgttttctaactaatgtacaacccaagctgccttttgcctctgaggacgttattattaatccctgcctcattattcatattatgggaataaaagtgtatgaataaggtttttgttattttaacccccaggcttcgaaataaacttctccactttgcaaacaactccctcttgaatttcaccaaccccaacccgcactcgtattgctccgcccccacaagaaaccaatacttacgcggtggcaaataaccggtggcacttgctgcgtactcatacacagattaactacaattggtgacggcgaacaccattatggaacaaacagagctccggcgaactctctgacaagaaatatgttttgccccaaaaacctaattgcattcacattaataaatacaagaaaggtccgggccttccaaatcacacaaggggcgcccaccattcaaatccattcctaaccctttgctcctcatcacaaan

SEQ ID NO: 48806 - protein, 103 aa, Zea mays
  misc_feature: Ceres CLONE 1458477-F
MGPGPPSSHCSGKGVLSSISWPPRVARLDALLFQAHNEWDDAERAYRQLLEIHPFDQIAPKRKIAIAKAKGNMSLAIGYITKYLELFMADHDARRELAETYVF

SEQ ID NO: 48807 - DNA, 505 bp, Zea mays
  misc_feature: Ceres CLONE 1458486-F
  misc_feature: Encodes the peptide sequence at SEQ ID NO. 48808
  misc_feature (258)..(258): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (444)..(444): n is a, c, t, g, unknown, or other
gcggtggcggccgctctagaactagtggatcccccgggctgcaggaattcgcacgagaccattacctagaacatcctaatcgaaaaacctgaagaacggagttcccaaaggaaagccccacaaaacctcggttgctccccttggcccttgccatcctcgttcctatcgccagttcgccacctcctttgctctcgcctcgcgcgcgctcccccccgcgcatcgtgccgttcgccaccgcaccgcgccgatggaggtcgncccgccgtgcccccagatcccgccgcggccctgccgggggggggctcctggctccccggccgtccgaaacccttgcgtggcaccttggcccctgcccccgggcgcgggtttctccccaaataannnnnntttgggggggggggaacccgggggggcccgcgccccccccccccccctttaataaangtttttgaaaaaagggagaaacaaccccgggagaaaaaaacaccgcccccccgccaaaaaa

SEQ ID NO: 48808 - protein, 63 aa, Zea mays
  misc_feature: Ceres CLONE 1458486-F
  misc_feature (4)..(4): Xaa is any aa, unknown, or other
  misc_feature (45)..(45): Xaa is any aa, unknown, or other
  misc_feature (46)..(46): Xaa is any aa, unknown, or other
  misc_feature (47)..(47): Xaa is any aa, unknown, or other
MEVXPPCPQIPPRPCRGGAPGSPAVRNPCVAPWPLPPGAGFSPNXXXLGGGEPGGARAPPPPL

SEQ ID NO: 48809 - DNA, 697 bp, Zea mays
  misc_feature: Ceres CLONE 1458487-F
  misc_feature: Encodes the peptide sequence at SEQ ID NO. 48810
  misc_feature (697)..(697): n is a, c, t, g, unknown, or other
acccgcggtggcggccgctctagaactagtggatcccccgggctgcaggaattcgcacgagaccattacctagaacatcctaaccgaaaaatcggccatcgcagtttcacagacagcatccattccacagtcaccagagcactagagcagagcaacaactgacaagagcagagcgagatcgtcgtcagcgagctcagcagagagccagatacgagagagaggatggcggacatcgcgttgctggtggcggagcagttcgagaagacggcaaggcgaggcgcccccggcggggacagcggcagcggcagcgggaccggcggcgagacgaggaacttcggggccgtggccaaggtgtggagctcgtgggtggagtccgcctccgccgccgcgtccggggtcagattcaccgtcgcggtgcagctggagcccaagaccgggctcgcgctggccgccgccgacggcctcttctccgcctagcttcctgcctgcatgcttccatgtcttcctcctgagcagtgccagtggtcgagcgggtcctgctcctgcaccccgtactatgcttgcgcgacctgtacatttcgttcgtcgatgcgcctgcgctctaatccggaacaaagtactattcatatttgctccagtctccattcatggatatgcatatgtctgctaaaaaaaaaaaaaaaagcttatcgatacn

SEQ ID NO: 48810 - protein, 84 aa, Zea mays
  misc_feature: Ceres CLONE 1458487-F
MADIALLVAEQFEKTARRGAPGGDSGSGSGTGGETRNFGAVAKVWSSWVESASAAASGVRFTVAVQLEPKTGLALAAADGLFSA

SEQ ID NO: 48811 - DNA, 686 bp, Zea mays
  misc_feature: Ceres CLONE 1458495-F
  misc_feature: Encodes the peptide sequence at SEQ ID NO. 48812
  misc_feature (100)..(100): n is a, c, t, g, unknown, or other
  misc_feature (156)..(156): n is a, c, t, g, unknown, or other
  misc_feature (227)..(227): n is a, c, t, g, unknown, or other
  misc_feature (284)..(284): n is a, c, t, g, unknown, or other
  misc_feature (611)..(611): n is a, c, t, g, unknown, or other
cgattgggtaccgggccccccctcgagccctgcagtggtaaaggaagtgagaacagccattgagcagcaggtagcgcgtcaagcgagcagagcagcgaanagcatggatgccgaagccgccgccgccgagggccaggtgcggcactggaccgcggnacgtcacggcatttccctccacgtcgccgagcgcgggcgcgccgacgcgcccgcggtcctccctcatcacngcttcccggagctctggctctcgtggcgccaccagatggccgcgctcgccgcccgcngctttcgcggcgctgggtcccgacctcgggggttacggggattcctttgtgccccccgaccccggcgcctaatccttccttcccctcttttgggaattggggcccgcttcctttgcccccctccaatttaaaaaggggtttccggggttgggccccaacttgggcccccatttggggttttgacccctctcccttttttcccgcggaaaagggggggccccccccttttccccggggaatacccctattttccccccgggggctctctccccaaaaggaaaattttttttttccaaccttcggggggaaggtttttcctcaaaaaanccccccccgaagcccccaaaaaaaccccgaggggggttttttttccccccccaaagtggggggccgccccccctc

SEQ ID NO: 48812 - protein, 103 aa, Zea mays
  misc_feature: Ceres CLONE 1458495-F
  misc_feature: SWISSPROT Homolog: EC 3.3.2.10 Soluble epoxide hydrolase
  misc_feature (18)..(18): Xaa is any aa, unknown, or other
  misc_feature (42)..(42): Xaa is any aa, unknown, or other
  misc_feature (61)..(61): Xaa is any aa, unknown, or other
MDAEAAAAEGQVRHWTAXRHGISLHVAERGRADAPAVLPHHXFPELWLSWRHQMAALAARXFRGAGSRPRGLRGFLCAPRPRRLILPSPLLGIGARFLCPPPI

SEQ ID NO: 48813 - DNA, 670 bp, Zea mays
  misc_feature: Ceres CLONE 1458496-F
  misc_feature: Encodes the peptide sequence at SEQ ID NO. 48814
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
tcatttcttctctcctccttactttctttatggtgtttttnnnnnnnttttttaaagctggagctccccgcggtggcggccgctctagaactagtggatcccccgggctgcaggaattcgcacgagaccattacctagaacatcctaatcgaaaaagaaaaccctaagccgctacgcccttggccccttctctctcttcgtcgcgccgccgtagcacgactccgactcggccatggcgacacccccagctctctattcccttcgccctcttcggatcttctccgccgtcatccgcgaggtagaggggtggtcctcttcaacgtctgcgacgctacgtgcggcgaccggacaggcagaccgtgtcatcggcaccctctttggatccctcctccccgatggcaccgtcgacgtccgcaactccctacgtgggcccccacagcgaagtcggccgaaccaggtcgcaatcgacttccactaccaccctaacatggtacggccccccaccagaaagtgaaacccaaaggaaatcatcccccggatgggttctcaactgggatttggtggtttccggggggaaaataccccttatccccgggggtttcttttccaggggaagggaaaaagtcccccctttctctttttaaggtccgaagcccgggggcccccgaag

SEQ ID NO: 48814 - protein, 93 aa, Zea mays
  misc_feature: Ceres CLONE 1458496-F
MATPPALYSLRPLRIFSAVIREVEGWSSSTSATLRAATGQADRVIGTLFGSLLPDGTVDVRNSLRGPPQRSRPNQVAIDFHYHPNMVRPPTRK

SEQ ID NO: 48815 - DNA, 694 bp, Zea mays
  misc_feature: Ceres CLONE 1458499-F
  misc_feature: Translation starting site: 512
  misc_feature: SWISSPROT Homolog: EC 1.1.1.100 3-oxoacyl-[acyl-carrier-protein] reductase
ccccgcggtggcggccgctctagaactagtggatcccccgggctgcaggaattcgcacgagaccattacctagaacatcctaatcgaaaaacacgcactggaatcatcgtgcggcgcaccgagcgagaggagtggagaggatgacggcgcccaggcctggtgggggagcggcggccgcgtcgagggcggcggcggcggggcccacgacggtgctcatcacgggggtcagcagggggctgggccaggccctggactctcgagatcgcgcgtcgcgggcactcagtggtcggctgcggtcgctccgccgagcacctccgctcccttgaagaatagatcacgtcgccatcgcgccacttcttcaccgtcgccgacgttaggtctgacagcatctgtggcccacctggcccagactgttgtagacaagaagccagttccagatattatattaaacaacgctggtgcgataaactagaataacaagacgtggaatgttccagcggaagattttgatatggtggtcgatacatctatcaagggaacagcaaatgtgcttcgcctttttgtaccacttatgatagagaatagacgtgggattataatccatctatcctctggttggggaagatctgctgctgcagaggttgctccatattgtgcttcggagtgggcgattgacggcttgactcgctcgtta

SEQ ID NO: 48816 - DNA, 644 bp, Zea mays
  misc_feature: Ceres CLONE 1458505-F
  misc_feature: Encodes the peptide sequence at SEQ ID NO. 48817
caattgggtaccgggccccccctcgagccactgcagtggtaaagagagaattaagccaacggaaaaaaaaagaagagagctactacagcaatggccggaggagatgacctgaagctgctgggcctgtgggcgagcccgtacgtgctgcgggtgaagctcgcgctcagcctcaagggcctgagctacgagaacgtggaggaggatctgagggacaagagcgagctcctgctcaagtccaaccccgtgcaccagaaggtccccgtgctgatccacggcggcaagcccatctgcgagtcgcaggtcatcctgcagtacatcgacgaggccttcgccggcaccggcccgtccctcctccccgccgacccctacgagcgcgccgtcgctcgcttctgggccgcctacatcgacgacaagatgctgcccgcctggaaccagtcgacgatgggcaagacggaggaggagagggccgaggggaagaagcagtcggtcgtgacggtggagacgctggagggcgcgctgagggactgcggcggccaagggaagcccttcttcggtggggacagcgtcgggtacgtcgacgtcgtgctcggcggcctgctcgggtgggtgcgcgcgtcggaagagctgcacggcgtcaggccctt

SEQ ID NO: 48817 - protein, 184 aa, Zea mays
  misc_feature: Ceres CLONE 1458505-F
  misc_feature (5)..(78): Pfam Name: GST_N Pfam Description: Glutathione S-transferase, N-terminal domain
  misc_feature: SWISSPROT Homolog: EC 4.4.1.5 Lactoylglutathione lyase
MAGGDDLKLLGLWASPYVLRVKLALSLKGLSYENVEEDLRDKSELLLKSNPVHQKVPVLIHGGKPICESQVILQYIDEAFAGTGPSLLPADPYERAVARFWAAYIDDKMLPAWNQSTMGKTEEERAEGKKQSVVTVETLEGALRDCGGQGKPFFGGDSVGYVDVVLGGLLGWVRASEELHGVRP

SEQ ID NO: 48818 - DNA, 660 bp, Zea mays
  misc_feature: Ceres CLONE 1458510-F
  misc_feature: Encodes the peptide sequence at SEQ ID NO. 48819
  misc_feature (201)..(201): n is a, c, t, g, unknown, or other
acccgcggtggcggccgctcttcaactagtggatcccccgggctgcagtttttcgcacgagaccattacctaaaacatcctaatcgaaaaaagggataccagggtggaacggctcaaatcttggagaagcgtacgggttccccatggggtcccagggatcctcgggtccagttgctcctgccacaaggtttatgctgctanaagaactagaacgtggtgagaagggcattggtgatagaactgtgatctatgggatggaccatccttatgacatatttatgcggccctggacaggcactatctttggtcctcccagcactgttcactagggacgaatctatcagttaaggctgatttgtgagacagattatcccgattacccaccgactggcccattccagagtcggatcaatatgacgtgcgggaaccaccaaactggattgcttgaaccaggtccatttcctatgcttggaaagggggaaagggaacattcgatggacgacattctgatcagcttatctagggagatgtcaactccacagaatcgcaggctgtaccaacctcgtggaggcaatgaagacccatagattcagcagaaaggggtgtctcttacatgtgtcatcacgtaatccacgggcgttgccaggttccgcattatcc

SEQ ID NO: 48819 - protein, 61 aa, Zea mays
  misc_feature: Ceres CLONE 1458510-F
  misc_feature (20)..(20): Xaa is any aa, unknown, or other
MGSQGSSGPVAPATRFMLLXELERGEKGIGDRTVIYGMDHPYDIFMRPWTGTIFGPPSTVH

SEQ ID NO: 48820 - DNA, 707 bp, Zea mays
  misc_feature: Ceres CLONE 1458524-F
  misc_feature: Encodes the peptide sequence at SEQ ID NO. 48821
tccccgcggtggcggccgctctagatctagtggatcccccgggctgcaggaattcgcacgagaccattacctagaacatcctaatcgaaaaattctcatcacactcgatcgcagtttgcagaaagctagaagacacaagaacatggcgtccaagcgactcctcgtgctagtagctctcctgctcgccgccgttttccttgccgtctcaggagcagctaacgacgaccaagcccaaccgaggaaggacgacggcggcgagaacaaagccgacgtgcaggactaccgtggcggcggcggcggctggcgcggtgggggtggctaccccggccgtggctacccgggcgggggcggctaccctggcggcggccgcggcggttactgcaggtgggggtgctgcaaccgcgggtactatggcggctgccggtgctgctcgcgcgccgacgaggtcccggagcccatgtaccgcccggagcccaccgaggtccacaactgaagccgagccacacatcgatctacaaagatgcatggacgacgactcttatcttagctaattaataagcactacatccatgcatgtccacaatagggccctagccctactatactatacgtcgtcagcagaaagtctggtttttgatttcaataataagatgcacctatatgtgtgtgttacatgtaaaaaaaaaaaaaaaaagcttatcgatacc

SEQ ID NO: 48821 - protein, 116 aa, Zea mays; identical to SEQ ID NO: 40624
  misc_feature: Ceres CLONE 1458524-F
  misc_feature (1)..(93): Pfam Name: GRP Pfam Description: Glycine rich protein family

SEQ ID NO: 48822 - DNA, 666 bp, Zea mays
  misc_feature: Ceres CLONE 1458530-F
  misc_feature: Translation starting site: 138
  misc_feature (619)..(619): n is a, c, t, g, unknown, or other
cgattgggtccgggccccccctcgagccctgcagtggtaaagggcgcactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatctccgtcctcgtctactgcaccgccggcatctcggggggccacatcaaccccgccgtcaccttcgggcttcttcctggcgcgcaaggtctccctggtgcgcgcgctgctctacatcggggcgcagtgcctcggcgccatctgcggcgtcggcctcctcagggggtcccgagcgcctacttcaacggtacggcggnggggccaattcggtcgggctcgggtagtccggcgggacgggcctcgg

SEQ ID NO: 48823 - DNA, 635 bp, Zea mays
  misc_feature: Ceres CLONE 1458531-F
  misc_feature: Encodes the peptide sequence at SEQ ID NO. 48824
  misc_feature (394)..(394): n is a, c, t, g, unknown, or other
  misc_feature (619)..(619): n is a, c, t, g, unknown, or other
tcgagcactgcagtggtaaaggaagctatcgagagagaggcaggctaggctaggaagacgcagccaatggcggggcttcacttcgtgctcgtgccgctactggcgcagggccacataatcccgatggtggacctggcgcgcctcctcgccggccgcggcgcgcgcgtcagcgtggtcaccacgcccgtcaacgccgcgcgcaacggggccgtcgtcgagagcgcgcggcgagcggggctcgacgtcgagctggcggaggtcgcgttccccggcccggggctcgggctgccagaggggatggagaacgtcgacatggtggcggaaaaggagcacttcatgcccttcttccaggccacgtggaagatggacgcgccgctggatgagtacctgcggncgctgccgcggcgcccggactgcgtcatcgccgactcgtgcaacccgtgggcggcgcgggtgtgcgcccgccacggcatcccgcgcctggtgctgcactgcccgtcccgctacttcctcctcgccacgcactgcctggtcacgcacggcgtgtacggccgcgtggcccacgagctggagccgtttcgagtgccgggcttcccggtgcgccgcgcccggaacgtgnccaacgttcgcggctt

SEQ ID NO: 48824 - protein, 189 aa, Zea mays
  misc_feature: Ceres CLONE 1458531-F
  misc_feature: SWISSPROT Homolog: EC 2.4.1.238 Anthocyanin 3'-O-beta-glucosyltransferase
  misc_feature (110)..(110): Xaa is any aa, unknown, or other
  misc_feature (185)..(185): Xaa is any aa, unknown, or other
MAGLHFVLVPLLAQGHIIPMVDLARLLAGRGARVSVVTTPVNAARNGAVVESARRAGLDVELAEVAFPGPGLGLPEGMENVDMVAEKEHFMPFFQATWKMDAPLDEYLRXLPRRPDCVIADSCNPWAARVCARHGIPRLVLHCPSRYFLLATHCLVTHGVYGRVAHELEPFRVPGFPVRRARNVXNVRG

SEQ ID NO: 48825 - DNA, 697 bp, Zea mays
  misc_feature: Ceres CLONE 1458538-F
tccccgcggtggcggccgctctagaactagtggatcccccgggctgcaggaattcgcacgagaccattacctagaacatcctaatcgaaaactactaaacaaacgaccgtgtggaaccggctggggaaaactatttcgtggcggctagggtttaacaaatgccaaccacgctgctttgctagaccgccgccgatatctacggtcggattaggttcggtgccctcttcgcctctgtctcccgaggtctccctgcggcggcggtcaccgtagtggactccggccacccccacgacaaccggcaaaagggtacgggagtgtgaactatgccgtgcaaagacctgcgcttcactgcctttgcccacacctcaggctagaaaatggttcctgattccgtcaataaccaagaattcctatgaagctacactcattcatttcacaattgctcatacgactgttctgctcctctttagaattgttctacgcatctctatgtatgctccaagcactatctctttaatctacgacaagaatttcatagcagctttgactactattgaagttgatctttttactagtgtggtctgcttagcagtaggtagcactacaactagcaatgtatggatgaattaaaggaagtgaagaaggcagacaatcttacataaactctacatcttaaaactgccatgattggcaaaga

SEQ ID NO: 48826 - DNA, 643 bp, Zea mays
  misc_feature: Ceres CLONE 1458539-F
tcgagccctgcagtggtaaaggaagaataaattagaaaagaaaaacgaaaagaaaactcccgagcaaaaaaaagcacacgcgttgcgcaaaaggggaaacaggggatctccacctctgccgccgacccgtgggaagagaggagcgtgcgacggcacgcagacgcatctagtctcccgccgcctctactgtcctcgccatcgccagcaccccaaggctcggtacgattcggctgcgtgcccgcgcgtcggcactgcaccgcggcgcgcaggcggaccgtgctggggttttggtggggtgtagggaggggcgtcctgcgctctgcggcggcttgatcctgtgaaggcggcggcagcagcagcaggcttctccgatgcagcggctagtgggggtgtgcccacagtgcggtgcggctcgatttctccttgttcccttgcgtgcgcgggttcccctgccctgtctcggttgcccgaggggaaagtgaatcgtctgccttttccgattttggtaggaacggcttggggtattcccttacgcccccgttgttttgttggaatggaatcctttccaaatatttttactttacaaaaacctcttttggttcaataatttaattttctggaaaggatttggactggtacccta

SEQ ID NO: 48827 - DNA, 656 bp, Zea mays
  misc_feature: Ceres CLONE 1458544-F
  misc_feature: Encodes the peptide sequence at SEQ ID NO. 48828
ggagctccccgcggtggcggccgctctagaactagtggatcccccgggctgcaggaattcgcacgagaccattacctagaacatcctaatcgaaaagactgtgagcttcgttcgttcagttcatccgtgttcttgtttgcgaggtccagagagagaggatgtcatgctgcggaagcaactgtgggtgcggctccggctgcaagtgcggcaacggctgcggagggtgcaacaagatgtacccggacatggctgagcaggtgaccaccaccacccaggctctcatcatgggtgtcgcaccatccaaggggcacgcctagggcgggttcgaggcggccgccggagctgagaacggcggttgcaattgcggcggctactgccagtgcgacccctgcaactgcggcaagtgagctaggtgctccaccctgcatgccggccggaggaagctagctaattattataagctaaataaagtataccggcgtcgctgtgtgtgtttctagtcagtcagtcagttacttgcgtgccgtggctggcatgctctgagtctgacatgatgatgatgcctgatgacgacatcgtgtcctgtagtcctcccctgccccctcgggcgcttctggcggcaagcagggtgttgtgttgtcgctgtgtggatgcac

SEQ ID NO: 48828 - protein, 52 aa, Zea mays
  misc_feature: Ceres CLONE 1458544-F
  misc_feature (1)..(50): Pfam Name: Metallothio_2 Pfam Description: Metallothionein
MSCCGSNCGCGSGCKCGNGCGGCNKMYPDMAEQVTTTTQALIMGVAPSKGHA

SEQ ID NO: 48829 - DNA, 670 bp, Zea mays
  misc_feature: Ceres CLONE 1458547-F
  misc_feature: Encodes the peptide sequence at SEQ ID NO. 48830
ggagctccccgcggtggcggccgctctagaactagtggatcccccgggctgcaggaattcgcacgagaccattacctagaacatcctaatcgaaaaattccccggactattctcagccattttccctgaatctagccagggaactcacccacgcccgcatcgcgtggaattccacgcgaaggcgaggggagggcaacgcatgcggctagcgaggcgatggctgcacgacacgctgacgttgacgcctgtgaccatcgatcatccattgttcatctccatccccttcggtggccgattttctctccggtttaccactctagtttcgctgatgatgatgggatcacaaaagcttgcagctgtcctttgcttccactgaaaactcatatcaagggcccggcaccagcctctgaccctgataaagcggatattgttgatgaagccataactttctttcgagccaatgttttcttcaaaaatttccatgtgaaaagctcagcagacaagttattgatctatctgacgttttatatcaatattgccttaaaaagactagaaggttgccggacactagctgttgggactaaagcaatcattaatctgggattggagaaaagtcctgtacctgggggacccaggtttcctttccctggacttttcactctttcccagt

SEQ ID NO: 48830 - protein, 151 aa, Zea mays
  misc_feature: Ceres CLONE 1458547-F
  misc_feature (30)..(151): Pfam Name: P21-Arc Pfam Description: P21-ARC (ARP2/3 complex 21 kDa subunit)
MAARHADVDACDHRSSIVHLHPLRWPIFSPVYHSSFADDDGITKACSCPLLPLKTHIKGPAPASDPDKADIVDEAITFFRANVFFKNFHVKSSADKLLIYLTFYINIALKRLEGCRTLAVGTKAIINLGLEKSPVPGGPRFPFPGLFTLSQ

SEQ ID NO: 48831 - DNA, 1014 bp, Zea mays
  misc_feature: Ceres CLONE 1458549
  misc_feature: Encodes the peptide sequence at SEQ ID NO. 48832
gcgtgattgcgtggaagtctcttctggatccaaactaataaacaccacgcgagtacgccgcgtgcgacctcgaggctcgagcttgacgcccgcgtgccatggctcccacggcgccgacgcagcggccgacgatgcgccactcctccgcgttcctcctcccttcaaccgcaccgtcatcgcccgcgcctggtcccgatgacgccgccgtcgcgctcgtcgtcctcaaccagccgctgccccgcttcgcgcccctcctctggtccagagcggcggtgcgggtgtgcgcggacggtggcgccaaccgcgtcttcgacggcatgccggccctgctccccggccaggaccccgacgaggttcgcgcgagttacaagccagatgtaatcaaaggggatatggactcagtaagaccagaagtgaaggagcattattccaacttgggcaccagaattgttgacgagtcacatgaccaggacacgaccgatttacacaaatgcatagcttttatagctgagaattattctgccactaacaaatctaacctcagcatcttggtccttggagcacttgggggaaggtttgatcacgagatgggaaacatcaatgtgcttcatctcttcccaagcatcaatatcgtcctcctatcagatgattgtctgatctttctgctctcgaaaatgcatacccacgagattcacgttgaaaagtcgatcgagggaccccactgtggattgatcccgattggcatgccgtcgactagcaccacgaccaccgggcttcgatggaatctagataataccagtatgagcttcggaggattgatcagcacgtcaaatatcgtggaagaggacaaggtaacggtcacctcggattcagaccttatctggacaacatcgctccggaagtgacactggagtatagagtaccattatactgttgtaatattagagaaataagtgacatgctttcaatatatatatatatatatatatatatattaaataaaaaaaaaaaaaa

SEQ ID NO: 48832 - protein, 268 aa, Zea mays
  misc_feature: Ceres CLONE 1458549
  misc_feature (43)..(183): Pfam Name: TPK_catalytic Pfam Description: Thiamin pyrophosphokinase, catalytic domain
  misc_feature (194)..(262): Pfam Name: TPK_B1_binding Pfam Description: Thiamin pyrophosphokinase, vitamin B1 binding domain
  misc_feature: SWISSPROT Homolog: EC 2.7.6.2 Thiamine diphosphokinase
MAPTAPTQRPTMRHSSAFLLPSTAPSSPAPGPDDAAVALVVLNQPLPRFAPLLWSRAAVRVCADGGANRVFDGMPALLPGQDPDEVRASYKPDVIKGDMDSVRPEVKEHYSNLGTRIVDESHDQDTTDLHKCIAFIAENYSATNKSNLSILVLGALGGRFDHEMGNINVLHLFPSINIVLLSDDCLIFLLSKMHTHEIHVEKSIEGPHCGLIPIGMPSTSTTTTGLRWNLDNTSMSFGGLISTSNIVEEDKVTVTSDSDLIWTTSLRK

SEQ ID NO: 48833 - DNA, 693 bp, Zea mays
  misc_feature: Ceres CLONE 1458556-F
  misc_feature (693)..(693): n is a, c, t, g, unknown, or other
acccgcggtggcggccgctctagaactagtggatcccccgggctgcaggaattcgcacgagaccattacctagaacatcctaatcgaaaaattataaaccttcgccaagattctctctctatacctcttcctttctctctccgtcggcgatgcaaaggctttccatagacgcatcagcttcgaagctccagagctacgatatcaatgactccaatcggaaagaatcactctcctctcctcctccttcttcgtcatcgtccgctccagattacgacgatcacgacctcaaggacgttaagctcagacggctatcgtcgctgcaatcgcctcatcagaaacgcgagaacctcgtccacttcatccccgtcctcactctaatctgcttcgtcatcctctacctctcttctcacgctccgtcgcaatcagatttggctcagtttaacggattcatgcgttcatcaaagcgtctagaatccgacgaagatggcgaaatctctgggctgatgatcggtaccgacgcttcggctatccggagtagcataaggaagttgagagagacggaatcgcttccccgccgccgaacctctcaccggaaaacagctgacttctagctttttttcactcacatcgtcttcttgtggttttgttcattgaaactcaaaaaatcgcgattctcgtttctgttataactan

SEQ ID NO: 48834 - DNA, 664 bp, Zea mays
  misc_feature: Ceres CLONE 1458558-F
  misc_feature: Encodes the peptide sequence at SEQ ID NO. 48835
cgattgggtccgggccccccctcgagccctgcagtggtaaaggatcgtcctccgctccagcagctgccaccagacatcagagagcggtcctccttgtgagtctgagctgaggaggaggaggaggagaagcagcagcgcagcgggaggaggagggagagcggagatgcgccgcgtcgcgctgttgctcgtcgccgccgtgtgcgcgctggcgccggctgccgcggtcgtcactgacggtcttctcccgaacggcaacttcgaggatggcccgcccaagtcggcgctggtgaacggcacggtggtgtcgggcgcgaacgccatcccgcggtgggagacgtcgggcttcgtggagtacatcgagtcggggcacaagcagggggacatgctgctggtggtgccgcagggcgcgcacgcggtgcgtcttggcaacggagcgtccttctggcagcgcctggccgtggggcgcggcgcctactacgccgtcacgtttcgcgcggcgcgaacgtgcgccccagcggaacggctgaccgtgtccgtgaaccccgagtgggggcgggttcccgatgcagaccatcttcgggaggcacgggttgggactccctccccttgggcctttcagggggaaaaagggccccggggaaccttggtcttcccccaacccggg

SEQ ID NO: 48835 - protein, 167 aa, Zea mays
  misc_feature: Ceres CLONE 1458558-F
  misc_feature (42)..(167): Pfam Name: DUF642 Pfam Description: Protein of unknown function, DUF642
MRRVALLLVAAVCALAPAAAVVTDGLLPNGNFEDGPPKSALVNGTVVSGANAIPRWETSGFVEYIESGHKQGDMLLVVPQGAHAVRLGNGASFWQRLAVGRGAYYAVTFRAARTCAPAERLTVSVNPEWGRVPDADHLREARVGTPSPWAFQGEKGPRGTLVFPQPG

SEQ ID NO: 48836 - DNA, 660 bp, Zea mays
  misc_feature: Ceres CLONE 1458559-F
  misc_feature: Encodes the peptide sequence at SEQ ID NO. 48837
  misc_feature (303)..(303): n is a, c, t, g, unknown, or other
  misc_feature (327)..(327): n is a, c, t, g, unknown, or other
  misc_feature (333)..(333): n is a, c, t, g, unknown, or other
  misc_feature (335)..(335): n is a, c, t, g, unknown, or other
  misc_feature (360)..(360): n is a, c, t, g, unknown, or other
cgattgggtaccgggccccccctcgagccctgcagtggtaaaggttccaacgagccttccctcccaaacttgcacgctgcccccgctctcgcctccgcccccgatccagatccagggtggaatagggaacggccatacaccatggcggatttctccaaggaatcttgcccttctgtgaagaacattttacttctggattctgaaggaaagcgtgttgctgtaaagtatttctcagatgattggccgactaatgcatcaaagttagcctacgaaaagtctgttttttactaaactctaaagacnaatgcacggacagaagctgaaatnacattngnttgatggttatatttgtcggttacnagtgttgtacatgaacttcactttttttgtccaccgctggagatgatgaaaaatgaactcatcctaaacaggggactacatgggtttttccgaatctgtttggcctccactcccggggtgaatgtgtagaaacggactgcgcttgagaaacttggatattaaaaccttccttcatcccaaaaaatgtggaaaggggggatcctcccggaaaccgaagccaacaccctttggcgggaaggttgcaaccaagccggtgaaggggtccgtgccccttttttgagacaaaaaatctcccgggcc

SEQ ID NO: 48837 - protein, 49 aa, Zea mays
  misc_feature: Ceres CLONE 1458559-F
MADFSKESCPSVKNILLLDSEGKRVAVKYFSDDWPTNASKLAYEKSVFY

SEQ ID NO: 48838 - DNA, 704 bp, Zea mays
  misc_feature: Ceres CLONE 1458570-F
  misc_feature: Encodes the peptide sequence at SEQ ID NO. 48839
aaagctggagctccccgcggtggcggccgctctagaactagtggatcccccgggctgcaggaattcgcacgagaccattacctagaacatcctaatcgaaaaatcaaaaaagaagacgtaattgcgcaaaagcctttttccgagatcggcgaaacaaatcgctgtaaaacccagcctgctaatcgccccactaggaggagtaggaggactctccgaggtccgagcggggtaggcaggtgtccgaaacggatcaccaaaccccgccggcgcagccgagagatccgacgtcgccgcgatccatggccgcctcgacggcggcggcgcggcgtctcctcctcgccctcgccgtcctcgccgcctgcctcggctcggcgccgcacggggccgtcgcgctccgctcgctcggcgtcgggggcgccaaggcggccgacggggacgcggccgtggacctcgacgcgtccaacttcaccgccttcctccagacttcgccggagtcgttcgcggtcgtcgagttcttcgcccactgggcgaccctccgcctctaacttcgttcattagtttttttacccttttggttcccgttgattcgatgcggccggcctcgttccaaatctctcggcgcgttagtctccgagtcgcggaagttgagatcgtacgatatgtgggaattgagatatttgaatctgtgactcgaaatccaagtg

SEQ ID NO: 48839 - protein, 81 aa, Zea mays
  misc_feature: Ceres CLONE 1458570-F
MAASTAAARRLLLALAVLAACLGSAPHGAVALRSLGVGGAKAADGDAAVDLDASNFTAFLQTSPESFAVVEFFAHWATLRL

SEQ ID NO: 48840 - DNA, 682 bp, Zea mays
  misc_feature: Ceres CLONE 1458575-F
  misc_feature: Encodes the peptide sequence at SEQ ID NO. 48841
aagctggagctccccgcggtggcggccgctctagaactagtggatcccccgggctgcaggaattcgcacgagaccattacctagaacatcctaatcgaaaaactcatctatttcttttgaatcattgtatactagctagctagctagccagagcttgtatggccactgctcatcatgcggatgaccatcgtgcagggagaagaagcgaggccgtcggagagaactacatgaggggcctctacggcgacgatgactacaacgccacccactacggtcaccagcagcagcagcggccgccgcccgcgcccatggcggtggccaaggcgttagccacagccacggcagccttctccatgttgttgttgtcggggctggcggtgacgggcacggtgctggcgctcatcgtggcgacgccattgatggtgatcttcagccccgtgctggtgccggcgggccatcacggtggcgctgctcacgggaggcatccgttcctccggaaggttcggcctggctgcggtggctgggcctggcgggggtgtaccgctacctttcaaccacgaccttcctcgtcggggtcaccacccccacatcctcaaggaatggggcccacaaccccctccgggagcaaaccccccccgccctgaaaaaaaaaaaaaagcgtagtcccccctcccttttctta

SEQ ID NO: 48841 - protein, 161 aa, Zea mays
  misc_feature: Ceres CLONE 1458575-F
  misc_feature (49)..(158): Pfam Name: Oleosin Pfam Description: Oleosin
MATAHHADDHRAGRRSEAVGENYMRGLYGDDDYNATHYGHQQQQRPPPAPMAVAKALATATAAFSMLLLSGLAVTGTVLALIVATPLMVIFSPVLVPAGHHGGAAHGRHPFLRKVRPGCGGWAWRGCTATFQPRPSSSGSPPPHPQGMGPTTPSGSKPPPP

SEQ ID NO: 48842 - DNA, 686 bp, Zea mays
  misc_feature: Ceres CLONE 1458582-F
  misc_feature: Translation starting site: 172
  misc_feature: SWISSPROT Homolog: EC 2.7.11.7 [Myosin heavy-chain] kinase
ggagctccccgcggtggcggccgctctagaactagtggatcccccgggctgcaggaattcgcacgagaccattacctagaacatcctaatcgaaaagagccacaccgtcaccacaccaccgtctcgcggagaaactcctccaaaacccccaaaccctttcaatcggcggcaatggcggcgccggcggccgacgatgcctcggcatccccaggctacgtcctccgctccacacttgaggggcaccgccgcgccgtatcaaccgttaagttctccccggatggccgccttctcgcctccgcctccgccgacaagcttcttcgcgtgtggtcttcctccgatctcacccccgttgcggagctcgagggccatggagagggtgtctcaaacctctctttctcccccgacggccgcctccttgcctccgcctccgatgatcgcaccgtccgcatctgggacctcgccgtcggcggaggggcccgcctcgtcaagacgctcacgggccacaccaactacgccttctgcgtctccttcaaccccccatggcaacgtcctcgcctccgggtcctttgacgagacggtgcgcgtgtgggaggtcaggtccggtaagtgcctccgcgtgctgccggcccattctgagcccgtcaccgccgtggacttcgatcgcgagggcgacttgattgtgtcag

SEQ ID NO: 48843 - DNA, 853 bp, Zea mays
  misc_feature: Ceres CLONE 1458583-R
taacgggccccccctcgaggtcgacggtatcgatacatccataataccatgaatacaaattctttcatagaaagggggggaattaactaccctgaatgttcacaaaacctaactaagtagatctttgaatcgtgagaagcaagtttcagtctgcacgagagccactgctacttgcagaagatttcttaccgctatacttctgcttccccaagttgaaggggatatatttgtatttcatcatgtgtgcaacttggcgtctcattgtaaggacaaagagaacaaaccagtaacagagtaatataggccaaaagacaggaacatcaaacagggaaaaaaaagtcatcacaaatgctatgcagagagccttcgtgaaagaataccagaactttgactccggggaggcggcgaaatgaagggttgaactcatcggagccctttggtgggaaagcaaaggggaattcgggagggatcgaggctctggatcgaccaaagggggagaagaaaacccattcaagaaattccggaaaggtgattcccgaggcccttaagaaacaatggaaaaccccctgcccttaaaccaacgccttaaaaacggagatgggatggctttccccaaaaagtccccaatccctccttttccctggaaaatggggaaggggatttttttcccagatatttaccgaaaaaagccttccgaaaaaaccgtgggcaaattattgctttccccctggggcgaaaccgggtgaatgaacggggtaacgggcaacccttacaaattttggcctccctttttcttatattcaaacacaaccccccccccctgttttgcctccaccctacaaaaacaaaaatg

SEQ ID NO: 48844 - DNA, 814 bp, Zea mays
  misc_feature: Ceres CLONE 1458583-F
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (63)..(63): n is a, c, t, g, unknown, or other
  misc_feature (64)..(64): n is a, c, t, g, unknown, or other
  misc_feature (67)..(67): n is a, c, t, g, unknown, or other
  misc_feature (77)..(77): n is a, c, t, g, unknown, or other
  misc_feature (79)..(79): n is a, c, t, g, unknown, or other
  misc_feature (80)..(80): n is a, c, t, g, unknown, or other
ggtagttgccgccttctttgggcacgtgccctttnnnnnnnnnnnnnnnaaaaggggaggtcnnggngggggggggngnntatattctaaaatataaccctcggctgcgggccttcgcgcgagaccattatatagaacatcttaatagaaaaaaatagtcaccctcctcggccacctgctcctcccgaagcgccgctcttcgacgccgaggagctgaccaagtggttcctctaccgagcggtcatggtcaagttcggggcgccgccgcctgtgcctctacatcaccggggccccccgcttcctggtacacgccccggcgggatgccggcggccccaacgccgccgacgcgggctgcagcggcgtcggcatcctgggcgtcgcctgggcgtactgcgacatgatcttcgtgatcgtctagtggttttttaaaaaatcaaataagaaccctaacgcggcagacagtgggggggggtgtttctggaacccaaagagtcaccggtgcgcgcccagaccgaaactttcgcgcttgacagtgagccattcccctcttgcggcatcattagcaaatctcagaactccttttaaccacaactaggggggctcgggggctctgcgactacaatcccaggattctccaatggggacccggcgcatcccccccggaaaattattctgagccctgtcctggtccattctagacgtggtcgaagtgcggggccttggacccctcaggatctggcggccatgtggatatccccacgttccctggggtgtcgggacctcttattgggtcaccacccgccttttctcgcg

SEQ ID NO: 48845 - DNA, 705 bp, Zea mays
  misc_feature: Ceres CLONE 1458585-F
  misc_feature: Encodes the peptide sequence at SEQ ID NO. 48846
atgtggatcccccgggctgcaggaattcgcacgagaccattacctagaacatcctaatcgaaaagtgttagcgctggcgtgtgactggtaaggtttacattgtctatgtggaaacagttcctgagcaatctgccccggaggtcgacggcctccggggactcaggacattgtagcagtggcgccggcatacagcgcacgatcagctgcggcagcatcccgccgggccgccccccggcctccgccattcggcgcatgtcatcctccgtcttcccctctagcgtcatggatggcttccagcccctggtctcgttcaaggacttgccccagctcgcaaaaccatagccagaacgtgagcaagctaagccttgtgctgcaacccgccccaattttttgggcccgggagggcatttctggggcaaaatgatatcaaggggctaggccctgcctgtattttatataaagtacccccaggccaaaaacgtcttcgttctcgaaggggggtggggcggggcccttcaccccgaaccccccccccccccccttttctggggggttcccccgaaatttggtggccttgccccaattcttcgggggggggggaagataccactcttaagcccccctagttccacaatggggtgcggggttcccctctcccccttttttttaaaaaccgctctttccaattatttatctgccacccct

SEQ ID NO: 48846 - protein, 78 aa, Zea mays
  misc_feature: Ceres CLONE 1458585-F
MWKQFLSNLPRRSTASGDSGHCSSGAGIQRTISCGSIPPGRPPASAIRRMSSSVFPSSVMDGFQPLVSFKDLPQLAKP

SEQ ID NO: 48847 - DNA, 799 bp, Zea mays
  misc_feature: Ceres CLONE 1458598-F
  misc_feature: Translation starting site: 341
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (429)..(429): n is a, c, t, g, unknown, or other
gggctccgccccccggggccccccgcaggggggnnnntttttnnntntcaaaactggcgctccccgcggtggcggccgctctatttctagaggatcccccgggctgcaggaattttcacgagaccattacctagaacatcctaatcgaaaaaagtgcctgaagagaagaccgcgggacatcacgatgatgccttcagcaccttcttcagccagactggtgctgggaagcacgtgccccgcggagtcgtcgttgatctacaacccactgtgatcgatgaggtgcgcactggtgcgtaccgccagctcgtcgaccctgaggagctcttcccgggcagggaggatgccgctaacaatttcgcccggggccactacacggttggaaaggagattgttgatctgggccttgaccgtatccgactgcttgatganaaaagaacacgacctccaaggcttcctggtcttcaatcccccccggtggtggtttgggctctcggccttgtccctcgcggtacttggccccctgcccgaggaatacggatgagaaccccgagggtgaggtttgagtggggtactgatcccacggaggaggctacccgctgttggggtgtgctagccacaggccgtggtcttccaaatcaagtgattcgcagagggtgcccaaatgcccgtcctgcgtggctcggacaaacgatggccaggccgtttccccccgggtaagtcccccccacttcgaacatagaagaaggtggctacttatgtccgccctttgaactccgccccctggtgtgtccgcgggggg

SEQ ID NO: 48848 - DNA, 621 bp, Zea mays
  misc_feature: Ceres CLONE 1458599-F
  misc_feature: Encodes the peptide sequence at SEQ ID NO. 48849
gcggtggcggccgctctatactagtggatcccccgggctgcaggaattcgcacgagaccattacctagaacatcctaatcgaaaagttgtaagctcccaggtttcttctcttcgcgtgagctagctagactagagtgggatcgcgaggaagaaggatgtcgtgctgcggaggaaactgcgggtgcggcagcggatgcaagtgcggcagcgggtgcggagggtgcaagatgtacccggacatggctgagcaggtgaccaccaccaccaccatcatgggtgttgcaccatccaagggcgggttcgaggcggccgccggagctgagaacggcgggtgcaagtgcggcgccgccagctgcacctgcgacccctgcacctgcaagtgaggatgaccgggtgcagcatgcaggccgtgacgatggaggaagtagatcggaaggacacccttcagtatctctagctaaatcaacctctgaaagtatgttgtaccaccgtcgtctgtgtttgccgccctgcgtacctagcttgctaggggtggtaaacaaaaattgtcctggttctcttcctcctcggcccctgccatggttgcttcgggggggccggcccggtgaatgcccagcacca

SEQ ID NO: 48849 - protein, 75 aa, Zea mays; identical to SEQ ID NO: 45247
  misc_feature: Ceres CLONE 1458599-F
  misc_feature (1)..(74): Pfam Name: Metallothio_2 Pfam Description: Metallothionein

SEQ ID NO: 48850 - DNA, 683 bp, Zea mays
  misc_feature: Ceres CLONE 1458600-F
  misc_feature: Encodes the peptide sequence at SEQ ID NO. 48851
gctcttatctagtggatcccccgggctgcaggaattttcacgagaccattacctagaacatcctaatcgaaaaattttagggcgaacgcgaaatctaaaattagagagcgatggcgagtacagcagctgcgacgggaacgacgacggcgaagagaaaacctgtgtttgtgaaggttgagcagctgaagcctggaacgaccggtcacacattgactgtcaaggtcgttgacgccaatcctgtggttccggctgcgaggaaggctcgtccggggggttctatgggtcggccgtctcagccgagtcgaatcgctgagtgtctcatcggagacaaaaccgggtgtattttcttcactgctcgtaacgatcaccccgatcttatcaacccgggggaaacggtgttagtgcgcaattccaggatggacatgttcactggtacaatgaggctaggggttgataaatgcggactcatcgaagccactgagcctgcttctttcacagtcgaagaggataacaatcttgtctcttggtgaatacaaaactgattaacctaactgatcagtggaatggcctgttattatcttctccactgagcctacaatttgggttccgattcttctatccgtaaatggctttttgatttccacgcataaaaccttttggattcactgggttcacaaccttct

SEQ ID NO: 48851 - protein, 139 aa, Zea mays
  misc_feature: Ceres CLONE 1458600-F
MASTAAATGTTTAKRKPVFVKVEQLKPGTTGHTLTVKVVDANPVVPAARKARPGGSMGRPSQPSRIAECLIGDKTGCIFFTARNDHPDLINPGETVLVRNSRMDMFTGTMRLGVDKCGLIEATEPASFTVEEDNNLVSW

SEQ ID NO: 48852 - DNA, 663 bp, Zea mays
  misc_feature: Ceres CLONE 1458601-F
  misc_feature: Encodes the peptide sequence at SEQ ID NO. 48853
acccgcggtggcggccgctctataactagtggatcccccgggctgcaggaattcgcacgagaccatacctaaaacatcctaatccaaaaaggaaagaagtgctccggggaagcaccgtgacacccttgctcacccgcatctctctaaccgccggcgccggcgccggcgccggccatcgttcacatggctgccatgccaccggccttcacgggcaacctgaagaaagcacttgcaggtctgagaagaatcaatttagatgggcttcgatggcgcgtatttgatgctaagggtcaggtgctgggacgattggcttcccaaatagccgttgtgcttcaaggcaaggataaaccgacctatgcgccacatgcgaaaaatggagacatgtgcattgtacttaatgcacaggatatcagtgttacacgaaggaaaatgacagataagatttactactggcatacagggtacccccgcccatttgaaggaaaggaggctcaaggaccagatgggaaaagacccaactgaagtgattcccaaagctgtgctgcgcatgtttccccgcaacaaattgtttgatgataggaatcccaagccgccgaattttttctggaatttgaggattcatttcctggaccggccctcttggaaccttttgtgaggcccccc

SEQ ID NO: 48853 - protein, 112 aa, Zea mays
  misc_feature: Ceres CLONE 1458601-F
  misc_feature (29)..(111): Pfam Name: Ribosomal_L13 Pfam Description: Ribosomal protein L13
MAAMPPAFTGNLKKALAGLRRINLDGLRWRVFDAKGQVLGRLASQIAVVLQGKDKPTYAPHAKNGDMCIVLNAQDISVTRRKMTDKIYYWHTGYPRPFEGKEAQGPDGKRPN

SEQ ID NO: 48854 - DNA, 664 bp, Zea mays
  misc_feature: Ceres CLONE 1458615-F
  misc_feature: Encodes the peptide sequence at SEQ ID NO. 48855
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (509)..(509): n is a, c, t, g, unknown, or other
cgattgggtaccgggccccccctcgagccctgcagtggtaaaggcgacgcaccccttcctcgtttcgccgcctccgccgacaccgactgcctacctcagctgccgtcgccatgggcagaaggcctgctagatgctatcgccagatcaagaacaagccataccctaagtccaggtactgccgtggtgtccctgaccccaagatcaggatctacgatgtcgggatgaagaggaagggtgttgatgagttcccctactgtgtgcaccttgtctcttgggagaaggagaatgtctccagtgaggcgctcgaggctgcccgcattgcctgcaacaagtacatgaccaagtctgcaggaaaggatgccttccaccttagggtccgggttcacccgttccatgtcctccgtatcaacaagatgctttcgtgtgctggggctgataggctccagactggaatgaggggtgcctttggcaagcctcagnnnacctgtgctagggtggacattggtcangtcctcctttccgtgcgatgcaaggacaacaatgctgcacatgcccaccaaagctctgcgtcgcgctaaattcaagttcccctggccgccaaaagatcatttgagagcacaaaagtggggcttccacaagtttcagcccgccctgaactacctga

SEQ ID NO: 48855 - protein, 155 aa, Zea mays
  misc_feature: Ceres CLONE 1458615-F
  misc_feature (5)..(155): Pfam Name: Ribosomal_L16 Pfam Description: Ribosomal protein L16
  misc_feature (124)..(124): Xaa is any aa, unknown, or other
  misc_feature (133)..(133): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQXTCARVDIGXVLLSVRCKDNNAAHAHQSSASR

SEQ ID NO: 48856 - DNA, 671 bp, Zea mays
  misc_feature: Ceres CLONE 1458621-F
  misc_feature: Encodes the peptide sequence at SEQ ID NO. 48857
  misc_feature (1)..(1): n is a, c, t, g, unknown, or other
ncgattgggtaccgggccccccctcgagccctgaggtggtaaaggcaggcaatcgtacgcacccagccatcagcgaacattacttccacgccccccctcctttccaggtcccctcgcccgcgcgctcagatctcgcgcgcctcccataagggaaacgttgagccatgtgcacatctgtggatgccgctccatcagttgcggctgaggtcactgagaacttgttgtgtggcaaaaaagttacagctgcatttgtcctacgcggtcctgcaaatggaaaagggacacggtgtgccacacgtcatgcagcacatttgcattcacccagcttactgctggaaatcttaggcccgcacagattaggtctcggatctaaaaaaggaaccatgagtgagagcatgatgacggagggaaagattgttccatccaaggcgactattacgctattgccggaagcaatcataacaagcgacaatgaccaattcctgatcgacacatatcacaggaatgaggataatcgtgctccctttgagaatatgaccaaaatttctcctgcacttgcgctataccttgactgtactgaagaacatatgtagaaacgactcctgaggcgcactcagggaagggatgaggatcacctttacaccatcaaaaaaaagttccagaactctgtt

SEQ ID NO: 48857 - protein, 142 aa, Zea mays
  misc_feature: Ceres CLONE 1458621-F
  misc_feature: SWISSPROT Homolog: EC 2.7.4.3 Adenylate kinase
MCTSVDAAPSVAAEVTENLLCGKKVTAAFVLRGPANGKGTRCATRHAAHLHSPSLLLEILGPHRLGLGSKKGTMSESMMTEGKIVPSKATITLLPEAIITSDNDQFLIDTYHRNEDNRAPFENMTKISPALALYLDCTEEHM

SEQ ID NO: 48858 - DNA, 690 bp, Zea mays
  misc_feature: Ceres CLONE 1458630-F
  misc_feature: Encodes the peptide sequence at SEQ ID NO. 48859
  misc_feature (397)..(397): n is a, c, t, g, unknown, or other
  misc_feature (399)..(399): n is a, c, t, g, unknown, or other
  misc_feature (403)..(403): n is a, c, t, g, unknown, or other
  misc_feature (611)..(611): n is a, c, t, g, unknown, or other
gcgattgggtaccgggccccccctcgagccactgcagtggtaaagggggtcctctcttcttcaccaccacctcctactccgctgcaaccccaaatctctccttcctcgcatacgcgcgcagcagaggagctgagaccaacgaagaagaagaacaaccgagcaagcacaagcttagctagcgtggaggtgcccaaggcgacgacggccgccgcgccaggctagccaaccagctgctcatcgctcctagctgcggagccgatggctggaaccgacgtctacgtcgggacggagctccgcctcggcctgccaggaggaggcgcctatgcggccaaggctgccaagaggtgcttcgaggacaccatcgacctcacgctgaagctgcgggcgggcgggatgnangaanctgccgctgccgccacctccaaaccggagccgggcgccgagaaagccaagaggcccgccgaggctccggccgctgatgcccataaaccacctgcacccaaggcacaagctgtgggtttggcccccaacccggcctacccggaggaacgtcctgaccctcccagtctgttgaaaaagcacaagggatccagacccctgagaggaaaaangtcccctggcccatgcgggggggcaagggggcccacccttctttgaaggtccagaatggacggggggccctctacctgg

SEQ ID NO: 48859 - protein, 132 aa, Zea mays
  misc_feature: Ceres CLONE 1458630-F
  misc_feature (47)..(47): Xaa is any aa, unknown, or other
  misc_feature (49)..(49): Xaa is any aa, unknown, or other
  misc_feature (118)..(118): Xaa is any aa, unknown, or other
MAGTDVYVGTELRLGLPGGGAYAAKAAKRCFEDTIDLTLKLRAGGMXEXAAAATSKPEPGAEKAKRPAEAPAADAHKPPAPKAQAVGLAPNPAYPEERPDPPSLLKKHKGSRPLRGKXSPGPCGGARGPTLL

SEQ ID NO: 48860 - DNA, 751 bp, Zea mays
  misc_feature: Ceres CLONE 1458632-F
  misc_feature: Encodes the peptide sequence at SEQ ID NO. 48861
  misc_feature (56)..(56): n is a, c, t, g, unknown, or other
tttattttcccctcaccgtttacacaccaatacaataccagaaaaaccaaaaaaanccccattgggtaccgggccccccctccaggccgctgcgttggtaaaggcccccaatcaaatactcagacaaccatggggcaccagcaggcgcagcacggcaaggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgccagcgagatcccggcgtccaaccacgactacctccggcgggtcatgcgcacgctgacagccatgcgcatcttcgcggccagccacgaccccgccaaggccgacgacgcggccgccatctcctaccagctgaccccggagacccggctgctcgtcagcagtagcagcagcgtcgacgacgccgccggcgcctcgaaggagaacactactaccccgagcatcctcccccacatcgcccacctggaccgcccccaaccaccattctccctgctggtccccaatggtcgagtgcgagaaaggactaacagcagcggccgacccgtgttccctgtaaccacaaacggggcccccgggaaaggggaaaggtgggacgtggctctgaaaagaaccaacccctgacccaaacagggcgccaagtctttctccgcaaaaaggc

SEQ ID NO: 48861 - protein, 194 aa, Zea mays
  misc_feature: Ceres CLONE 1458632-F
  misc_feature (34)..(82): Pfam Name: Dimerisation Pfam Description: Dimerisation domain
  misc_feature: SWISSPROT Homolog: EC 2.1.1.146 (Iso)eugenol O-methyltransferase
MGHQQAQHGKDDTEELLAAHRQLWCHALGYVKSMALKCALDLRIPDTIDRCGGSATLGELLAASEIPASNHDYLRRVMRTLTAMRIFAASHDPAKADDAAAISYQLTPETRLLVSSSSSVDDAAGASKENTTTPSILPHIAHLDRPQPPFSLLVPNGRVRERTNSSGRPVFPVTTNGAPGKGERWDVALKRTNP

SEQ ID NO: 48862 - DNA, 675 bp, Zea mays
  misc_feature: Ceres CLONE 1458636-F
  misc_feature: Encodes the peptide sequence at SEQ ID NO. 48863
tcgagccctgcagtggtaaaggaaacgcaacgcaaggcccctcgacgcagataccgcgctcaggagcattcgagaagccgaagaaaattcgaagacgaggaccagctacactgcggacggacttcgggcatggagggccagttccaggttggcaaggaggaggtcatccaagcatggtacatggacgacagtgaagaggaccagaggcttcctcatcatcgcgagcccaaagaattcattcctctcgacaaactttccgaactaggaatattaagctggcgcctaaatgctgatgattgggagaatgatgagaacctcaagaaaattcgtgaagccaggggttactcttacatggacatttgtgatgtgtgcccagagaagttgccaaattacgaggctaacataaagaatttctttgaagaacacttgcatactgatgacgagatacgatattgccttgagggtagcggctactttgatgtgagggacccagatgatcaagtggatccgtggtaacggtaaaagaaaggggggatggatcgttttggcctgcaggaaaggtatccaccgcttttccgttgggataggtgaccacttactttaagggccaatggcgtcctatttgggggggtggagccctggtctgggacaaccaataacaaatcggtcccggca

SEQ ID NO: 48863 - protein, 128 aa, Zea mays
  misc_feature: Ceres CLONE 1458636-F
  misc_feature (14)..(127): Pfam Name: ARD Pfam Description: ARD/ARD' family
MEGQFQVGKEEVIQAWYMDDSEEDQRLPHHREPKEFIPLDKLSELGILSWRLNADDWENDENLKKIREARGYSYMDICDVCPEKLPNYEANIKNFFEEHLHTDDEIRYCLEGSGYFDVRDPDDQVDPW

SEQ ID NO: 48864 - DNA, 710 bp, Zea mays
  misc_feature: Ceres CLONE 1458645-F
  misc_feature: Encodes the peptide sequence at SEQ ID NO. 48865
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (605)..(605): n is a, c, t, g, unknown, or other
gaatttttttaaaaaacacattccttcttgatgttattaaaaannnnnnnnnnnnnnnnnnnccgaattgggtaccgggccccccctcgaggctctgcggtgctatagctggtggtgggcctactccaagcagccgccgcgctcggacggcgccgcggcgtggtggagcggcggcggcgccgccgcgcaggaggagcgccacttctaccgcctcttcttcctggagcaccagcggtcgcttgtgctggacacgtacctcccgcgcgtccgccagctgggccgcgccgtcatggtgaagaaccgccagcggaagctgttcaccaacatctccacgcaccagtggagcgacggcgggttcatgaggtcggcgtggacccacgtggtgttcgagcaccccaagacgttcgccacgctcgccatggaccccgccgagaagaagagggtcatggacgacctcgacatgttcaagggcggaaggcaccactacgcgcgcgtcggcaaggcgtggaagcgcgggtacctcctgtacgggccccccgggacggggaagtcggccatgatcgccgccatggccaactacctcgactacgacatctacgacatcnagcttcacgtcggtgcctccaacaccgacctccgcaagctcttcatcgagaccacccgcaaggccattatcgtcatcgaaagacatcgactgcctccctccaact

SEQ ID NO: 48865 - protein, 140 aa, Zea mays
  misc_feature: Ceres CLONE 1458645-F
  misc_feature (106)..(106): Xaa is any aa, unknown, or other
MVKNRQRKLFTNISTHQWSDGGFMRSAWTHVVFEHPKTFATLAMDPAEKKRVMDDLDMFKGGRHHYARVGKAWKRGYLLYGPPGTGKSAMIAAMANYLDYDIYDIXLHVGASNTDLRKLFIETTRKAIIVIERHRLPPSN

SEQ ID NO: 48866 - DNA, 670 bp, Zea mays
  misc_feature: Ceres CLONE 1458647-F
  misc_feature: Translation starting site: 106
  misc_feature: Pfam Name: BSP Pfam Description: Plant Basic Secretory Protein
  misc_feature (1)..(1): n is a, c, t, g, unknown, or other
ncgattgggtaccgggccccccctcgagccactgcagtgggaaaggacccccctgagctgatcaagaaggcaagcaccaatcagccagcagtccagcacaatatcatgaacaagcgtcaggtcaccgcggcggtggctgccctcctggcgctgctagccgcatcatcaacggccggcgccgtgacgttcgacgcgacgaacacggcgtccgatacccccggcggacagacggttcgaccaggccgtcggcctcgactacgccgagcaggtcctggccgacgcgtccactttcatctggaacaccttcgaccagcccagccccgccgaccacaagcccgtcgacgcggtgaccctcgtcgacgaggacatcggcggcgtgaccttcacgagcgccaacgggatccacctcagcgcgcagtacgtccgccgctactccggcgacgtcaagaccgaagtcaccggcgtgctgtaccacgagacaacgcacgtgtggcagtgggacaggcagggccaggcgaacggcggcctcatcgatggcatcgccgactacgtccggctgaaggcggcgtacgcgccgggccactggctgcaaccggtgcaggggggccggtgggaccaggggtacgacgtcacggcgaagttcctggactactgctactcgatcaaggcg

SEQ ID NO: 48867 - DNA, 709 bp, Zea mays
  misc_feature: Ceres CLONE 1458658-F
  misc_feature: Encodes the peptide sequence at SEQ ID NO. 48868
  misc_feature (1)..(1): n is a, c, t, g, unknown, or other
ncgattgggtaccgggccccccctcgagccctgcagtggtaaagggcttgccttaaccattcctcccaacaccacctcgcctgcgatcttcgtagcctccgtcgcgtcgagcatcgatcatgtcggcctactgcggaaagtacaaggatgagctcatcaagaatgctgcctacattggcaaccctggcaagggtattattgctgctgatgagtccactggcaccattggcaagcgcctttccagcatcactgtcgagaacgttgaggagaaccgccgtgccctccgtgaactcctattctgctgccctggtgctctccagtacatcagcggtgtgatcctcttcgaggagaccctgtaccaaaaaccccaggatggcaagccttttgttgatgtcctcaaggagggaggcgtcctccccgcgcttccagctgacaagggcaccattggaggttgtttggccctgataaggaaaccaaccccccaaggccatgaacaacctttggcaaagcgctgcccccaagaattaacaagggccggggccccgcttttgccaaaggggcgcccgctgtttctcccaaaattgggccccccagggaacctctccccccttttggcccttccaccccgaaaaccctcccagggggcctgggctcccctttatgcccttcctttctccccacggaaaaaagagggcccgggcgcccacag

SEQ ID NO: 48868 - protein, 196 aa, Zea mays
  misc_feature: Ceres CLONE 1458658-F
  misc_feature (11)..(196): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYKDELIKNAAYIGNPGKGIIAADESTGTIGKRLSSITVENVEENRRALRELLFCCPGALQYISGVILFEETLYQKPQDGKPFVDVLKEGGVLPALPADKGTIGGCLALIRKPTPQGHEQPLAKRCPQELTRAGAPLLPKGRPLFLPKLGPPGNLSPLLALPPRKPSQGAWAPLYALPFSPRKKEGPGAH

SEQ ID NO: 48869 - DNA, 642 bp, Zea mays
  misc_feature: Ceres CLONE 1458660-F
  misc_feature (219)..(219): n is a, c, t, g, unknown, or other
  misc_feature (220)..(220): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (255)..(255): n is a, c, t, g, unknown, or other
  misc_feature (264)..(264): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (390)..(390): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (408)..(408): n is a, c, t, g, unknown, or other
  misc_feature (409)..(409): n is a, c, t, g, unknown, or other
  misc_feature (424)..(424): n is a, c, t, g, unknown, or other
  misc_feature (429)..(429): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (437)..(437): n is a, c, t, g, unknown, or other
  misc_feature (438)..(438): n is a, c, t, g, unknown, or other
  misc_feature (456)..(456): n is a, c, t, g, unknown, or other
  misc_feature (478)..(478): n is a, c, t, g, unknown, or other
  misc_feature (480)..(480): n is a, c, t, g, unknown, or other
  misc_feature (483)..(483): n is a, c, t, g, unknown, or other
  misc_feature (489)..(489): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (521)..(521): n is a, c, t, g, unknown, or other
  misc_feature (538)..(538): n is a, c, t, g, unknown, or other
  misc_feature (540)..(540): n is a, c, t, g, unknown, or other
  misc_feature (542)..(542): n is a, c, t, g, unknown, or other
  misc_feature (554)..(554): n is a, c, t, g, unknown, or other
  misc_feature (582)..(582): n is a, c, t, g, unknown, or other
  misc_feature (583)..(583): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (620)..(620): n is a, c, t, g, unknown, or other
ctggagctccccgcggtggcggccgctctagaactagtggatcccccgggctgcaggaattcgcacgagaccattacctagaacatcctaatcgaaaaaaggaaacagtcacgtctcccagatctaactccccccgactcacgaatcccagagagcctccatggcgacgcaccgccactgcctcccactcctcctcgtggccgccgccctcgccctcgnnccgccgnnntccctgggctcgcgcgggcgctgggncggcgggcngcggcccgctgctgggggcgggtgggaacccgatccctgaagggaggaatccccattcccgaactagggggggggcctttggggaaagaaaaaacccaaaggggggcccccnnnaaaggggggggntgtgcggcgccgtnnntnncgcgccgcccccccnccccnannnnntnnaccccgcccgccggcgtnttttgttacgcggtacctaaantnttntttttntttcgccgggctgcgcgggtnnngcggnnntntcgcggcggcggttttntntntccttagggggntttgcggtttttcggtttggtttgttcnnatnnnccagggtagggcaaannnacgaaaaaaaaggntcgctgtaggcggcgaaaaaaa

SEQ ID NO: 48870 - DNA, 709 bp, Zea mays
  misc_feature: Ceres CLONE 1458671-F
  misc_feature: Encodes the peptide sequence at SEQ ID NO. 48871
  misc_feature (619)..(619): n is a, c, t, g, unknown, or other
ggagctccccgcggtggcggccgctctagaactagtggatcccccgggctgcaggaattcgcacgagaccattacctagaacatcctaatcgaaaaatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcaaagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgaccctttgagtgacatgctacatccggtcaggctgttcgttgggtttcatcccgacccggctccaaaactttnaaaattggttttcggccccgggggattacgcgtccccaccgctaaattctctaatttacccccaacgaaaagtcccaacagctccttgtt

SEQ ID NO: 48871 - protein, 187 aa, Zea mays
  misc_feature: Ceres CLONE 1458671-F
  misc_feature (44)..(108): Pfam Name: Glutaredoxin Pfam Description: Glutaredoxin
  misc_feature: SWISSPROT Homolog: EC 1.11.1.15 Peroxiredoxin
  misc_feature (158)..(158): Xaa is any aa, unknown, or other
MVALLGRRIGVAAAAAAFIALVAFGSASSSPKSFVKSTVSAHDVVIFSKSYCPYCKRAKAVFKELELKKEPYVVELDQREDGSKIQDALLEIVGRRTVPQVFVHGKHLGGSDDTVDSYESGKLARLLNIGVKDDPLSDMLHPVRLFVGFHPDPAPKLXKLVFGPGGLRVPTAKFSNLPPTKSPNSSL

SEQ ID NO: 48872 - DNA, 690 bp, Zea mays
  misc_feature: Ceres CLONE 1458676-F
  misc_feature: Encodes the peptide sequence at SEQ ID NO. 48873
tggagctccccgcggtggcggccgctctagaactagtggatcccccgggctgcaggaattcgcacgagaccattacctagaacatcctaatcgaaaaaatcttcctccttcctttttcctattgctgtgctctacagttcaataatttccctgccatctctcggcctttagtgaatttctccatgagctttactggtcaccgaactcgcattcgagttgacatgctttgcgtcgttcaactggccagagctcgccgcatgtcatctccggttcttcccagcccatggtgtgtgtcgctgcacacttgccagcggtcgtcggccatcgaccccacgctcattctcgcaacctcactgcagcatcgtcgttctcccagttctgcgcgaacgtctgtgaacatttagagaagaagcggtgtctgaaaaaggagttcactccagagcctcttgatccagtggtggagttttatctaactacttacagagtagaataattttgggatctactcctgcaataaggagaagttttattcccttatcttttgggttagttacttcatgtggaggacttgaaagctagaaggttttatatatctcctattgaaaaggcttcaccccttccgaataattggattaaagtatggcccttccagtactttccagggattggaataaatacatcccctttcac

SEQ ID NO: 48873 - protein, 73 aa, Zea mays
  misc_feature: Ceres CLONE 1458676-F
MSFTGHRTRIRVDMLCVVQLARARRMSSPVLPSPWCVSLHTCQRSSAIDPTLILATSLQHRRSPSSARTSVNI

SEQ ID NO: 48874 - DNA, 690 bp, Zea mays
  misc_feature: Ceres CLONE 1458677-F
  misc_feature: Encodes the peptide sequence at SEQ ID NO. 48875
  misc_feature (556)..(556): n is a, c, t, g, unknown, or other
tggagctccccgcggtggcggccgctctagaactagtggatcccccgggctgcaggaattcgcacgagaccattacctagaacatcctaatcgaaaaattcacatctgtagccgcgcctctccgtatcactccgcgcctctctcccgccaggccgccgcccaagcaaccatggtggccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcagcgaggttttctggaactggacctggtgctggggacctgggtcgagcagcacgtgcacgccatggacgaggccaacatccgcgccctcctgcaagtgctcgacctcgaaaacccagatttgtggaaatggttgactagccaggagcagccaccagaggatctgaantcctaatcggtgtttgctgccatcaaatcaaagtcacagataaccctgaccaagcatgctttcccctgaaacccgatctaaccccgggcaaccctgggtttaaagatggggccaacataaaaaaaaggaaaaag

SEQ ID NO: 48875 - protein, 130 aa, Zea mays
  misc_feature: Ceres CLONE 1458677-F
  misc_feature (60)..(131): Pfam Name: DUF339 Pfam Description: Protein of unknown function (DUF339)
  misc_feature (129)..(129): Xaa is any aa, unknown, or other
MVAALLRRALHLRRVLPSPAVTAAASQRLIPAFSTTPTPTPTTSQQNAATTTIDLSSDESRRRLLNRLVYRSKQRGFLELDLVLGTWVEQHVHAMDEANIRALLQVLDLENPDLWKWLTSQEQPPEDLXS

SEQ ID NO: 48876 - DNA, 751 bp, Zea mays
  misc_feature: Ceres CLONE 1458682-F
  misc_feature: Encodes the peptide sequence at SEQ ID NO. 48877
  misc_feature (367)..(367): n is a, c, t, g, unknown, or other
  misc_feature (370)..(370): n is a, c, t, g, unknown, or other
ggagctccccgcggtggcggccgctctagaactagtggatcccccgggctgcaggaattcgcacgagaccattacctagaacatcctaatcgaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaantgncctctgccaacccacaggaggaaaggcaaggctcactgagggctgctctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgagatcaaccaatggctctttgaattttaattacgacgaacacaacatttggtgacatctggtttcctgaaaaaaaaaaaaaaaaaaagcttatccataccggccacctcgaggggggggcccgggacccaattcgccctataggggatcggattacgcgggctcc

SEQ ID NO: 48877 - protein, 86 aa, Zea mays
  misc_feature: Ceres CLONE 1458682-F
  misc_feature (30)..(84): Pfam Name: Ribosomal_S27e Pfam Description: Ribosomal protein S27
  misc_feature (63)..(63): Xaa is any aa, unknown, or other
  misc_feature (64)..(64): Xaa is any aa, unknown, or other
MVLQNDIDLLNPPAELEKLKHKKKRLVQSPNSFFMDVKCQGCFSITTVFSHSQTVVVCPGCQXXLCQPTGGKARLTEGCSFRRKGD

SEQ ID NO: 48878 - DNA, 705 bp, Zea mays
  misc_feature: Ceres CLONE 1458683-F
  misc_feature: Encodes the peptide sequence at SEQ ID NO. 48879
  misc_feature (399)..(399): n is a, c, t, g, unknown, or other
  misc_feature (400)..(400): n is a, c, t, g, unknown, or other
  misc_feature (406)..(406): n is a, c, t, g, unknown, or other
  misc_feature (434)..(434): n is a, c, t, g, unknown, or other
  misc_feature (471)..(471): n is a, c, t, g, unknown, or other
tggagctccccgcggtggcggccgctctagaactagtggatcccccgggctgcaggaattcgcacgagaccattacctagaacatcctaatcgaaaactcccccgatcgatcccaatcgaacccaccaagccgataccctaaccctcgcccttctcgatgtcggccgccaccaccggcccagccccttcagtagccactccgatggcgccccctccgtcctacccggcctcctccacggcctcttcctccatctccgcgtccgccgaggaggaggaggacctctatggccgcctcaaatcgctccaacgccacatggagttcgtcgaaatccaggaggagtacgttaaagacgagcagaagaacctgaagcgcgaactccttcgtgcgcaggaggaggnntaagcngatccagtctgtaccgctcgtcattggnccagttatggagatggtcgacggcaacaacggcatcnttgggctctaccactggcagcaactactacgtgcgggatcctcaggaccatcaaaccgggaagtgctcaagccgtcagcggtccggtcggtttgaatcgtcactccaaccctctattcaacctggtgcccccggaaagccaaatcccaaatcccctttgttggaaccctcggaaaaccccacggccctttaaaagattttggggggggtgcaccccaaaaaaaaaaaattcggg

SEQ ID NO: 48879 - protein, 65 aa, Zea mays
  misc_feature: Ceres CLONE 1458683-F
MAPPPSYPASSTASSSISASAEEEEDLYGRLKSLQRHMEFVEIQEEYVKDEQKNLKRELLRAQEE

SEQ ID NO: 48880 - DNA, 791 bp, Zea mays
  misc_feature: Ceres CLONE 1458685-F
  misc_feature: Encodes the peptide sequence at SEQ ID NO. 48881
  misc_feature (32)..(32): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
ggtgggcggcttttcttttttttttggcgccnggaggnnngctctttttctttaaactggtactccaccgcggtggcggccgctctattctagtggatcccccgggctgcaggaattcgcacgagaccattacctagaacatcctaatcgaaaatttcgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtataatgtgcctcaagtcaagggtcatcgacttagaggtgggccacagatgattcagctgagtttggatggcatgaggatatacgtgtaaaaatcacttttcaaccgatgacaccatcagtttttcccctgatgatgttgtcaagaagggctcccacatggttggacatcgatgttcacaccgaagataggaggcctggcttgtcaaccccaaccttcttcgtcgattttggccctgtagcctgatggtcccggccctggccccataagatgaaatactcctgggtgcggatgcccccttttgatatctggtatctgtaggtctggggattcgtgggtatttaaaagggctgactagcataaccacccgattgttggaacgcgctgctagatttaacagtggaatccggggctgctgtgttttgccttttacatgacgaccggattcggcaggaga

SEQ ID NO: 48881 - protein, 44 aa, Zea mays
  misc_feature: Ceres CLONE 1458685-F
  misc_feature (13)..(13): Xaa is any aa, unknown, or other
WAAFLFFLAPGGXLFFFKLVLHRGGGRSILVDPPGCRNSHETIT

SEQ ID NO: 48882 - DNA, 702 bp, Zea mays
  misc_feature: Ceres CLONE 1458688-F
  misc_feature: Encodes the peptide sequence at SEQ ID NO. 48883
  misc_feature (585)..(585): n is a, c, t, g, unknown, or other
tggagctccccgcggtggcggccgctctagaactagtggatcccccgggctgcaggaattcgcacgagaccattacctagaacatcctaatcgcaaaagaattcctgtcactgctcgaaatcgatccgatctccgctcgcgctgaagcctgatctccaccgggttcgcagcaggggcgcaggacctcgatcacgaggaggcaggggagcagcatccacaaccacaagccatggcggggagggccaacatccccactaacaactccgccctcatcgcaatcatcgccgacgaggacaccgtcactggcttcttgatggccggcgttggcaatgttgatctgcgcaagaaaaccaactacctcctcgtcgacaacaagacgacagttaaacaaatcgaggatgcgttcaaagaatttactacgagggaggatattgctattgtgctcatcagtcagtatattgccaacatgataaggtttctggtggatagctacaacaagcccgtccctgctattctggagatcccatccaaggaccatccatatgatccagcgcacgactctgtgctctctcgagtgaatatctngtctctgcagaatcggtggcgtctgataagcgatgaaaggcatctttggctaacaagacccttccatgcatctattttggtaggggattgaaaaaaaatgggccctacccttggggg

SEQ ID NO: 48883 - protein, 148 aa, Zea mays
  misc_feature: Ceres CLONE 1458688-F
  misc_feature (15)..(115): Pfam Name: ATP-synt_F Pfam Description: ATP synthase (F/14-kDa) subunit
  misc_feature: SWISSPROT Homolog: EC 3.6.3.14 H(+)-transporting two-sector ATPase
  misc_feature (119)..(119): Xaa is any aa, unknown, or other
MAGRANIPTNNSALIAIIADEDTVTGFLMAGVGNVDLRKKTNYLLVDNKTTVKQIEDAFKEFTTREDIAIVLISQYIANMIRFLVDSYNKPVPAILEIPSKDHPYDPAHDSVLSRVNIXSLQNRWRLISDERHLWLTRPFHASILVGD

SEQ ID NO: 48884 - DNA, 714 bp, Zea mays
  misc_feature: Ceres CLONE 1458692-F
  misc_feature: Encodes the peptide sequence at SEQ ID NO. 48885
  misc_feature (559)..(559): n is a, c, t, g, unknown, or other
  misc_feature (584)..(584): n is a, c, t, g, unknown, or other
ggagctccccgcggtggcggccgctctagaactagtggatccccctggctgcaggaattcgcacgagaccattacctagaacatcctaatcgaaaaactttgagtcttgaagaaaggtcatcatcatcaacgtcgagaataatggcttctctttgtgcttcctctgccatcgccgccatttcttctcctagtttcttgtgtggcaagaagctaaggctgaacaagaagctgagtgttgcagctgtttccaaatcagctgcgtctgtgcgggccgttgcagcggatcccgagagaccaatctggttccctggaagcactcctccagagtggctcgacggtagcctccctggtgacttcggatttgatcctcttggtctttcatctgacccctatagtctaaaatggaacgtacaagcagagatagttcactgccggtgggcaatgctaggtgccgccggaatttttatcccggagtttctaaccaagatcgggatcctcaacacgccttcgtggtacactgccggagagcaagagtatttcacggacaaaaccacactcntttgtcattgagctcatcctaatangatgggccgagggacgtaaatgggccaatatcattaagcccgggtagcgtcaaacctggacccaatcttcccaaaacaaaaactgaacgggaaaaaattttggatacccgggtgggttaaggtcccaccc

SEQ ID NO: 48885 - protein, 142 aa, Zea mays
  misc_feature: Ceres CLONE 1458692-F
  misc_feature (59)..(141): Pfam Name: Chloroa_b-bind Pfam Description: Chlorophyll A-B binding protein
  misc_feature (140)..(140): Xaa is any aa, unknown, or other
MASLCASSAIAAISSPSFLCGKKLRLNKKLSVAAVSKSAASVRAVAADPERPIWFPGSTPPEWLDGSLPGDFGFDPLGLSSDPYSLKWNVQAEIVHCRWAMLGAAGIFIPEFLTKIGILNTPSWYTAGEQEYFTDKTTLXCH

SEQ ID NO: 48886 - DNA, 771 bp, Zea mays
  misc_feature: Ceres CLONE 1458693-F
  misc_feature: Translation starting site: 154
ggagctccccgcggtggcggccgctctataactagtggatcccccgggctgcaggaattcgcacgagaccattacctagaacatcctaatcgaaaaaaacctttcgacctgctttatactagacctcatcgagaatctcacgcgtcggcgaccatggcggcgtctccgtcttctccccatgccgcccccggagttagcggccagagcctgtccccctcagcgccgtctccccacctccccaactatttcatgtggagagaatttgtctggggaggaattgcaggtgcatttggggaaggcatgatgcatccagttgacactctgaaaacaaggcttcagagtcaagctataatgacaggggctaaggctcaaaaaaatatattccagatggtcaggacagtttgcccccccccatggtctaagaggtttttacagaggaatcagcccaggtgttactggatctcttgcgactggcgctacatatttcggtattattgaatcaaccaaagcatggttggagattgctaatcctaatctaaagtggaccctggtcacattttatcgctggggccgatggttgatacacttgggaacctttgcctatggtgcccttgctaagtcatgtaaaccaataatgcaaatttcagggcccccaaaaaatctttgggcattcagctgtatcccaaagggaaatatttccccaaacctctggggataaaagaatggatggggtactaacaatgggaatgttcccttggctggctgtttcta

SEQ ID NO: 48887 - DNA, 754 bp, Zea mays
  misc_feature: Ceres CLONE 1458699-F
  misc_feature: Translation starting site: 278
  misc_feature (698)..(698): n is a, c, t, g, unknown, or other
aaagctggagctccccgcggtggcggccgctctagaactagtggatcccccgggctgcaggaattcgcacgagaccattacctagaacatcctaatcgaaaagatccattcgattccatgtgttggcgactcgatcgtgtcgtgcgtgctgcacgcgcaggccaacgtgaccgccgccgactcgtccgggcgtgcctactgcgtgtacagctccgacgcgtccacggcgtacggcgtgagcgcgctgctgctgctgctggccgcgcaggccgtggccatggccgccacccgctgcttctgctgcggccgcggtctctcgccgggccgctggcgggcatggtccggcacctgcttcatcatctgctgcgcagcgcagggtgacgttcgtgatcgcggagctgtgcctgctggcggggtcggtccggaacgcctaccacaccaagtacgtctcgctgttcagcaacgccccgccccggtgcgccgtgctgcggaggggagtcttcgccgccggcgccgccttcgccttcctcaccgcgctcctggccgagctgcactacctcttctacgccagggcgcgcgccgccgccgccgtgcccccgcccatcgtcggcggcatcggcatgacccgcatgtgatgtgactctgtattttgtggcagctgccccgccggcgcttggctgcgtgctttgtaccgtgtngtcatgccttccacggggcctttttggcgaaccctgcgtgtgctctcaaaaaaaaa

SEQ ID NO: 48888 - DNA, 712 bp, Zea mays
  misc_feature: Ceres CLONE 1458701-F
  misc_feature: Encodes the peptide sequence at SEQ ID NO. 48889
  misc_feature (602)..(602): n is a, c, t, g, unknown, or other
  misc_feature (712)..(712): n is a, c, t, g, unknown, or other
aaagctggagctccccgcggtggcggccgcactagaactagtggatcccccgggctgcaggaattcgcacgagaccattacctagaacatcctaatcgaaaacttttttttcccttcggggatggtattcgtcgtcttggcttcatcctctcgcccgccgtctcgactgtagcaagcggggctgctgtccgccgcattcaggagccatgcgtgaggggatgagggagagggacagaggcgggagcccggatgcgtcaggccctccgcccttccgcggcccggcgtacaagacgaagctgtgcgcgctttggaggggcaggggcggctgcccccgccccaactgcggtttcgcccacggcgaggctgagctccgaaggccgccccctcgcgcctccttccagcctcgcccacgacctgggagaagggattacagagatcatgagtttagactcaggcctgatagaagacactcaccccatgggaggtattcccctgaaagagatatcaggcgtcgttcatttcatgataagagaccaagttctgaagataggggatctagtcattcaagatcacctattaggaagagtgagagaaaacatagntaaagtcctgatggtggagaaacccattcatccgtaagtgttccaagtccagataacgaagaccgaggaaaagattaaatgttctttaagcagtgataaaaaaaaaaggn

SEQ ID NO: 48889 - protein, 131 aa, Zea mays
  misc_feature: Ceres CLONE 1458701-F
  misc_feature (27)..(52): Pfam Name: zf-CCCH Pfam Description: Zinc finger C-x8-C-x5-C-x3-H type (and similar)
MREGMRERDRGGSPDASGPPPFRGPAYKTKLCALWRGRGGCPRPNCGFAHGEAELRRPPPRASFQPRPRPGRRDYRDHEFRLRPDRRHSPHGRYSPERDIRRRSFHDKRPSSEDRGSSHSRSPIRKSERKH

SEQ ID NO: 48890 - DNA, 857 bp, Zea mays
  misc_feature: Ceres CLONE 1458702-F
  misc_feature: Encodes the peptide sequence at SEQ ID NO. 48891
  misc_feature (21)..(21): n is a, c, t, g, unknown, or other
  misc_feature (35)..(35): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
tgggtggccgcccctcctctnatgtattataatcncncccactannnnnnnccaagactggaactcaccgcggtggcggccgctctagaatagtggatcccccgggctgcaggaattcgcacgagaccattacctagaacatcctaatcgaaaaacacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgaagaccagggcagcggggccggaatacagccgcccagcggccagtaccccgtgaggaaagtgggggccatgatcgatgtgcgggatttgaaagactaacagccaattcaaggaactcgcccccccccccccttggggagtaaaagcgggcatgttccaataaagtgcccgcctcgatgcaagcatgccccaaatctcccgcaagaggtgggttgccggacccacactagcacagaaggggggtctggacacctcacacagaaactaatctcccgctaatctaacggatcccatgcaaagaaagggcgcgatttgtatgccaaaaccctactgacatacctttcttaagttatttaaaaacccgacctttccagtagtgcgaaaaacccccggggtgttggccattaaaagccaccgctctggaaccaccacctttttgacaacccagcgcacaccactcaaaagatagaggccggcgggctctcctccatgccggaaggtggataacacacgcttg

SEQ ID NO: 48891 - protein, 59 aa, Zea mays
  misc_feature: Ceres CLONE 1458702-F
MARALGACVLLAVLLGALAPAAAARAHEDQGSGAGIQPPSGQYPVRKVGAMIDVRDLKD

SEQ ID NO: 48892 - DNA, 675 bp, Zea mays
  misc_feature: Ceres CLONE 1458708-F
  misc_feature: Translation starting site: 241
ggagctccccgcggtggcggccgctctataactagtggatcccccgggctgcaggaattcgcacgagaccattacctagaacatcctaatcgaaaaacacacatacttgttgtataccgcctttgttcggagagaatcatcgagtcggatagagtccagggctccaggcgctgcgtactgatcgaagaggcgtgtctcttcgatcgacctccaggcttccagctagctagctagcgagcgatggcattgagggagatcgagtcgacgctgccaccggggttcaggttctacccgagcgacgaggagctggtgtgccactacctccacaagaaggtggccaacgagcgcatcgcgcaggggacgctcgtcgaggtggacctgcacgcccgcgagccgtgggagctcccaggtcagttcaggtggcgaagctgacggccaccgagtggtacttcttcagcttccgggaccgcaagtacgccacggggtcgcgcaccaaccgcgccaccaggacgggctactggaaggccacgggcaaggaccgcgaggtgcgcagcagcagcagcgccaccgccgtcgtcgtcggcatgcgcaagacgctcgtcttctaccggggcagggcccccaacggcgtcaagtccggctgggtcatgcacgagttccgcctcgacaccccgc

SEQ ID NO: 48893 - DNA, 774 bp, Zea mays
  misc_feature: Ceres CLONE 1458711-F
  misc_feature: Encodes the peptide sequence at SEQ ID NO. 48894
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (374)..(374): n is a, c, t, g, unknown, or other
  misc_feature (377)..(377): n is a, c, t, g, unknown, or other
tggagctccccgcggtggcggccgctctttaactagtggatcccccgggctgcaggatttcgcacgagaccattacctagaacatcctaatcgaaaaatatcccatcctgatctctcctcccttcttcagtgcagcagcaggccagcggcacgccacccgcctcactcccgcctccgatccgctgcttactcgccacccggagatggccaccgccgccgccttctccgtctcctcgccggcggcctccgccgtcgccgcgcgatccaaggtgtttggaggagttaaccaggcgagaactagaactagctgccgcgtcggcatcacgcggaagaactttggccgtgtcatgatggcccttgcagtggatgnnncncgntttgaaggagcgccaatggctcctccagacccaattcttggggtttctgaggcctttaaagcagataaaagcgagctgaagctcaatcttggtgttggtgcctataggacagaagagctgcagccatacttgctcaatgtagtcaagaaggctgaaaatcttatgttggagaaaggagaaaacaaagagtatccttccctttgaaggtttaaccgcgtttaacaaaccaacaccagaactattgcttgggagctgaatacccttgttattaatccagggaccgggctgcaacactttcagtctcttctcggggaactggaatcctggcgtcttccctgacgcatttcaaaaaaaagataatttccctggaagcaaaaggggctgaaatccgtccccc

SEQ ID NO: 48894 - protein, 125 aa, Zea mays
  misc_feature: Ceres CLONE 1458711-F
  misc_feature: SWISSPROT Homolog: EC 2.6.1.1 Aspartate transaminase
  misc_feature (56)..(56): Xaa is any aa, unknown, or other
  misc_feature (57)..(57): Xaa is any aa, unknown, or other
MATAAAFSVSSPAASAVAARSKVFGGVNQARTRTSCRVGITRKNFGRVMMALAVDXXRFEGAPMAPPDPILGVSEAFKADKSELKLNLGVGAYRTEELQPYLLNVVKKAENLMLEKGENKEYPSL

SEQ ID NO: 48895 - DNA, 760 bp, Zea mays
  misc_feature: Ceres CLONE 1458714-F
  misc_feature: Encodes the peptide sequence at SEQ ID NO. 48896
ggagctccccgcggtggcggccgctctagaactagtggatcccccgggctgcaggaattcgcacgagaccattacctagaacatcctaatcgaaaactcccccgggccccctctccgctgcgacggcgagcccaagaaaactttcctctaggagcgcatggaggtgtccgctgggctccggccgccgcccgtcgctgcggcagcgtcgctccgaggccgtcggtttgcgtcggtgccgccgctcgcggcttcccattcggtgcggtccgtgtcccgcgcggttaagaataaagcaagtgcaatctatgacctccaaaggaatagaagtaaccttgaatcgctattctgctacgacaaatctgtcccagaggagaatattggaaaaccgtccggactacatctggaaaagaaccatctccagggacaaccctccctgctcaagctgtgaagctaaaggcgctgtgctgtgcacaacatgcgctggttcaggcttgtacgtcaactcgatactagagagccaagggatcatcgagaaagtcagatgcctaggctgtggaggaactgggaacatcttgtgctccaagtggggaggccgggcgcatccctgaatgatataaagcttggactttgcagtgtctcccccacaagacagtacaatcctgctagcatccttccccgagttacgttggcggggtaattttggtctacagggcggccttccccagtccgaagagtttacgattccttccggagagatttt

SEQ ID NO: 48896 - protein, 96 aa, Zea mays
  misc_feature: Ceres CLONE 1458714-F
MEVSAGLRPPPVAAAASLRGRRFASVPPLAASHSVRSVSRAVKNKASAIYDLQRNRSNLESLFCYDKSVPEENIGKPSGLHLEKNHLQGQPSLLKL

SEQ ID NO: 48897 - DNA, 769 bp, Zea mays
  misc_feature: Ceres CLONE 1458721-F
  misc_feature: Translation starting site: 248
  misc_feature (633)..(633): n is a, c, t, g, unknown, or other
  misc_feature (667)..(667): n is a, c, t, g, unknown, or other
  misc_feature (668)..(668): n is a, c, t, g, unknown, or other
  misc_feature (677)..(677): n is a, c, t, g, unknown, or other
tggagctccccgcggtggcggccgctctagaactagtggatcccccgggctgcaggaattcgcacgagaccattacctagaacatcctaatcgaaaattttctatatcgcgttacgtccctccctacccagcgatctaggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtcaaacttcatctgctatcttaggctcttcactgatctagtttgatagtgtttagagtctagatagggatctgatcgtgtgcgatgcttttggtcgatgtgccgcgtggttgcggttgtttcaaactttcctatttcttaatgaaatagggggcttcgccccttcgtcaaaaaaggtgaggatccaattgggtgagggctccgctggtcaggtcacaaggaacatgcttgcaaatganggtgtccgttctttctacaagggtttgtctgccnngatgctgangcaagcgacgtacacgactgctcgtcttggatcctttagggttctaactaacaagcagttgaaaagaatgaagggaagcattttgctctatt

SEQ ID NO: 48898 - DNA, 692 bp, Zea mays
  misc_feature: Ceres CLONE 1458725-F
  misc_feature: Encodes the peptide sequence at SEQ ID NO. 48899
  misc_feature (519)..(519): n is a, c, t, g, unknown, or other
ggagctccccgcggtggcggccgctctagaactagtggatcccccgggctgcaggaattcgcacgagaccattacctagaacatcctaatcgaaaagtccgtcgttgaggatagagagtcacttgcaccgggggagcggagatgaagccggttgtggggatcgtggtgtcgaacaagatgcagaagtcggtggtggttgcagtggaccgcctcttccacaacaaggtatacaaccgctacgtcaagcgcacctccaagttcatggcacacgacgatgacaacacctgcaacattggcgaccgggttaggctggatccttctaggcccttgagcagacacaagcactgggttgttgctgaaattctccgcagagctaaggtgtacgttccaccagctgcaacagcgtccagtgaacgtggtagcaaatctcaacaagctggtggtgctaccaaatgatccatctgaagttactcagaacaagatgcagtcacggcttgtttttctttcgctgtatgtttngttcccttgtggaatgtggttgccatgtttagcatgggagaaaaaatagcaagcagccagcatcctttgcttaattactgttggtcctccgggggggcccttcgtttaaacggtcctagcctttaaggatgtgtgttcccgaattcaccaaaaaccatgggtttccttttgta

SEQ ID NO: 48899 - protein, 104 aa, Zea mays
  misc_feature: Ceres CLONE 1458725-F
  misc_feature (6)..(74): Pfam Name: Ribosomal_S17 Pfam Description: Ribosomal protein S17
MKPVVGIVVSNKMQKSVVVAVDRLFHNKVYNRYVKRTSKFMAHDDDNTCNIGDRVRLDPSRPLSRHKHWVVAEILRRAKVYVPPAATASSERGSKSQQAGGATK

SEQ ID NO: 48900 - DNA, 715 bp, Zea mays
  misc_feature: Ceres CLONE 1458735-F
  misc_feature: Translation starting site: 153
  misc_feature (351)..(351): n is a, c, t, g, unknown, or other
ggagctccccgcggtggcggccgctctagaactagtggatcccccgggctgcaggaattcgcacgagaccattacctagaacatcctaatcgaaaactcgccttcgatcggcggccgccaccctcctcgacttccgtcccgccgccgccgccatgaagggacccggcctcttctctgacatcggcaagaaggccaaggatctacttagtaaggactacacctacgaccagaagctgtccatcttcaccgccagcgcctctggagtgggcctgacttccacagctgtgaagaaaggaggtctttattctcttgatgtcagttcagtttacaagtacaagaataccaccgttngatgttaaactggacacagaatcaaatatctctactacattgactgtgttggacgctttgccatccacaaagcttgtcacttctgtgaagctgcctgactacaattctgggaaggcggagctgcaatacttccatgagaatgcaacttttgctactggtgttggaacaaaacccaacccctgggaattgaatcttctctggggacagaaagggggtccaagggattttcttttgggggccaaaaacccggggtatggaacaccggccccccgggaaaaaaattttccccgggccccctggcttgccattggggggggagccccagaccccaaaataccccgtgggggtggtttccttttgcggg

SEQ ID NO: 48901 - DNA, 745 bp, Zea mays
  misc_feature: Ceres CLONE 1458752-F
  misc_feature: Encodes the peptide sequence at SEQ ID NO. 48902
  misc_feature (420)..(420): n is a, c, t, g, unknown, or other
aagctggagctccccgcggtggcggccgctctagaactagtggatcccccgggctgcaggaattcgcacgagaccattacctagaacatcctaatcgaaaaaaaccacccacccacccaaacccaatggcgtccaacctcctctccgccccgtcccgaaccctagctccgtcgccggcgccggcccccgcgggcctccgcgggcgtgtgccggtgcaggcgcacctcccgcgcggcggcctcggcctcgccccccgccgcagcagccgcgcgctccgcgtgcgcgcgtcggtggcgatcgagaaggagacgccggagagcgagccgcccccgacgttcctccgcgaggacgggcacgggtccgggtccgtgcgggcgcggttcgaggccatgatccggcgggtgcagccccccgtctgcnccgcgctcgaggaggccgacggcggcggcgcgcgcttcgtcgaggacgtctggtcgcgccctggcgggggcggtggcatcagccgcgtcctgcaggacggccgcgtcttcgagaaggccggggtcaacgtctccgtcgtctacggggtcatgccgcccgacgcctaccgcgccgccaagggggaagtcgccaagaacggggccgccgccgcggatgaccacaagcctggccccgtgccattcttcgccgcggggatatagtcggtgcttcacccaagaacccatttgctccacattgcattttaactaccggtactttgagacgg

SEQ ID NO: 48902 - protein, 184 aa, Zea mays
  misc_feature: Ceres CLONE 1458752-F
  misc_feature (79)..(184): Pfam Name: Coprogen_oxidas Pfam Description: Coproporphyrinogen III oxidase
  misc_feature: SWISSPROT Homolog: EC 1.3.3.3 Coproporphyrinogen oxidase
  misc_feature (99)..(99): Xaa is any aa, unknown, or other
MASNLLSAPSRTLAPSPAPAPAGLRGRVPVQAHLPRGGLGLAPRRSSRALRVRASVAIEKETPESEPPPTFLREDGHGSGSVRARFEAMIRRVQPPVCXALEEADGGGARFVEDVWSRPGGGGGISRVLQDGRVFEKAGVNVSVVYGVMPPDAYRAAKGEVAKNGAAAADDHKPGPVPFFAAGI

SEQ ID NO: 48903 - DNA, 672 bp, Zea mays
  misc_feature: Ceres CLONE 1458753-F
  misc_feature: Encodes the peptide sequence at SEQ ID NO. 48904
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (553)..(553): n is a, c, t, g, unknown, or other
  misc_feature (556)..(556): n is a, c, t, g, unknown, or other
  misc_feature (557)..(557): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (602)..(602): n is a, c, t, g, unknown, or other
  misc_feature (603)..(603): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (638)..(638): n is a, c, t, g, unknown, or other
ggagctccccgcggtggcggccgctctagaactagtggatcccccgggctgcaggaattcgcacgagaccattacctagaacatcctaatcgaaaaaacacattgttagtattagacactttctagttcatcacccatggcaaagttcttcaactacaccatcatccaaggactcttgatgctttccatggtacttctggcatcgtgtgctattcatgcacacataataagtggggaaactgaagaggttagcatcacagggagcccgacagtgatggtcatgatgggggcaaaccgaaagataattgaagataataaaaatttattgtgctatctaagggctctagagtactgctgtgcgaggaccagacaatgctacgatgacataaagaagtgcttggagcattgccgtggttgaaaagtgtaataaaggatatgctttctttggatcttagttggtgatcagaaaaatgtctaccaattcatgcatgtaccaaaagataatataaacctgctcaaaaaaacctggttaatttnnnnnaannnnnnnnanaannaaaaataaaaaaaaaaannnaaaaaaaataattaaaaccaaaaannaaaataannntaaaacaagaaatcatttttttttnaaaaaaaaaaaacgcttttttttctatccccccc

SEQ ID NO: 48904 - protein, 93 aa, Zea mays; identical to SEQ ID NO: 46618
  misc_feature: Ceres CLONE 1458753-F
  misc_feature (18)..(91): Pfam Name: BAP Pfam Description: Basal layer antifungal peptide (BAP)

SEQ ID NO: 48905 - DNA, 805 bp, Zea mays
  misc_feature: Ceres CLONE 1458761-F
  misc_feature (261)..(261): n is a, c, t, g, unknown, or other
  misc_feature (423)..(423): n is a, c, t, g, unknown, or other
  misc_feature (760)..(760): n is a, c, t, g, unknown, or other
  misc_feature (805)..(805): n is a, c, t, g, unknown, or other
acagctggagctcaccgcggtggcggccgctctagaactagtggatcccccgggctgcaggaattcgcacgagaccattacctagaacatcctaatcgaaaaatacgccgccatcttcgcaagccaccgcaaccgaagcccgccttcgccgccgccgcctctgcgatccccgcaaggtcgcaaacatgtctaccgtgctccagcgcccgacccccggcacggtccagtgcttcggccgcaagaagacggctgtggccgtcncctacaccaagccggggcgcgggctgatcaaggagaacgggggcccgattgagctcctctggccggagatgctccgcctcaaggccttcgagcctattttttttcccccccccctccggggggggggacatccactttatttatccccccccctatttgtcntgaaaaaaaccaaaaaatctacccgcttccccccagtgtggtcgccaagtggcctccctttccctccatacaagaatatcctccctacaatcccccccattaacactgtcgtgtttggatgtttttccctccggctactacccccctcccttccccggctttccatcttcctagttatgtttaagcttaataaaatcttatctattcctcttgtggtcctctgcccacaagcttcccccactttccctccaaccctacacacaactctctctgttcgctctccccatttttccccataccctcttctgttagtgtggccttcccgcctatcgttcgngattcttctctatcttattcccttgttccctctctcagcttttcn

SEQ ID NO: 48906 - DNA, 703 bp, Zea mays
  misc_feature: Ceres CLONE 1458762-F
  misc_feature: Encodes the peptide sequence at SEQ ID NO. 48907
ggagctccccgcggtggcggccgctctagaactagtggatcccccgggctgcaggaattcgcacgagaccattacctagaacatcctaatcgaaaactcgctccctgcctccctcagttccgctcttcgtctttgggggccattgcccgtgcggccgtgcgtcacccgagcccgtgcccggaatctttgtagaagcgtctggaggactcccacccggctgccagccatggctgagaatctggcgcccgagaagcgccactccttcgtgcacaacgggcagaaggtgttcgagtgggaccagacgcgggaggaggtcaacatgtacatcgagctcccgaagggtgtgccaaccaagctatttcactgcaacattcaggctagccacgtcgaggtcggcatccgcggcaaccccgccatacctcaaccatgacctgacaccacccagtgaagacttgactcgtcgttctggacaatagaagatggtgagatgcatatcacactgcaaaaaagaaagaaagggaaaaaccatgccctctcccaatacagggcaaggggattttggaaccctatgctggcaaacaaagaacaaaggcggcttatgctcccaagggtttaagggaaaaaaaccctggggttcaatttttccaagggctcaggttccgtggaaccctgccctgaaccaaaaaaccttcgtggggagggg

SEQ ID NO: 48907 - protein, 67 aa, Zea mays
  misc_feature: Ceres CLONE 1458762-F
MAENLAPEKRHSFVHNGQKVFEWDQTREEVNMYIELPKGVPTKLFHCNIQASHVEVGIRGNPAIPQP

SEQ ID NO: 48908 - DNA, 698 bp, Zea mays
  misc_feature: Ceres CLONE 1458765-F
  misc_feature: Encodes the peptide sequence at SEQ ID NO. 48909
  misc_feature (681)..(681): n is a, c, t, g, unknown, or other
  misc_feature (689)..(689): n is a, c, t, g, unknown, or other
tggagctccccgcggtggcggccgctctagaactagtggatcccccgggctgcaggaattcgcacgagaccattacctagaacatcctaatcgaaaactcgatttctcgcggagcggccctccacctttatcgccgccgccgccgttgctgtgttccgtctcttcgccgatggcttcggccaagagaatgatgtcaggacctcctgcttctggatatgaccggtcacctctattttacggaggaggtggtggcgccccacctccaattccgcttggaactggtagctatggtgctccatatccacaccttgggatgcgatatggctatggtccaccagtaggacctcctggttcatacggtcttttctcttcatatggtccacctgggccaatgagtggtatgggatatggcccaggacctgagctaggccgatatagctatgggtttagaggttctccaatgccggtttctagtccatggtctggtggagcattagctgaaaacaatgacaacattgcttcacgaaagcgccgtggaggccctgatggactttctgagggtgactggacctgtcccaaatgcgacaacattaacttttccttcagaagcacttgcaacatgaagaaatgtggagccccgaggccaactccgggaggtaacacgagctcatctcgcaaggnacacagtncataggaag

SEQ ID NO: 48909 - protein, 173 aa, Zea mays
  misc_feature: Ceres CLONE 1458765-F
  misc_feature (129)..(160): Pfam Name: zf-RanBP Pfam Description: Zn-finger in Ran binding protein and others
  misc_feature (171)..(171): Xaa is any aa, unknown, or other
MASAKRMMSGPPASGYDRSPLFYGGGGGAPPPIPLGTGSYGAPYPHLGMRYGYGPPVGPPGSYGLFSSYGPPGPMSGMGYGPGPELGRYSYGFRGSPMPVSSPWSGGALAENNDNIASRKRRGGPDGLSEGDWTCPKCDNINFSFRSTCNMKKCGAPRPTPGGNTSSSRKXHS

SEQ ID NO: 48910 - DNA, 675 bp, Zea mays
  misc_feature: Ceres CLONE 1458770-F
ctggagctccccgcggtggcggccgctctagaactagtggatcccccgggctgcaggaattcgcacgagaccattacctagaacatcctaatcgaaaacccagtagtgtccattcggtgtctgtctgtccactctcgtgtcctcacgccaggtccagtcaacctgccccagcgccatcccttatttaagtgcttgtccagggagccctgttgtctcaagctttagctggatccttgggcatctctgtgaaggtgtgtgcaagcctgagttcatctccttagcctccgcgtcggctttgttcagttcatcaagtgccattccattgtctggtactctggtgccacagcaaccatccttccacctcgccgtggtcagagcatctcgagaagtttgttacccagaacggagttgcgccaccgcagaccggagccgtgaacagcctctgtgttgaccgaacaactcacgctttctccggtcgattccttgtgagcaccaaagtttagaactcctaccagaaggagtgaagattcaagctgaagtggtgactgaagaggagtctactccagtggctgctgatcaagtggaggagccatctaactggggtttaatagagggatcgagtacctcttcactgcaacaaaggtgatgaggagtattctaggagttcctgtggct

SEQ ID NO: 48911 - DNA, 757 bp, Zea mays
  misc_feature: Ceres CLONE 1458775-F
  misc_feature: Encodes the peptide sequence at SEQ ID NO. 48912
atagctggagctccccgcggtggcggccgctctagaactagtggatcccccgggctgcaggaattcgcacgagaccattacctagaacatcctaatcgaaaaatcaaccgcagtacacggcgtatcattcccagcgaccacgagagactagctagccaagtgcatgcaaccagccatgcaggccgggaagacggcagtggaggcgacgaaggaggccgcggccaacgtcggggcctcggcgaacgccggcatgcagaagacccgtgccgccgtgcaaggccaggtggagaaggccacggcgcgcaacgcgtcggacaaggtcgcggccgaggagcgccagcgggagcgcgtgcgcgccgcggagctggagaaacaggacgccgtgcgcgcccacgcggccgccgagggagcgcgccattgggggcccggccccgtaccagcacccagcacccgtcccaaggggccgccccggggatccgccccccaacaaggaattatggccgccgaaaaaattccccccccccccgggcgcgggccccttcaagggccgggggtctgggaaaaaccccccccccccccctttgggggcacccggaacgggggggggcccaaaggcgcgcgggaaaaaaaccccggtttgtgggggggaggaaccttctctcccagggggccccgcggcacccgggggagaaaaatactccttgtaggggggcgtgcccccccggggaaaacgcccccccaccggtggggaaaaata

SEQ ID NO: 48912 - protein, 194 aa, Zea mays
  misc_feature: Ceres CLONE 1458775-F
  misc_feature (8)..(80): Pfam Name: LEA_1 Pfam Description: Late embryogenesis abundant (LEA) group 1
MQAGKTAVEATKEAAANVGASANAGMQKTRAAVQGQVEKATARNASDKVAAEERQRERVRAAELEKQDAVRAHAAAEGARHWGPGPVPAPSTRPKGPPRGSAPQQGIMAAEKIPPPPGRGPLQGPGVWEKPPPPPFGGTRNGGGPKGAREKNPGLWGGGTFSPRGPRGTRGRKILLVGGRAPPGKTPPHRWGKI

SEQ ID NO: 48913 - DNA, 607 bp, Zea mays
  misc_feature: Ceres CLONE 1458778-F
acccggcggtggcggccgctctagaactagtggatcccccgggctgcaggaattcgcacgagaccattacctagaacatcctaatcgaaaaactcgagcgcagccagccagccagtttgccgcttgggcgccatgctctctagagcttcgtaccctctaatagagatccggcgcgggccaataaacacccgtgcttactacagagtcgcagatgggccggcctcatgatgaggtcatcgcgtcggcgccatggccgcgcgctcgaggcggcgccagaacgcgaagaccccgcccggcttccgatccaaacctggcgccttacccgtgcccaggcttctgtgtggcggggcttaagatcgcctttggcaaaacacgctgggaacaggcccctgttcaaaaaggtataaggggcccgtcccctggatcctcccggttgccgaaaagttccttctaatttgggtttggcgcccttgtttttttaatgggtccaacataccgggggtttgttgaaaatgttttcccccttgttattgttatatttcttctctccgcttgtgtgtttgctctgaaatactaaagatgcacctctggcgacattttttatcat

SEQ ID NO: 48914 - DNA, 706 bp, Zea mays
  misc_feature: Ceres CLONE 1458780-F
  misc_feature: Encodes the peptide sequence at SEQ ID NO. 48915
aaagctggagctccccgcggtggcggccgctctagaactagtggatcccccgggctgcaggaattcgcacgagaccattacctagaacatcctaatcgaaaacgattgggtgccggtttgccaaggacatggaggatgcgagcggcagctcgtcgtctccagccgtcctacggaacaagtattgggtcctccgccacggccgcagcgtccccaacgagcgaggtctcatcgtctcatctctggagaacggcacgaagccggagttcgggctggccccgcagggggtcgagcaggcgcgcgcggccggcgaaaagttccggaaggagcttgacgagattggtgtgccggtgggttccgtcaagattcgttactcgccgttctcacggaccaccgagacggctagagtggtcgccggtgtgctcggcatcccctttgaagctctagttgccaagcggggctgggacttcgtgagcgctactttgggccatcataagagttactttcccatgataagtttgcagactttgggccagaaaaagaaacccatcccgtgtatggcttcctgaagggggggaaaggcccccccaaatgttgctaagaaaattttccgccggggctgttattctggagaaaaaccaagtttccgggggctcccgcattctttattggccgccctgggggacccccccaaaaaattttttaaggg

SEQ ID NO: 48915 - protein, 145 aa, Zea mays
  misc_feature: Ceres CLONE 1458780-F
  misc_feature (17)..(130): Pfam Name: PGAM Pfam Description: Phosphoglycerate mutase family
MEDASGSSSSPAVLRNKYWVLRHGRSVPNERGLIVSSLENGTKPEFGLAPQGVEQARAAGEKFRKELDEIGVPVGSVKIRYSPFSRTTETARVVAGVLGIPFEALVAKRGWDFVSATLGHHKSYFPMISLQTLGQKKKPIPCMAS

SEQ ID NO: 48916 - DNA, 828 bp, Zea mays
  misc_feature: Ceres CLONE 1458783-F
  misc_feature: Encodes the peptide sequence at SEQ ID NO. 48917
  misc_feature (15)..(15): n is a, c, t, g, unknown, or other
  misc_feature (16)..(16): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
ttttgtgtttggccnncttcgcgtgtgtgtctttctgtgtttgnnnnnnnnnnnnnttcaggctggagctccaccgcggtggcggccgctctattactagtggatcccccgggctgcaggaattcgcacgagaccattacctagaacatcctaatcgaaaatgctcgagtccgtggtggagcgggtgccggtggccgacctcgccgccgcggcgcggatctcgcgggagtggctccgcgcggtgcgcgccgcgctgcgccgccgcccgctgcggctgccctggctcgtcgtgcacctccaggggcgcgggggcctctggtgcgcctcggcgtacgacccgtgctcgggcgcctggctcgccgtgccggcgccgcgccataccagaccgtcgcacgtccgcctcctgcgcggggcgcgcggggacttcgttttgcacaatctcattctcagaggctcctccgtcctcgggccgaccccgtttgggttctggcccggatcgcttcacgttgtaatgccccctctgcttgtgggcgcattccgtcctgcttggtttaccccacgcatggggttgcactgtggttcatatgtggctctgggtgggccctttgcctctggctttggttacttggtcctaaggggtgagcatactatcccccccccgtcgcattaggtttcactaaatgaacaggccgcgtgggaacggctcttgggatttccgaagtcgcgtggacctgtcttttttgtaatccctcctccccgatgaaaaggggtttctcctccggggcgcccaccggaaccacccgggtgagtacctacttggagataggt

SEQ ID NO: 48917 - protein, 169 aa, Zea mays
  misc_feature: Ceres CLONE 1458783-F
MLESVVERVPVADLAAAARISREWLRAVRAALRRRPLRLPWLVVHLQGRGGLWCASAYDPCSGAWLAVPAPRHTRPSHVRLLRGARGDFVLHNLILRGSSVLGPTPFGFWPGSLHVVMPPLLVGAFRPAWFTPRMGLHCGSYVALGGPFASGFGYLVLRGEHTIPPPSH

SEQ ID NO: 48918 - DNA, 743 bp, Zea mays
  misc_feature: Ceres CLONE 1458784-F
  misc_feature: Encodes the peptide sequence at SEQ ID NO. 48919
tctgaactagtggatcccccgggctgcaggaattcgcacgagaccattacctagaacatcctaatcgaaaactctccgaccacgactgtgcgccttcctaagtaaccctagctcggcgccctccctccgcgacatccaagcccggcaatctcatcgtcgcgcttgcaccgttacgcagtgcgacctctgcgtcttcgaatccaggaaggtagagaggaggaggaggtttgtggcacgatttgaccagcccaatggttccctccgagatggggagtgtcgcgaccgccgtcagcacacctgatgccgacaagctgctccatggccctatcggtggcaggaggggcaacaaaccgggtccccaacaagatgcttccccgcttaaaaggggggtaggggttgaataaaaccacccgaaatgagcgcttgtgtaagaacctgggtcaggtatccttggaggtccatatctacgtctactatgggggaagggtttgttttcgtgagctgaaccaccactctggaaagcccaagaacaccctatccggtgtcccgataagtctccgcttgtcgtataaggacccgagcgcgctcctctgcgcgaaagccatcccgccttgttacctggacgcttggcccgcgcggacggcatgggttctcgtcccgaacacccggatggggggtttcgtgtggagcgcaacattggtgtggacctttaccacaaaaaggtaggttcgtctctccggccg

SEQ ID NO: 48919 - protein, 45 aa, Zea mays
  misc_feature: Ceres CLONE 1458784-F
MGSVATAVSTPDADKLLHGPIGGRRGNKPGPQQDASPLKRGVGVE

SEQ ID NO: 48920 - DNA, 709 bp, Zea mays
  misc_feature: Ceres CLONE 1458785-F
  misc_feature: Pfam Name: K-box Pfam Description: K-box region
  misc_feature (31)..(31): n is a, c, t, g, unknown, or other
  misc_feature (63)..(63): n is a, c, t, g, unknown, or other
aaagctggagctccccgtggaggcggcctcnctagatcagtaacacccccgggcggcaggaangtgccccagaccattacctagaacatcctaatcgaaaaatacaggccattttgccgtttccggcgcgcgcctctgaacaaacccgaaagcccccctcatcgccattcctcttcctgccatggcgatcctctttactcctcccctcccaccaccaccgcccctcccaactacaccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactcgcgccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacc

SEQ ID NO: 48921 - DNA, 719 bp, Zea mays
  misc_feature: Ceres CLONE 1458792-F
  misc_feature: Translation starting site: 158
aagctggagctccccgcggtggcggccgctctataactagtggatcccccgggctgcaggaattcgcacgagaccattacctagaacatcctaatcgaaaaaggtagaagacgactgactgcctcgagcagcagagatcagggaggccgagggcgggatgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttcttcctcgtcggagtcgacagcgatgagaatgagttagctatccttgaattcatacgtcgttctggtggaaactatggatcgccacttcggcaatgtgtgcgagctcgatatcatggtccatctggagaaagtgcacttcctgttggaagagatggtgatgaatggttgcattgtggacacaagttaacagaccatgttggcaccaataaaacttatgggagaaaactccctaaaacagcgatatctattttgggtggtcttacatcccacttcctagcaaatttgccatgtctgccccttttcaataaattttccctctgtttggtggaagcgcaaaaccaatcccctgtaaccttggatt

SEQ ID NO: 48922 - DNA, 670 bp, Zea mays
  misc_feature: Ceres CLONE 1458793-F
  misc_feature: Translation starting site: 186
agtggatcccccgggctgcaggaattcgcacgagaccattacctagaacatcctaatcgaaaagcatcatactcttcatttaccgttttcttatgctttacgcgtaccccaacctgcttgcagctagacttttttttgctcctcctcctcctgctgttaattgccactgtaccagttagtcacacatgaactgtctgctgcagattgcatttccaaatgaagctgatggcttccacgatcagctcctcaaagtgcaagacaacataccgatctgcgcctccatcatcgggcagcgcctggcgctctactcgctggaggccggccccgagtggatcaaataacgggtgaaagacctggtgaaaaaccgagcgctgctggtggaggcgctgtccccgctcggcgaggacaaccgtcaagggcggtgcagggcgccatctacctctgggcaaagctaccggacagctgctcggacgacttcaaggctgtcaggtggctcgcgaacaaacacggcgtcgccgtgatccccgggagcgtcagcgaaggacccgggtacatccgcgtctccttcggagggctcaagaaagaagacaccaggctggctgttgataggcccaggcccggcctgcaagaactggtgaccgatggaatggtaaatggacggctccatggg

SEQ ID NO: 48923 - DNA, 616 bp, Zea mays
  misc_feature: Ceres CLONE 1458795-F
  misc_feature: Encodes the peptide sequence at SEQ ID NO. 48924
tggagctccccgcggtggcggccgctctagaactagtggatcccccgggctgcaggaattcgcacgagaccattacctagaacatcctaatcgaaaagtgttttcggccgtgcgctcgctggcgcaagccgcgcgaatcggatcgctgtccgcctctccatttcccctcgtccgcacacccgagcctcgcttccgcctcccacttcccaccaggccaccaccccgtccggcgatcccgatcgcgagacgagggtagcgagatcgagaggattgtcgcggctgccgggcggcgctccagttccaagtcgaggcgaggaactacacgtgtgatatctgcaactcatatggctgggacccacaagaagcgaatggaagaccgttttggtagttttttctcatttgatgaagattctgaaagtgaggacatatcgctggatgagttggaggaggaacttaaaagagccccaaggaactggggaatggtacctaagaaaacctttttttaaccccaggggggggaaaaaaaaagcggggggggtggggggcaaattttggggtggagagggggggaaacacctagggcctattatagagaaaaaaaaacctcttttttttt

SEQ ID NO: 48924 - protein, 53 aa, Zea mays
  misc_feature: Ceres CLONE 1458795-F
MAGTHKKRMEDRFGSFFSFDEDSESEDISLDELEEELKRAPRNWGMVPKKTFF

SEQ ID NO: 48925 - DNA, 751 bp, Zea mays
  misc_feature: Ceres CLONE 1458806-F
  misc_feature (361)..(361): n is a, c, t, g, unknown, or other
  misc_feature (409)..(409): n is a, c, t, g, unknown, or other
tccccgcggtggcggccgctctatactagtggatcccccgggctgcaggaattcgcacgagaccattacctagaacatcctaatcgaaaaagttaaagggttcctctctacgtacgtctcccagtccgacaggacttctcgagcgagttagcgaatcccattctcccaggcagggaagtacatggtagggatcgaggtggagcccgaggaggcgacgcgcccctcgtcaccggaataggacgagaaggcagctgccgccgcccgcggggaggcggcgcgcccatcgtattcagggcgaccagaggaggcgcccagacccggcgcgccgcttctggaggacaggtgttcagggggtacgganaacacgaggaatgcttcgaggacacgctcctatattggcaccccccanagaacactagacctccagccaattatgcgaaagcttaggggaagccgttttttgcgtccggacaatctgaagaagcatcttctaaatgtgtattggcattgcaggttgctgcagacctggatttttattaagatctccgcgccgcatgtctttccgagcgcgctttgtttttctcgaaatgtgtgaagaactcgggctgcttaaggaagccccatggcgctgaggtttaaaccatcgtatcggtgagccccggctttgtaggggtggccctgcccaaagcctaaataccctgaataggactcttcgcccacttgaaaaggattccgccgggataactccttt

SEQ ID NO: 48926 - DNA, 757 bp, Zea mays
  misc_feature: Ceres CLONE 1458811-F
  misc_feature: Encodes the peptide sequence at SEQ ID NO. 48927
  misc_feature (335)..(335): n is a, c, t, g, unknown, or other
  misc_feature (479)..(479): n is a, c, t, g, unknown, or other
cccccgggctgcaggaattcgcacgagaccattacctagaacatcctaatcgaaaaattcgcaccaccgccgcgccgcccaaaccctagccgccgccgccgccgccgccgccatggtcgccgtcaaccgccccctcgtctccgtgaaggccctagagggcgacatggtaaccgacgcccccgggatcgccttaccgcccgtcttcggggcgccgatccgccccgacgtggtcaggttcacccacaagctgctgtcctgcaacaagcgccagccctacaaagtctcccgccgcgccggccaccagacgtcggccgagtcctgggtttattttacantccgtgtttcgtagtcccggggttgtcggcggcccccccccaccgcgccgggcaaggagggttcggcaacgtgtgccccggcgtgagcaatgttccccccccccaagagctggtgctggtggttttttctgggtgaatattaancacctgccgggtgagcgatctccttcgggtgtcgtcggcacctgccagccccgggccttctgtctatgggggtaggccaccggtatccgagcctgttcccggaaaagccccctggtctttttcttaatatccggaaaatccattttaggaatatctctccagaggtctcccaattcccgacaagcaaaatcgggcccctcccgcgccgccggctaataaagctcgtatggaaattcagagcgggcatacccccccgcgagaaaggatacaagaaacca

SEQ ID NO: 48927 - protein, 78 aa, Zea mays
  misc_feature: Ceres CLONE 1458811-F
  misc_feature (75)..(75): Xaa is any aa, unknown, or other
MVAVNRPLVSVKALEGDMVTDAPGIALPPVFGAPIRPDVVRFTHKLLSCNKRQPYKVSRRAGHQTSAESWVYFTXRVS

SEQ ID NO: 48928 - DNA, 757 bp, Zea mays
  misc_feature: Ceres CLONE 1458813-F
  misc_feature: Encodes the peptide sequence at SEQ ID NO. 48929
  misc_feature (346)..(346): n is a, c, t, g, unknown, or other
  misc_feature (379)..(379): n is a, c, t, g, unknown, or other
  misc_feature (418)..(418): n is a, c, t, g, unknown, or other
  misc_feature (650)..(650): n is a, c, t, g, unknown, or other
gctcttaactagtggatcccccgggctgcaggaattcgcacgagaccattacctagaacatcctaatcgaaaaccccattccaagcgcgagggttttgctgctgctccagccggacccaggacaagaagcggcgcgatggcggtgggcgacctggcgttcaaggcgctgacggctgggctgggcgtcgccacgctctacctcgccgccaccttctccgtcaacgtctaccgcggcctctcgtggcactccgagcagtccaagctagaaaaggcgaaaaccgaagattgaaaaagaccagcaagcagttttagagagcagatgaaaggcgggcatttttgttgatgncttatctttcgtgtcaattgtgtttttgcttgncccccccccctttcacaaaaacaggagagtatctccaancccgcgatatctataccccatccaacaacccgcctgggatgattattcatcttttcgggacacgtcctggtttggatcattatttaacaacttcgcaaatggcttggggatggaaaatttttaactctgtgaactgctatgcctcacttaaaaaggggggaaccccggacgggttttttccccttttctataaataaaaaaaaaaaacctttcccatccctccagcactagngggggggcccgggcccccaattccgcccttagcggaagtcttattaccgccccctcacctgcccgccctatttacaacgccacgactacggacaacccttggcctta

SEQ ID NO: 48929 - protein, 50 aa, Zea mays
  misc_feature: Ceres CLONE 1458813-F
MAVGDLAFKALTAGLGVATLYLAATFSVNVYRGLSWHSEQSKLEKAKTED

SEQ ID NO: 48930 - DNA, 770 bp, Zea mays
  misc_feature: Ceres CLONE 1458815-F
  misc_feature: Encodes the peptide sequence at SEQ ID NO. 48931
  misc_feature (368)..(368): n is a, c, t, g, unknown, or other
  misc_feature (374)..(374): n is a, c, t, g, unknown, or other
  misc_feature (375)..(375): n is a, c, t, g, unknown, or other
  misc_feature (689)..(689): n is a, c, t, g, unknown, or other
ggagctccccgcggtggcggccgctctataactagtggatcccccgggctgcaggaattcgcacgagaccattacctagaacatcctaatcgaaaaaaaaaggcagccttctcaccgtcggacccggcgatgcagcggcacgtcgcctccggccggccgtcgggcacggacggctccgacttttcttaccgcatggtcgtcgaatcccggtaccagagggtcgccgagggcagatcccgcctcgcgcgcctcatcctcgtgcaggcgctgcacctagtggccggaggcttgcttctattgctgtcgttgtccaggggggcggcggtgaacaagttcgccgtgctgtccatggccgcggggattcttgnccaaanngggggggggattagggggattgcggaccatgccccccgctgcttcggttttcccaaccttggcatcaattgcggttgcattctctgtgacttcatatttccggacagaattgttcttggaggttttaaaggaaaacccaaaggccatcccaagctccaaatgcctgaagccgcttcgggtgctctttgggttcctggctgcaagagggggttttgagttaaaagttacccaacaccggggaaaaaatttttcctctcacaaaaaaccttctgtaaaggggttgaacctttttaactttttttttcccgcgctcnagggcccacccacgtttgggggtatcaaaaatttggcgcccaggcggggattttttttgtgccacaaaaatagtatcttgg

SEQ ID NO: 48931 - protein, 153 aa, Zea mays
  misc_feature: Ceres CLONE 1458815-F
  misc_feature (80)..(80): Xaa is any aa, unknown, or other
  misc_feature (82)..(82): Xaa is any aa, unknown, or other
MQRHVASGRPSGTDGSDFSYRMVVESRYQRVAEGRSRLARLILVQALHLVAGGLLLLLSLSRGAAVNKFAVLSMAAGILXQXGGGIRGIADHAPRCFGFPNLGINCGCILCDFIFPDRIVLGGFKGKPKGHPKLQMPEAASGALWVPGCKRGF
